United States Patent 10,233,495 (METHODS AND COMPOSITIONS FOR SCREENING AND TREATING DEVELOPMENTAL DISORDERS) - sequence listing, part 142

SEQ ID NO: 713 - DNA, 4300040 bp, Homo sapiens (residues 2,150,021-4,300,040 of 4,300,040)
gtggagggtcagtgtggcagccttttgcacccacacttgaggcacccgagttctcgtctggcatacaggaggaatgacgttgcacaaatgaattgaattgaaggtggtaaatgcggggaattttattgccaatgaaagtggctctcagtgggtaggggagctgaaaaggagacaaagtgggaaggtaatcttccattgaagtccagctgtccttggctggactcctctctgaagctacactgtcaagctgtccctctgaagtcaagctgcttctctctgacttccagctgtagtctctgacattcaactgcttctcctctctctactggctgagcctggagtttttatgtgcacaggatgggggacagtgtgggccatgggtggtttttgaaaaggcaatattcaagcaggaaaacagggatgtaagttttcattttgggctgcaggttcaggcagaatttctctgcctcctgtcgctatcaatatctttgctttgtagagaatctctgctcttcttcacagttgtcttaattatctgtgaatttctattcttccctatgtatttcagaatattttaagttgctaaaaccttttgatataaattgtactaaatgtatagatgattttgaaagacaattaacgtctttgtgatgttaaaattttccattcttttttttttttttgagatggagtcttgttctgttgcccaggctggagtgcagtggcgtgatctcggctcactgcaacctccgcctcccaggttcaagtgattctcctgcctcagcctcccaagtagctgggactacaggtgtgtgccaccacacctggctaatttttgtatttttagtagagacagggtttcaccaagttggccaggatggtcttgatctcctgaccttgtgatctgcccacctcagcctcccaaagtgctgggattacaggcataaaccaccatgcctggcccattcttagttttttttgagatggagtcttgctctgtcacccaggctggagtgcaatggcgcgatctcggctcattgcaacctccgcctcctgggttcaagcaattctcatgctttggcctcccaagtaggactacaggtgcctgctaccacacccagctaatttttgtatttttagtagagatagtgtttcactatattggccaggctggtcactcctgacctcaagtgatctgcccccgttcagcttcccaaagtgctgggattacaggcgtgagccaccgtgcccaccccaaatgttccattctctaacatgacatgtctttccattttttctagtctttatgtattttattagagttttaaaacttttcttgtatattctttgataggcttatttatattgttaaaatagataattgggatgtcattaggatgagaccctctaatgcatgaggttcttaccagagaaaccaaaccccaactcactgtaaactgtaaaatgaaacttaggctaaaccaatcagaaactgttagctaaacttctaacggactttccaactttaaccaattaaatattttctttgtcttgctttcatgagcaccttataaaatttctcctttgtatcttctcagtagagcactgacctgcttatagtctggtgttgactgatgaatcgcagaatgctcaaataaactcattaagattttaaggtgtctaagtttatcttttcttttcttttatttatttatttatttattttttgagacagagtcttgctctgttaccctggctggagtgcaatggcatgatcttggctcactgcaaactctgcctcccaggctcatgtgattctcatgcctcagtctcccgagtagctgggacctgcaggcttgtgccaccacacctggctaatttttgtacttttagtagagatggggttttaccatgttggccaggctggtcttgaactcctgacctcaagtgatccccccacctcagcctcccaatgtgctgggattacaggcatgagccactgcacctggtggtcgtgcctatgtttatctttcaatgctatatagtatagatgggatttttttttttgctgctgcgaatggtatctcagtttatattatattttctacttggtaatatctgatgtagaggaatgctacttattttcaaatattttaaaagattgcaactgtgcttattttttttaaatgatgttctgttgagttttctatgcatatgatcacatctgtcacctgaatataatgacagctttgtctcttcttttcaaatcttaaatcttcatttcttattgtcttacttcagtgtccacattgactaggggtggggatattgtccatccttgcctcatctgtaactttcaaggctttgtgccttcatcaagcatggcattttttattgaggtataagttccatgcagtgaaattcatagatcttcagtaaactctgtactcagtttggtggacacagagcatcttctttacctcagaaagtccccagtgctcctttacagttaatctttctgccctccagaagcaaccaccaccctcatttctatcattattacgttagttttgcctttctagagtttcatgtaaatggaattacagcagaatgtactttgatgtgcctggttgttttccatcagcatagtatttttgagaaccatccctgttgttacttgcatcagcagtttgttccttttcatcgcttagtagtatttcattgtatgaatacaccactgtttgttccttctcctttggatgagcatctggattgtttctacttcagtactattatgaataaagctgctatgaacattattatacaaagcttttttgtggacatatgctcttatctctctaggaatggaaatgttgggtcatagtgtagatgtatatttaactttttttctttctttctttttgttttttttttttttttttttgagatggactcttgccatgttaccaggctggagagcagtggtgcagtcttggcttgctgcaacctctgcctccagggttcaaacaattctcctgcctcgggttcccaagtagctggaattacaggcacatgccaccatgcccagctaattttcatgtttttagtacagaaggggtttcaccacattggccaggttggtctcggactcctgaccccaggtgatccgcctgcctcagcctcccaatgtgctgggattacaggcatggccaccacggcctggccaactttttaagaaaccattagttttgatgtagtgtgggcaaagcctcaaattggggcttagcccaggagggtttgaggcttcgcccaggaaagaattcaaggttgagctggtggtattcgcaacttttattgaagcagcagtgcacagcagcggcagaggtactgcttcttgcagatcagggctaccccacaggcagtgtgcccagagtagcagctcagaggccgttctgtggtcatatttagacccacttttaattacatgcaaattaaggggcagagtatgcagaaatttctagaaaaagggtggtaacttctgggtcgttgggtagttgtcatggcaatggtaagctgacatggcacactggtgcgcatgtcttatggaaagctgcttccattctcttttagctactcctcaatttgggctggtgtctgagctctgccttcggagttgagtcccacctcctacctcagttttccaaagcaattatttcatctcacactcctaccagcaatgtatgagagttctaattgctctacatcttctccagcatttagtgttataaatctttttcattttaaccattctatcaagtatgtagtggtgcctaattgttgttttatttgcatttccttgatgaataatgattttaagcactttttccatctacctattggccatttgtatatcttcttttataaaatgtctgagtttttgcccatttaaaaattgtggtttttttttttaaattactgggttgcaagaattctttatattttatggatgcaagaatcttcattagatatatgtgttgtgaatattttctcttggcagctttcttgtttattttcttgatggtggtttctgatgaagagaagttttaaattttgatgaagtctaacttattaatcttttcttttatgatttatgctttctggatcctccttaagaattaactgcttactctgagatcacaaagatattcttctagcagttctagtagcttcattattattttagctcttatgtttaggtctgtgatccatcaagttggattttgtgtatagtgtgagacaacggttgatgtcctttatttcctatacggatattcaattctctaagcaccattggttaaggatattttcctttccccatcgaattgttttgatacttttattaaaaatcatttgattttatgtgtataagtctgtttctgtgactctctatttgattccagtagtttatttgactatcctttcactaatagcccattatctttattgcagttttgtttgtctgaaagtatcttcattttgccctcatattttgaagggtatttttgctagatatagaatatttgcagtttttttctttgagcatcttaaagatgtcattcaatatccttccagcttctaaagtttttgatgcaaaatcatcaaatcttactttttcttctttgaaagtcatgtgtctttattctctagttgcttttaagatttgccttttagctttggtgtttggcttattgacaaggaagtgcttaggtgtggttttctttgtaattatcttgcttgggtttgacccagcatcttgaatctgtacattgatgtcttcgatcagtttgggagggttcttgatcattagctcttccacttttgctgctgtcttattctttctctcctctgtttgggactccatttacacatatattcaaacttttgattgtttcttgtatgtctgatgtgctctgttatttccatcctttttttctctgtgggcttcagtttgcataatttatattcaagcatgaacttttgagttcactaatcctgtctaatgttaaatccatccaaagaatttttattttcagatactgtattttgcagttccagaaagtccatttgctatatttatagattacaattctctgacaaagttttctttttaactattttgttgcattttcaattatcatatttaaacatatttgtaatagttatttaaaatgttttttctgccctacaatatctgagtcatctgtgggtctttattatcttttcatctcctgagaaagtgaggttatatttttctgccttttcacacaacttatacattttttttttttttttgagatggagtctcgctctgtcgcccaggctggagtgcagtgacacgatctcagctcactgcaacctctgcctcctgggttcaagcgattctcctgcctcagcctcccaagtagctggggttacaggcacatgccaccacgcctggctaattttttgtgtttttggtagagacggggtttcactgtgttagccaggatggtctcgatctcctgacctggtgatctacccacctcggcctcccaaagtgctgggattacaggcataagccactgtgcccggcacgttttacccttttcttattaggcaggtaaggtaagaggccaatcacaacaatatgatcagagaataaactagattgaggttgaattgtagttctgctagactcagtctctggtttgatggagagcttgtcaagtctacctcctcagacatatcacacgacggaacattcatttatgcctcttagaggtttgagcttggctctttagcttcccacttaacacgacttcaattttggcaaataggagagcgggaccagctgtgcgtttgacacaagtcccccttcctctacagattgttgtctcctaattactgtgagggtggaaattttcactttgttattctgtgtccctcccacagccttccatgcccctcaggcactcggcaaatgttccatgggaaaagctggccatgcttcaagggctctgttcaatctgagaccctacatctttaattatgagaaataattggacattgtgtcttaaaatatttttctggttatttctttttctgagactcctgttaaatggatgtaggcccttatacttttatcatccatataacttttcttttttttttttgagacagagtcttgctctgtcacccaggctggactgcagtggcacagtctcagctcactgcagcctctgcctcccgggttcaagtccccctgagtagctgggactacaggtgtacgccaccatgcccagctaatttttatattcttagtagagatggggttttaccatgttgtccaggctggtcttgaactcctgacctcaggtgatccacccgcctcagcctcccaaagtgctgggattacaggtgtgagccaccacaacgcctggcccacttttctttatattttctatttttagaccttttctgttttttgttttgttttgttttgttttgttttgtttttgagatggagtcttgctctgttgccaggctggagtgtagtggcacaatctcggctcacttcaaactccgtttcccgggttcaagtgattcccctgcctctgcaggctcccaagtagctggggctacaggcacgtgccaccacgcctggctaatttttgtatttttagtagatgggttttcaccatgttggccaggatggtctcgatctcctgatcgcgtgatccacccgcctcagcctcccaaagtgctgggattacaggcatgagtcacctggccccaatatttttgattttggtgattgtcttctgcctgatcttccaactctctaatttattttttggctgaatacattctgctatttactccatctactgagttatttgttgtaacggttattaaatgttgtcattgccaacatttctagttatttttaaatcattgcttatcttgcttgatatttacagtgtcctcccttatgtcttggaggatgtatattgtccttatggtaaatccctcttctgcctagtctgttcatacgactttttaaaattttttatttttttgagacagagtcttgctttgtcacccaggctggagtgcagtggtgctacctcggctcactgcaagctccacctcccaggttcatgccattctcctgcctcagcctcccaagtaactgggactacaggcgcctgccaccacgccccactaattttttgtattcttttagtagagacggggtttcaccgtattagccaggatggtctgaatctcctgacctcgtgatccgcctgcctcggcctcccaaagtgctggaattacaggcgtgagccaccacacccggcccatactaccccttttgctagtcattcatttggtggttgttttggctctgagttcatcttcccttaaaagtgtcagctatcttggtgaataatgtatactccgtgggaaggagtgaggttaaagacggggctccagctttggctcctctaggcaaaggtatgaggggagtgcctcagggtgcagagcctctggcagctattcgccatttgccacctgtccacagacaagccagagtgaagtgcctcaccttccagagaccctctgccctagtcgctgctcttttccaagagctgcctcactctgctttgtcttttatcccaaccaagggtagaagaggaaggagaggctgctccatggctcctggccagccttcatctattgaatctgttttccaccagccagttcagctggccccagaattgccttgaggttaccttgctattttcggctggtgctgtgttgatattttctgcccacagaggtgaaagggcaggctaccctccacccagagaagtatgggggacagaaaagcaataagaaagccctctcccagatttatatcgacccatgacctctggctgtcaccactctaggctgcagtgctcagccgactgggacccatctaccttttgtttctcagggtcagattctgggtacatcatccctctctcccttatacaatatctctagggccaagtcttggggagggaatctgcagtccactccatccagcaccaagataaaaatctgaagccccatctactttctgtcttctaaaaattctccaatatttctggtttgctaatggttcttcattttgttttctagccctgttatgttttgattgtttttaaaactatttgtttcttttctgccattttcaaatatgagagcatgttctgagaccctcccttttcttcttaagaagaatccccttggccaggtgtggttgctcacgcctgtaatcccagcactttgggaggccaagatgcgtggatcacctgaggtcaggagtttgagaccagcctggccaacatggtgaaaccccgtctctactaaaaatacaaaaaattagctgggcgtggtggcaggcaactgtaatcccagctactcgggaggctgaggcaggagaatctcatgaacctgggaggcggaggttgcagtgagccgagatcacgccattgcactccagcctgggcaacaagagaaaaactccgtctcaaaaaaaaaaaaaaaaaaaaaaaaagaagacaaagaagaagaaagaatctcctacttagtagaggcagtgattcttgtgcaactttgtaactttcattcatcccattcactctttcctgttttcttgtctgtaaaatgggaatagaggagtaggtgatgtttgagggcctttcaccctccccgtgctgtggctccaaggatcaggcccaactgttgtttggctcattttctgctgtacattctgcattagttcagaaacgtgagtggtggcaccgctttctttctaatttcattctggtcattggtattcagagagcaaaatgtagagctgaaaaatgaagattgtttcttcttagaaaaacaaaaagcacaaaccatctacagaaacctgttcctataatgagcagctgaggcaggtggacagaagattgtcctgagaaatgtgaatgaacttgcctccacggaatggggtatctagagtgggggatggtgcgagggttttttattccttcccaaagcaaaagcagacttctaatcatttttatcttgcactctggcctctttcaaatcccatgaagccccccaaagttgccaatgactaatgtgagactataactctctaggaaatagggatatctctgcctctgatgccagaaaacaaggcaatagacagaatgacctccaagaaccttgcctatcaaatacagcatccagtcatgtctctttgtagaggcagaaaccattcatgcttctgggaagagctaaaaaccattttgagaaaggttggaggagttgaaaggaacactgggatgctggcttcctcttcaccttccaccatgattgtaagtttcttgaggtctcctcagaagctgagcagatgccagcttcatgcttcctgtacagcctgctgaaccgtgaaccaattaaacctcttttcttgataaattacccagtctcaggtatttctttatagcaatttgagaacagcccaatatgccatccatgattttaggtactataaagccatagactattgggcaaggacttcagctcgaccctcatatacagacagggaaatagcctgaaagagctcagagacttccctgatatcaccatagtgagtcagtagctgaactaggagtagaacccaaggcctcttactgctgtgtaggagtctgatacctgtacctggatgcctcaagtaagttcctgaagcttctaagccccccactgcttttgaaggaaacgctaggtcaggcatagaataagggctaattaaatgttcagtactgtggcagatgctgtggatccccattgtggttgaaggacctagccctccaggtgctagaaagactgcaggaagacagctcacggctgtaaatcctctttgggaattgcatctgctgaagaaagcaacctggatcaaaataacttccccctttctagaagatccacatccaatgactgatctgtgcttgagtattaaaggccagatctgtccctgacacaggacaactcgaaagaggttgttccagcttcagagtgccccatgcggttggccaaggtctttgctgagtctatactgtggcctaacttctcccctgcccaattctatttttctcccttttcttccccaggtgttgagccacagagcactccctattctaatctcagagtctgcttcctgaagaacccatcctgccacacttggattgaattacagtcatgagaaagcctgaacttgggaaggagccagggtctggtggcttcagtcgtggtgggggagcagctgaagagagatgggtcatgaggtggggcatagaccctggacctggaggcctggattcccgcctctccacagcagctcacctgcccaattatgattttgcctgcaaccctccaagcagagctgggagaggctgtgtgattattgctgttccaatcactgcttaaaatcaatgttatgtgtcccagaagatcaatctcccccatttcttagagccattcccctaaatcttcacccctcttctcgggctctgctcactctcacctccctcactctcagcagatgatcttgcctcgtactgtcctttacagaaaaaacgaaaatgaagccattgggaagctttcatcagtttcacatctcatatccttgttaccctatcctcacctcctcccatccagcccaagaaagggtggtctccccaggctctgggccctgcccctttctgcttccttagagatctctgcatgtcaattatcataccccttctccctcatgggacttacctgtttcctctctcctgctaccttcccatgggtacataaatatgtttaggtctctcatctggaaaaaagcaccaaccacagatagaagaaaatatttgcaaattatatgtttaacaaaggacttgtatccaaaaatatacaaagaagtcttaaaactcaacaagaaaacaaacaaccttattaaaaaatgggccaaagaccttaacaaatacctcaccaaggaagacatttaggtggcaagtaagcgtatgaaaatatgttccacatcaagtgtcactggagaatacaaattaaaacaataagacatgactacacacctatcgaaatggccaaaatccagaacactaacaacactaaaagctggtaaggatgcagaggcacaggaactctcattcattgatggtgggaatgcaaaatggtacagcctctttaaaagactgtttttggcagtttcttacaaaactaaacatacctttaccatagaatccaacttcctttgttaaataccgaggagcaatcatgcttcttggtatttaacaaaggaagttgaaaagttacaccccaacaaaaaactctgcacgtgaatatttatagcaacttcattcacaattgccaaggacatcctcttgtccttcagtaggtgaacagataaataaactgtggtacatccagaccacagaatattattcagtgctaaaaaggaatgagctagcaaaccatggaaggacttgaggagactttaaatgcctatcactaagtgaaagaagttaatcagaaaagcctagatactgtatgattctagctatgtgccattctggaaaaggcgaaactatgaaaacagtaaaaaggtcagtggttttcaggagttgaggggaagagatgaatgaataagtagaacacaggatgtttagggcagtgaaactaccctatatgatactgtaatggtgggaacatgtcattatgtatttgtcaaaacccataatttgtataacactgagaatgaaccttcatgtaaactacagattttgggtgatgatgatgtgtcaaggtaggttcattgatggtaacaaatgtaccccataaattgattatgggggaggctgtacctgtgtgggaccagggggtatatgggaaatctctgtatcttctgctcaattttgctgtgaactaaaactgctctaaaaaataaaatctattttttaaaacaacaccacaacattttctatccatgtacttgtcaacttctggtcttttcatttagccacactcatgccacaagcagttattaagcaatattctaggtgcagaaatacagcagtggacaacaaagtcatgattcaaattctatggagggagatagacaataaatgcataaccaagtaatatataatattatcagagggtaaataagtgctaaggaaaaaaaatcaagcagagtaaagaagttggggatgaccaaggctggggatagtgggcaccactttatatagggtggtcagggaaggccttcctggaaaggtaacacttgaacagagacctggagaaagtagggaatgaactctgtggacatctggggaaacagtgtcccagtgagagggaagggcaagagcaaaggcccaaaggcaagcatgactggtgtatttaaggagcagtaaaggaagcgaacgcagagtagaggaagcaagtgggggagagatgagatcagaaggaaagcacagagccagatcatgtaggatcatatagaacaattgaaggatttaatttttaccctagagaattctgagcagaggaatgacttgatttgcttgcatttaaagaggtcactgtagctgctgtgtagaaagtaaactatagagagaagtggaaggaaagagactaatcagaaagccactgcaatacaggtaaatgaggatggcttggattagggtggtagcagtggagaccagaaaggtggttctggttctggatatatttcgaaggtaggagccagtaggattgttggtgtgggttttgcaagaaacagaaaaatcagctgggtatggtggctcatgcctgtaatgccagcactttgggaggccaaggcgggtggatcacctgaggtcaggagttcgagagcagcctggccaacctggtgaaaccccatctctactaaaatacaaaaaattagctgggcctggtggcaggtgcctgtagccccaggtactcaggaggctgaggcatgagaatcccttgagccctggaggcggaggttgcagtgagccgagattgctccactgcactccagtttgggctacagagtgagaccccatctcaaaaaaaaaaaaaaaaaaaaaaaaaaggaaaagaaaaaaagaaacagaaaaatcaaggatgaccgcaaggtttttggcctgagccaaaagaagaatgaagttgccatcgcctgagatggggaagactgcaggataaatggtttgttgtttgttttagtggcagtgggtaggcaggaggatgaaaatcatgagtttgattcaagacaagttagtgaagatgttgagtaggcagtcgggtatacagaattaaaagatacagtccaagctggaaacttgaattagagcgttctcagcacatagatagtattaaagccgtcagactggatgagatgaccgagggaatgggtctagacccagaagaaaagagtgtgagtactaagtcctggagttcctgtacattaaggggttggggagaggagaaggatccagcataggagactagaaggaacaaccagcaaggtgagaagaaaagcaagaactttctgttctagaggcagaaagtgtttcaagaaaggtagtgaatgatttggagacagtgaaaagattgatgatgcaggagaggagaatttctggcgtgatgtccttgagtaggcaagttgcgcaaaaggagggctgacctgaatggtagcacaaggagggaaggcagagggtgtggcccaggtgctcttttctctgctcccagacctgctcttcttgaggtggccttccccttctgccccctgcacttgacccatttcctggtgccagactctgcaagcagcactaccagggtaattagatcgatgtcttcccaagtgtgtgttgtcttagagaaggtcagacctgggcaggtccctgatgcctttcacttattgagttcttcccatccttcaaggtcagctataacccagctcctctgcgaacccttccctgacctccacagcctcagtccacacagctttcccctctccttccatcccatttccttcttcaagctgggcattgaggagcatccttggagacctaggacaggtgaggacaggagcccatttcagctgcatttccacttatcaccaggaggtggctcagagtagcaagtgcctatgtcaaccatgatggaaagaacttggaaaaggagtagggaagttggagactgttagttcctttctggctctgcaggccgcttgtccatggcgctagcctgcttcattagtcctgtctgctgcagggccgaggaggaaattctgatgctctcagtgagaaatggtggctcagggctgcagaggagctttaggaggactctgagaggaaaaggcccagaacggttaagctacctcctcccgccacatggttagtttgtggcagggatgagaggtgagtcctggtgtcctggttttcagcctgctgtactgtcaatgccccttcccgccagccagggtcaagcattcactccagagttcaagccttcattcagctatagcatcccaggtgggagtgagggagcatgagtgaggagcctggaggagaatgagccagagttcctgccctaagggagccctcaaagtgcctggggagatatgacatgtggcttgggccaagtggagaacactgtgggcagcacacatcagaacagaccaaggctgaagctggcacctgctccttggaggaggcttagggaagtaagtggattggtccagtttgagaggacaacctctgatagactccctcctcttaagctgggaggaactggactacatgaatatttatggaggggtggagggtgatggagacgggccacattttgacagcaatgctgaccctaaagaataatgaagggctggtcaaggaactactagggtgaggggagaaactccagctggagtcactcctcagaagccacacatctggctgcacatctccctgagtggacggcatcagtgctgctgctcaagttcctgtttggaaacccagagcccatccctgtttgcctgtgaaggtgccaggttcctgcagaaagtctgcttataaaggatttcttttgaagttatgtttgtgatggtctcatcaagaaaactgaggaaggaacaggagccacacatgtcatttagctgaaagtcctgttttaagaaaacaaacgcaaggttgtattcatgagcaactgctaaccacaataatggaagaagcagttaagctaataagatataataccccatacttcatgtagtaaccttgggagaggtaggccagtgggcaggaagccccatgtctggtggcagaagcagggtgggaaggaaactgcaagagaactgagccttggtcactgactgaggatgttgcgattcacacatcctgcttcgtggcctggattgtctcgaactgggttcttccctagcaccagtaacccaagtggagacctagcagcagccaagacatgttcccaagaagggtcactttcactgcaaaatgcctatctccaggagaagagggggagtggactgagagaagccagggagagagaaagggcagggatttgcagtcagttgtcctgcctcagggattagggttgacatgaagaactgcaggttaagagtgctccattaaggaagattagataaactgttctcaccactggggcagttaaaccttcccttgagtccctttggtaaggtgccctgaagatgcctaggcataatgtcacaaacccagctgaaaacgaataccacaaagagaccctgtgactctgaaaacagcaatatttgcacttaagattcagcacctggcttactcctgtagtcctagctactagggaggctgaggaaggaggatttcttgtgcccaggggtgaattcaaggctacagtgagctacaattgcactacggcactctagcctgagtgacagaacaagatcccgtctcttaaaaaataaaaataaaataaaaaaggattaaactcctggattgaaattcagatttctggattccatatggtttatccactatcttccttaagagggccatcaccactggcttgtgaggcagggccccttgttctccaagccaggggcactcgatcttattcatctagcaggaacccttagttgttctggtcagtgcctgcttctctgagcctgtcttggggcaagcctaggagcagggccaggacgagcatgaggtacctgcacctatgatgcaaaactgaaggaggtgctcactttcaggtcagcgcaagggtggagcctgttcaattatttgcatgtgagagctattagaaaaaaacaactcccaatgagatagaagagttcccctggtagcatggtgctgtttttagtttgttctgttgttttgttgttttgttttttaaactctgtacaaccctcctatttggaggacctgccaccttccttccgactcaccagcagcaggacacaaactctgaaatggcttcccggtattgggagtgttgtcagccaagattatagtaaagaaattggaaagggaaaggggattgaatggttcagtttcaccggggatggggaggaagacagataatggaaagggtgaacagggaagaagagcagaggctggtgagtcagatagaagcagctagttagaaaagactgcttagaagctctttcgttatgttgttgtgtgtgtattagggccttagggttacggagtgttcccaggcgatcctccctggaggacctgctcctctttcattaggctgctcctgttattttgcttgccagatgcttccagctggcagtagttggttctagacatttgaagcctattccaagactcaattcccaggactaagaaactaggaagccggaacctgcagtggttgctatgcaccatattcagttttacaccggattcagtcatttgagagaaatgtggttgccttaagtctaggctggatggaatggttcctgatggcaccctatgagtcctaagtgagtgggcagagtggagtgcgggtgggtggcttttgccaagacatcaaggatttgaggcctaaaaatgcaaacaacttgggaagtaatatgcaccaaccagcctgagggaagggaggccagtgccaaggtattggcttagtgtcgcagggatcctcgataaaatccccaatcgccacttgggccttaaatccctgacactgccaagaattgatttttgtttcttatggaagcagtcaaaatgaatacattttcagtatcattcttaggagaggcatctcaatgtttctgagccgctttctatgagatggactgcttagctgctctaaaaagacagaaatatctccatagcttacactgtacagtttgcattatctaagtgtatttaaatagatgagagagacactttcccttttgcatgtcaaaggaggcaaaaggaagttttctcctaatttcagtcataatttctgccctgaggaaagttataatgttctactgtatggatacaccacattttgcctatccattcatctggagatgtagacacttgcgttgcttccacattttgcctattgtgagtaatgccactaagaatatgagtgtacaaatatctctctgagaccctgctttcaattctttggaggtatgcccataagtggaattgctgaatcatatagtagttctatttttatttctattttttgagacagagtctcactttgtcacccatgctgaagtgcagtggcatgatctcagttcactgcaacctccgcctcctgggttcaagtgattcttctacctcagcctcccaagtagctgggactacaggtgagcgccaccatgcctggctaatttttgtattattattatttttttagtaaagatggggtttcaccatattggccaggctggtcttgaactcctgacttcaggtgatcctcccgccttggcctcccagagtgttgggattagaggtgtgagccaccttgcctggcctatttttaattttttgaggaactaccagactggtttccatagctcaaggctgctcctttaacaagctttccccaaagcctcaatcagtgagtttcatttccatctcatttgccacactgggtcacgtgactgcctctagctgcaagggggtctgagaacccacgtattttcaactaggcatagaacttcttagaacaaatgctacactctgttggtaaggaagaagtagagaattaattttagtggacaactagcagcctaagggcaaatgagaacactgaagggcttcaggtaagcaagagacattgtgggaggatttgcgctttagaaggctctctctggcagctatggactgaggagtcacagtcagcagaattagttaagaggcttcaacaacaatccagtgaggagtgatgggggttcagatgaggatggtgtggcagtagggtattcaggaaagggagggattcctaacatattctagggcaccccttcaagcctgcctggatattggcagtgggaagtggggggaagtgggagggaacgagggatgagtccaggttttgagcatagtccttcctgtatatctagaaggggaaacaggttttggggacatgtgataattcaattttgcacatgttgaatttgaggaacctgcaggatggtaggtagataaaaagtgggataaggcttgtcccaatctgggtcttttgggattggtttgtgacctccttggggaacttgaagcaaaactggagatagcacattctgagtcatctactactgtgctgacctaggaagcaggttgtggggaggtggggggtgggagggatagaggtgagaggggtagggctgctgtccagaaagaatgcatgaagacaaccttccatcctgagtttttctggttctgacgggaatctctgtgtagcacctccattcctgagttcccagggacaatcaggcaaacattctctgaaccaaggagacccctgcatgatgggatggtcattctagctatctgtgtccagatccaagtgtctgagtctcagatgagctggtcctacacatgtgctatctgtgccctgcccaagctgtttccccctcctaggggatcagagccctctcaatctgctgcttccaggaatgagagccaatacacatttccttccctcctgacctctgctcttgaatgattattttaaaatctccccccatagacacactataaactgctctgtgatgttccttcactgtccaccatggctgagtcatgccagattataaatcccttaggacaggaccagcgtcaccaccgcaaggcacaaggcacaggactgactctttgtgaagggaaggaaagtaagtttctctagatctgttcaatgccacctccagggtcctgcagcagggctcctagctccctcagcccaaggacacctctccatgtgatgctacttccccaggttgctgggccaactggaggctactcatcctgagacctgtaaggccagacccaggctggacgaggctggtcagggcctggcagggcagtggggagcagcgtggaatggtccagagttcctggaggtggtcagggacaagacagctgggcctctctgctgtcatccctaggagcagtcagcaattacacagacacagctgctgtgtgattcaaagacacatatgcacgtagactcaaatacagagttgcttgaatgtgttcacaaatatacacacccggccgggcgcggtggctcacgtttgtaatcccagcccttttggaggccaaggcgggtggatcacaaggtcaagagatcgagaccatcctggccaaaatagtggtgcgcacctgtaatcccagctactctggaggctgaggcaggagaatcgcttgaactcaggaggcggaggttgcagtgagccgagattgagccactgcactccagagccagactctgtctcaaaaaaaaaaaaaagacaaaaaccccccacaaatatacacacccatgcaccaccacccctacccatacaccacacgcacacttaaattcagagggcaaatcccggttcctcccttcatagctatgtgtccccaagttacttaatctctttgtatcttaatttccttatttccgatctgtaaaaatgagaataatggtattcacctcaatgagttgttgtgaagattaaatgagataaaatggtaaagagcttacaacagtggcaacacatgcagagagacgcacatgttttcatactcatttcccaagccctgcccagtactgccactggcactggtggtgagcctggcagcagtacaaggttggagtcccttcatccctttgagccttggttttctcatctgtgaaatgggaataataatatctagccggcggggctgtttggaggaactaaagaggcccagcatggaaagctcctaacctaactctggcccacaaaagtctccctacgttttagctgtcactgtccctgtgaggaagaacagatccaagaacaggtgcagggatgggctgcaccacagcaaaatctggacaggcccgacccccatctcctcccaggctggagcggggccctgtaaggacagagcccaaggccactaggtgtcaggcctgttggagccaagtccggccagcagtctggggtggggctgggggcagggctggtcggatggccgtgggtggaaggaaaagaggaaaaccagctcagtggaaattgtcctgcggttggctcaggcgcccacgacactgtatttatagagagctccttgcagctcttaattcctcgcagtcgagttaaccctttctgggctgtggtgccagcatggtgtggaggaagaacccaagactggggttggacagcaggattccagccctgttctgccgccagtcgatgaccagtcagtcacctatcccctctcgcagaaaggaagattcggctcttggaagtgtgggaacggggtgggggatgggcagcgccctgctccgggagccgagggttttccccgccagggtcaggcctgggggcggggcggggcgggggcgggggccaggccgtgtgctctgcccagcgggctggctcaggcctcggtcagcagccgccaccgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggtgagtgctggcgtggcgcgggcggcgcggggtggggcggcctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagcagggcgaaggtgtgggcgactggtgcacttccacaggcagccgtgggcagcatgaggggtcagattccgggaaggacaggtagagacggctggcaggggccacggggtgaataggtgttgggggtggggagggaattgggatgggcagtttgggcttgggaagcctcagggaggtggggggtgaggtgggatggagaggagatgcgggcgacggtggagggaggtggggaccccgagtgggggcacactagaagggaggggattgaattccagcgcccagggccctccctgcgaccgtttagctagcgaattggcaggtttggcagcctaaggcaggggatttatttctaagccaaacctgctctaatgagaaaagcgtgatagatgactcagatatgggatctatcactgagggaaaacattaagcaaatagtaaagcaaaaaagatttgtgtgtgtgtgtgtgtgtgtgtgtgtgtgtgtgtgtgtgtggcgggtgggggggtgttagttgtcttaatttagaaaaacgatttaccttcaaattggatgtggataattgtaaatgagtctgatctcttcattaaagcccggggtccttttcttataagcatgtcttcagcagttagtttctatattagaaagtaatgaagctgctttgtctttaagagagttctttatttagtgcggcctcctctagttccctctggcctcccagaagtccctaggaaatctgatgctgtgcagccttccttgtagtgtgggggactgcaaataggtgggacagtttgaggctgaggggaactgaagtctaaacttgaagtctaaacctgtccgatgggttgagctgatctgagtgcagggcaggatggagggctatggggctgtagggtatgaagtggctcatttcaagggagtattttgggtgagtacattttcctgatatctggagttcttgagattaagcactaacacttagggtaactgttgaccgtggaaatttacatacgtcaccgtcagcttactggagtatcctgatgtgaatgaaattttccttcatgactttgggtcagccctgtggacctcagtttttgttctgaggggttgtatggcaaggggacgctggcgggagagagcttcgttcctgcattaagtggcctcagtgatgcagtcagggtcccatgactgacctttggagttcttccatgtccttatggcattactggtggtttctcctgcctgcagtaagctttccagcttactctagactcctgtgctgtgagacatgagcttgtcagaggtaaggagcctgtgttaatgcaagtctcaggtgagaaggggtgttggaatctgaggaccctgttttccttcctgtcccctcttcagctctgtccaggcaccacccgatggagggttggctgaatgtctcatgttcatatacctgacagctggcttcggtgctttaatatttatggaaaggacagttatagaagtgtggtcccttcaaagtagtcctctggggtgtctgtgtccttattaggttgacttctgaaacttcctgtgagaattccatcattaaactttggctttctctggaggggtaaatctttgttctttggagtaggatttgagtttgacaaggagctggacaatgctgtttggagtcagagatgcagtgtgataagagagctgtgagttggaattccacagcacctaaagagactcctagaaaatgttgtagaacaagtggctggatggtacttggttgcacatacggggtttggggtctgtgcagaaaaatgaccaaatccaagcagcctctgagattatgaccacatgggggctgttaagctgtggatctgagtcatagggtcagggaaagaggaaaaatggcaaggaggatgacgttactgcccatgagcttatcctctgagtgggtggcgacttctcattgtccttttcccacatccccagggcaggagtgttagggaagtccaccagcaaaagggggagggcacacccagggcctaggggagggggagaggggtgaggactggtccacatgatttttgagaaattgcctttggtcttgttggctcagaatggaccccacacctggaagggggccacgtgtacagttatgcaacccttgcctgccacccccagttctaccgcccttgcagtgtgccagataggagcattgggttttcaggtttgggagtgggtagggttgtgctggaggctaaatagacattatctcatgtaatcctcatagtaatcctatgaggtagggtatcattaacaccattgtacagttggggaaactgaggcccagaaagggtaagtcacatgcccaaagacacacagccggcaaatggtggagctgggctgttgtctgcttccagaactggctttttctgctgctctggaggtaggcacaggttttacccctctttctggagcccggtaagatgtgccaagggtctccttagtaagtcagggaagactcatctggggaaccagagaaggggcaggcctgacctgggtgacccagtgactagtggccttcacagcatagtcagggcctttgctgagagttcttctcttccagagccctggactttatcatgctggggcttccaggagttccccctccaccctccagttctgaccagtgctcccagccagctgccccctttctccctttctttctctttgtggtccagagaatgaatgcctgctccacacaccttatgccattgggaatctgaccttctctaggcatagggagcttaatctgcgggaagtggagtgagaagcatttcttgctgggagccttggagcagggagagatactgtctctgggaggcaggggtcccaagttaccctagaggcaatgcaggctcctaggaactggggctgccttgtgggagacattggaatgtgtccctgtgggaatgctctgtgctaggggctatggcagcaggacggtaggagctcatggtacttggaactgtgaccaagcatctgcgaagaggaaggggcccaggaccactagaatgagtcagagccagagatggagtcgagttgtgcatttgctactttggagctggggcactgatagggctctaggtgaaaagtagggatacagaaggagtaatggtcccagaggcccagatgtgtggcctgacagaggaggtcttggccagggagagtggggtaggggcaaagtgttcgctcagtgcagaggccccatctaggaggccttgtccccatgcttgcggcaataataacagcaataataataattattactgcagttttggtactgggcactttcctaagtcctctctctctattgtcttattttattctcacagcagccctgtggggtagggattgttacccccattttagagatttggaattgggtctcaaataggttaagtcatttaaacttggtcatgtgttcagcaaggcatcggtgtcaggattgaaacccaaggctgctggcttctgagctcatgctgtaccctgggcaggcaaggcagcctggtgattccattcaataagtgaggaagagagataggagcatcagctggctcttagtcacttctgctggtggctgataattgagtgtgggcccttggccagccggccaccactctgggtccagatttccatctgtacaatgggcctggagctaggcgctggaccaggtgtaccgtaagaggccttctagctctgaggactggtggagattgctacactccgagaggggtctggtgcttagatggagaggggtcggcagagttgttctgctaagctgagcctctttcagggtagaaaccaaaggaatttggaggcaaggaggcatttaggcagatcacatctggagaaaatgcacccttccttgagtgcagtctggaaaggcttctggaaaggataggatttccagatatgtttaggtgggcacctagcaggactcagcagatattgagtgaatgcagatgtgtgtgccctgggcctgccagtgtctgacccgaaatctgcgctctgatgtggtctcatgtgctctcatccctttccttcctctccctattctccttgttgccatcccttcttttggctggacctcctctgggcccaatgtagctttcacttttttcagggctctgtgcctcctgtgtgtgtgtgtgtgtgtgtgtgtgtgtgtgtgtgtgtgtacacatttccacatgcatgtataggtcagttttgcagcccctgcacatgcctctagttccagggagaccttagccctgctttgctggccagccctgatgacatactactgtcctgactcacacagaaatcgcttggagaggaagaactgattcctgctcttgggtgggatcacgggactggggagtggtgcccagtggacagccttgaacataaaaggcccaaactgactcagattatcaggaaaaaggaaggcaaacagggaggctgttcccagggaactctagggaccctcccatctcttttctgaggctgctgcccatttatagagcacctagtattaactaggtcagttttgataattttgctcattgagtcctataatcatcctatgagggtaaggtttataatccccattttacaaatgagcaaactgaggctcagagaggatattttcataaagtttcattactaggaagtgacagagtctggatttgaacctgtctctccaactccaaagtcatcttcttaaacactagtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaagtgagtgacagagcctggtctaaagtccaggatatctctgttgttgctgttttccttttttcgttaattgcaaaagaatttacatgttcatagttaaaaacagagaagtgtatcaagtagaaaacagtagcaaactctcacccttattctgacactccagagttgcattcactctcaggcatccagatcctttccccatatacaaacatccatccatccatatatctatccatctctctatctaaacacacatgcattcattcgttcactcattgaatcgtgcattgagaacccattatgtgccaagccattgctagaattaaggatgcaatagttaaataaagcagatgtggttccttctcagggaggttctcatatatcatgaagaaaacagactgggtgcaatgaatgacagggtccttcttagagtggcagatctcttacctggcttttctgtcaaggtgaccctcagaatatggaggtgttaccttttatcttagtccatgttttactgctataacagaataccacagcctgggtaatatataaagaaaaaaaggttatttggcttgtagttctggagactgggaagtccaagggcatggtgctggcatctggcgagggccttcttgctgcattatcctattgtggaagggcatgtgagcgtgcagtacagacagtatgggggcagcacttacgcttttatcaggagcccacttttcctgtgataacagcattaatctcttcacttcttacaggccccacctcttaatactgttacagtggcaattaaatttcaacatgagtcttaaagcacccatgtcatctaggaagaagaaactgtatttgcagcaacactgtgaggtaggaaagggagtcctatgttgtaggaactggaagcagcccactgtggtgaggggcaagtaggaagaggtgaggctgggcaggtgggcagggccagggcagatggggctctgtaggctatggaggagctgcgatcttatcacaaggaaagtgaacagccctatgattaactattgaaggcagtgatataatttatgcttttatattaatagcaattattctggctgttgtatagagtatagattggagaacagaattgggtgggggaactagagaaggtgaacagactggtgaagaggcttttatagttatccaggcaagagatgatggtgacttggaagaccaggaagagaagcaggggtagagagaaatggagatagtgaagatatagcagacatatttgaggagtccttcagttacagataatagaaaactagctcaagcacatttaagaaaaaaaaaaaagacttgtttaagtacctaggcagtctatgtgtgcagcttgcttcaggaataggggcttaaatgatggttttagggctctatatccttctagcttccatctctgcctctgttcatttgtttggatcaattctttagattgttggtagcagacacatttattgctaacagtcccagaccgtatccttcttagtaatctcaacaagaaagagtcttttttgatggctgcagcagcaaggctctggggaagtctctgattgggtgtggcttggcttacagctcattctcgaactaatcactgagtgggggcagggcaggtttctccatgagccaggtcttgtaacatgcccaggccctaggctgggaggacagctccaccagtacagcatggactgggctccctgcaggagtgcggagccttgctaccagaaggggccagcatagaccaagagaagggcactgtagaataaaggacatggagcaaaataactgtgttaagactagctaccaaagacggagacgatctgctcggcattgaatttgcctctttgtcaaggaaagaaggagcagaagatgttaagaaggaattgaagtttaggccatacggggaggtgctcatctgttttaactgtatttgtcttctggcccctgggattgcctgtcctggtgtggggtgaacttggagacagaatctctgagaagctgtcagggatatttcaggccagtctagggtagaagagggttggacacgtgggtcacagtattccacagtttcctgctgtgcacagattcaatccgagtccccatctacgtccctcactacctcccttgcctcctctcctgagtctcagcctctcctggagtcccatcttcccagaatatgctgtggacatctcctcttctgtgacttttcatgctgtcccctccgccagatagccgagatgtctcctcctctgtgcagtccttactgagcctccccagcccccagtgaatggcttgaccctttcatccaggtttaagcctactgcctcgtccattcccacaataccttgtataaatgtgtaccaaaaaactggtcatattctattttaatgatatatttgtttcctaaaccttttttctatttttaatatgaaaatgtgggattttaaatatgccatttagcagctctgtaatcttgagcaagttattaaatctctccatccctgaatttactcctcggtgaaataggataataatagtacctacttcacagaattgttgggaagcttaaatgagttaatatgtgtaaaagcatttagaacagagcctggtgcatggctttcaacaaaactggcctatgttattattatttgataaaagcaaaataatatatataacatgggtaacttttgaagcataataataaacatacctcccaacttgagaatgagaacccctgtagttgaatatttatatgtacgattcttcatctccattcatattgcatgcatggccaatgcctggcatgtggatcatgaataagcatttgttgaatgaataaatgaacaaatgccagaagacttgagacagggaaataaccagttttatggggaagatggtagattatgggaacaacagatcgataatcttgttcttaatccttgacaaagtcctggaaccaatgagcacttgaagaagagcccactagtaggcacttgcatggcttcactggggttttgaaaatgcacttcttttcttgttcttctccagttgattggtccccagccagaagcagtgaagcttctcatgacagccctggggatgagatgggtagatgggagctgggtagcagcacaggtaggaacactcctaaccccggtgtactgaatggtggatggacattgatcatccagggacagatggtgctgtgggctttcctattcctgtcctctccctgaggaccttgatgacacccagacaccagcagagagaggagagtaaccttttcagatgatattcattcattctttttttaatccaccaacaaattattgagcattgtctatgcaccagaacagtcaaaagagtacttcaaaagatcacgacagggttacacagcattgtaaatatagttaatgctgccgacttatacacttaaacctggataaaatggccaacttcatgttatatatattttacaacaatgaaaaaaatgttgtggcagttggaggaatggactcagtttaactgggtgaaatggaatagtaacaaatgaaatatcctgtaaaactcctccccattctgaactccatcagaagaggatggcagaggtgtggattagcagcaatgagtgtgagtgacttctgatggttggctacagatttgatagtctgttattttgggttattttggtgaatggtgtgacatggctgctcaatggtgacttcgtcaaggaagatcaaatacttgcagggctttgataaggaagggggcagactcattctgtgtggtccaaggggtcacatgaggactgttgtgggctgtattgggagacaaatttgggctaagtataaggtagagcttctcaccgatgaacgctgtccaaaagcaagtggatagcccatgcaggccatgggtgcccatcacgggagggcaaacagagattgtgtgtatgcggtgggtggggggaggggcagggaaaggttccctgttctgatacttgatcattaatttctgcagtttccccagaatttgttctcatggcatcatctccctcagtgaccccacctttggttctgtcaccaccactgcacgaatgactgccatgtccctctgttctgagctgcagctcagtgtgtctgggagtccataggacattttggtgtggatgatccatagtcgagctcagtaggaactgatcttccccctccacgtgcttcatctccaggtctccttgttatgtgtgtccatgtttgcccattgctcaagccttcagtgccctcttgacaccttcagcccctccctcaatacaaacagtccccaagcctggtcacttctacccttgacatttgtccaaagctgggctcaggcatcactcggtgactctgatgagatagtctcctgttcgtattttgagatacctattttagatgtggtttccttttgtggctctgagcagtggcaatgctcatcgggtacggagacggggaagagaaggagggaaagtaagggtgggatggctccttagttagttcagatgctgtaagaaaggcccaaaatagcaatgacttatgctggaagagatgtttatttctcacccatgtgaccatctgggtatatccagggctgatactacagtccctcagggttcttctgtctgctgctctgccgtcctcagggtgttgcctttggcagtatgatcgccacacacaccacatctatgttccagccagtgggaagggggaggggaaagggaggggagggcatgcttctctctttcagggcatgacccagaagctgtacacatcagtgtacacattgcatggccacactcagctgcaagtaaggctgggatctgcagtcgttagctgagtggccgtgtgcctaactaaaaatgctatggaagaaggggagagctgggtgtgctggcagcacctgtagtccctgttactcgggaggctgaggcaggaggatcacttgagcccaggagttacaagggtgcagtgggttctgattgcaccactgaactatgatggtaccactccagcctgggtgacagagcgggaccctgtctcttaaaaagggagaaaatgggtgtaagtggacaacaactagcagtttctgccacagtcactttgtgcatttcagtgggaactgtgtggctgtgaactggttaagccttaaggatatagtccctgaaagcttcaagtactgataaagttccactagcatccacaaagcttttcttttataggtaggaacactgagctcagagaagttgcctagttaagattgcataacaaagtgtcagagctgggaccagaaccccacactttgggctcattttctagaattccagggtgatctggctgaggggcagacaggcagtgtcaggaggacgggtctctggagttcaggaaagggttacctttcccagcgcggctacctggggagctgctcatgacttttcagggatcatctctggggttatcatgcctctgaggtgcctccaattcgccctgaccatatcataaatagtatactataccaaactgcagtgatctaactgcatgtcccccttccctattagaatctgctccttgaggacagacgtgtaccttagttatctctctgcccctagtacgtccctaccaggaactccgtaagtagtgaaatgaattactaaagacatgaatgcatgtggattcaaggactccttcggttgcagacaatagaaacttagttcaaactggtttaagggaaaaaaaatgattggctcaaatatctgggcggtctaggtctgcagcttgcttcaggcatagctggatccagggacttgtctgacattttcagaactttgtgtctttctgaccctttttgtccctttgtgggaagtgttgcccaaggagcccctgcggggattgggaggaagtagggggttaggaggaagtggagtgatgtgggtgattatggtggggggcaaggagaccctcttgggcatccccaggcccagggcattttggccctgagcccaggtgcagtctggatttgttgtagctttctgagggcacatcttgggtcatctcttgggagcctccctgtggccctgcttctgcagggttggatgcccttgctgtaccttaggctgaggacagcctgacccctctctcctgctgctctgtgaaagccgaaggtgctctgtggttttgggatagagcaggaaggagaaggacgaggagtgggcactggcaggtgactcaccgggacgggtggcacatgctgactccagggcaggtcccggctggggatgagattcccctttgtggaaaacatgggtggagggggtggtacgcaggcagcatgaggcctgcgtggctccacgtggctctgggtcccgggccgaccagctctgtgttcacaggacactctcccattctccagggagcacttcctttctgagctctgtctctttctcctgtcctcagctcctccaggcccagctgtcagcgtaggggtctctgggtgccgtggactcttctggtctctttgcttctgggctgtcaaactgcttctctccagggcaggtttccaggatccagagtctaggaaaggaatgaaagggagcaagtccagggcgcagccctggaagtccctcatcttccctctggagggaagcgcagctcggccctgggagagcctgggtaggtctgatcaggggaggtgccctctgctccctgtacctgcccagagtggcaggaattagcctgatatatgaaggagacaattatatgaagagtcttgagtaccaggcagaggaatggggtctgacttctatagtgaatggggagccatgggaagttcttgagcaggggagggacatgagcagattcctgtcttaggtcctaagagaaggcaccttagagaatggggctggcagggaaagagaggagcaagcagggccagtgaggggggtgatgggtcagggtgggagatggaagcttgagaagcagtgtggagagtgagggaggcggcccaggaagaacccacaggccttggttctgtctggggttaaagagaggcagggagatgtggaatctgggcgttcgttcatccttagccctggtgcttcccgcaggggttgggcaggtcctgcaggcagctgcctgctggatcttcctgtgggcctcagggtggcccttgtggggcaggatgtggtgcctgccaaaggtgctttatgaatggagccggggaaggctgctgactcagcaggcagtaaggctttgaggccggaagcgtctggaaaggaagtggctgctcagggcttccccactgtagacagctgggagagaaggggggctggccaggatgcacatggtttggctgagggactcccttggcccagctgctgggggtgtgtgtgtgtaggagtggagggtggcggggggcgggtgtgcctggctgggattggaaggattgaggctgggcgcctggaatggaattgaggctagcagctgttgatgaggtttgctccgtggaagggtggaaaggtgtagcagaattggactctttttggctgtgctgactggcaaattacttgacattaacaaagtcacttatctgggctttaatttttttttttttttttttgagacagagtcttgcagtatcgcccagactggagtacagtggcgcgatttccactcactacaacctccgcctcctgggttcaagcaattctcctgcctcagcctcctgagtagctggtattacaggcctgagccaccacgcccagctaatgtttatatttttagtagacacagggtttcaccatgttggtcaggctggtctcaaactcctgacctcgtgatccacccacctcggcctcccaaagtgctgggattacaggcatgagccaccacacccagccatgggctttaattttttaaagtcctgcaaaaataggaccaagtgttacagcctatctcccagggtattaggaggacgtgaaatcatttctattcttgttgatcagtgttggttggcatagatgtggcttgatcaggacatggcacaaatgtttaggcagcagctgtgggactcagggacaaggtgtgtgcagcctggagggtggctgggattgggagcagggctggatttagggatgtctgcccttctcatccccagctcaggcctgacctgcagccacagacttgcctcttactcagtcctgactccagccttgaggtcatccccaagtccttgcctcttccacttctgatctgtcttggtcactcaatacagatgtgttaagctagcaaatgttctctctctgcattcccacactcatacacctagtcgcctcctaaaactctgtcctagaagcttctttgcaaatactgctgatttcacacaagctatactgaacccttccattttctctgcctcagtgaatgctccaccctgtcactgaggctcaaaaccacggccaacctgactgctctttctctctacccaagtcctcagatactgtcacttttacccagacatgctttgtctcctgtctggcccttcatttattccaccactataccttcctacagggatggctatattagcctctttttttatttttattttttgagatcgagtctggctctgtcacccagtctggagtgcagtggtgcaatcttggcttactgcaacctctgcctcctgggttctagcaattctcctgcctcaccctcccaagtagctgggattacaggtgcccaccaccatgcccagctaattatttgtatttttagtagagatggggtttcaccatgttgttcaaaccggtcacaaactcctgacttcaagtgattcgcctgcctcagcctcccaaagtgctgggattacaggcatgagccactgcactcagcctgaaatagcctcttaactggcctctcccttgccctgatacaatccagtctatgctgaggagctagagtgggttttaaacattgttacctagattatgtgtgattaaaatgctccccagtgattcccattactcatagaaaaacccaaattcctcactggtctctcaaagccctgcttgatctggctgaaacataccctcccatcagatagcgggtggaggtgctgtcagattaatcttcatgaagctcagctctgaccgtgtatttcccttattcaggaagcttcagtggctctcaactgcctttaggatacatttcacacctgtcagcccatctctaagtctggcccccacaggagctcctgctctgccctaccagctactgtctgccaaattgatctgcacacatcctagccccagagcaagccaaccttgccttcacttgccgccttgcctcctcttccttatatttggatactaacatcttagctgaaagggtggatcccagctgccccctaccccatcttccctgtcaggcctccccagggactccctgccaagcatctgtcaccaagattcctcagcagggggcccggtgggatatgggaatgaggacctcccagtgggcagttgcagccttccccactctggtccaggagagatgaggcaagagatggtctggggagaacctttggagacaaaggccttgcgtcctctttctcccaggcaggggcagccttccaccacggggagcccagctgtcagccgcctcacaggaagatgctgcgtcggcggggcagccctggcatgggtgtgcatgtgggtgcagccctgggagcactgtggttctgcctcacaggtgagggtagcagcatggggacgggaggggagggacagtgattgtggcagttggggagggggtgcccacgcctgttaggggtcctgccaagccagctctggctagcagggccataccttacttccacctgtgggatccagtaggcaactcacgttactgttcttagcctccatttccttgtctgtaaaatgggaacatgagtgctaaatgagatcgtgctatttcttgaatacactgtgtgcgccccctcccaggacctttccacttgctctttcctctgcctggaactttctgcccctaaacgtctgcatgactggatcccatattttgtggaggtctttgctcaatgtcacctcctctcaaggctctcctagctcccttgtataaaatagcacacctccgctcctccctccctatccctggcctccctgcgttattctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggtttcaccatatctgctaggctggtctcgaacgcctgacctcaggtgatccacctgcctcggcctcccatgccgggccttttcccctcacttctgactcatcagcaagtcctgttgattccctcctaaataaaccttgaatctgatccctctcttcttctctactaccaccctttgaagccacaccaccctcacctcttacagggacagctgaaaccgcccctaactggcctcccccttgccctgccacagtccagtctccacagaggagctagagtgagttttaagcattgctactcagattatgcgtgattaaaacactccccagtgattcccattactcatagaaaaagttagattcctcactggtctcttcaagtcatctttggtctgggtgggacatgccctcccatcagatgtgtctgccacactggacgctccccgatattttcacacagcaaggccagtcttgcctcagggccttccacctgctgtttcctctacggggttctctgtatgtcagctctttttcattccctataaatttcagcttaattgctttaaagagcatgtgcctcaccaccatatttaaaggtacgggtattctttcttgtataaaaacaaatcgtgtttcgttaggaaaagaaaaaaaaagaaaaaaagaaaaagcacttgtgattctctctcctccagagaaaccactattgacatttttggtggatacttttttggactccccaatttataacattacttacgctcatggggaaatgcacatggtgcaggcaggtgtaaagtacctgccagatttttgaaaagctgttgctttacttactaacctgctggctccttttcctcacataccttagtcacatgctgacgagaatctgtgtgcccatttgtctctctctcccattaaaatgtaagttctgtggggatgtgaccgtagtattgctctctgttgcatttctgacttttatgcttggcacctgtaggtgctgactatattcttgactgaatgaggtcctaagacaataaattactttgggtctcaggcctaaaaggaggggtggacagggcctggggttagcaggggcagggagcgggactagggaggcccacccctcctcagtcccccttatatgttctccactccccctacccccaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccggtgagcaccaggagggggacgccttccccttagttcaccctccattccccctgcagcccaccccctgctgcaccactgctcccagaaccccagtgctgattcctgtactcagccccatgcatccttttcgtcctctgccattgccctgcccttgacccctgccctctgtcacctccagctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtcagcagaggggtgggcgaaggaaaggagtcctgatggcaggattcaccagggctggagctggtgagagtcacctgccccaggcctggccctgggattggtctggtcaggccaagacccacctgctgtgattgttctcagaagattggggagactccatatctgagagtcctcagacttaatctgcttttgcatctaagaagaaaataggaagatggaacagggtctgggaattgatgggggaagagtttgggggactcgggtggtagcctagagagtcccatttctcctcaccaccctgcccctctgaccccgcccccaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccggtgagcaccaggagggcgacgccttccccttggttcaccctccattccctctgcagcccaccctctgctgcaccactgctcccagaaccccagtgctgattcctgtactcagccccatgcatccttttcctcccctgccattgccctgcccttgacccctgccctctgtcacctccagctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacaggtaagggcagatgaacagctggggaaggacggagcgagtaactccctctttactggaccctaacgtggaatttccataggtttgggtggccagaagactttcaaaatccctttcatagacttcaggtgctcacactcttccccacaagtccttaagggactcgagctgataagaaccatttataatgtttgccttcctaagagtgcttttcgtggcacttatgcttcttatgcagaggacaaggtacctgcccgaaatttggaggcatgggcaggaattctggggcagccacaaggtgtggcccaggggacttggtgtgggtgtgctttccagcaggaactcctctgagtggtaggaaggtattctgggtcagtgggcgccatctgattctgaagcctgagtgacagctggccctccctagttagtccccaacacctgagtcaacgtcagctcttcttcctgcagacttgcgctccacccaggcagccgttggatgggcaggggctgtctctgctgcccccgtgtggtcaaacaccagatagaggccacccctttagtgattgttagtctctggtttccaggttctagcctcgtgggcacctcttgtgcctgagggtgtgaagagggttgaggtcaagagccgcagtctccatctgtgtttggccctgagaggcctctggtcagtcacttcctgggccgacgtgctcagtctggctcttcagtatctctccctggccaactgagctttcccagggacctcgccctggtgcacagtgaggtcaggacagcaggttttgtctgtctggttctcctcttgtcttctgatgacttccatctgcccctcagcccatccaagttctgatctcaccccaagtttccaggtctgcatgcacctcaggactcacttattcctgtcctctccctcttgagacctatgtggtccccacttctgacaagctcggagccagggcccgtcacatcgtctgcttggagttcaggctcactcctccttctctcttacgtgtttccttctggcaaggttgtgctccttctgcccaccccttccccaagatggaaaacactcccttcctgtgctctccaggagagagtagctgccctgagctcttgaatgttctgagacatgtccttgaccttttagagaacagcatatggtttggtggtgaaaatgctgttcacaggcgaaaagaagaaatagaagatagagtgatcttggcagaggatatgaagctttcagaggagggagggtggtagtgaggacacctccaggggcaaatgggagctgagaaggccttgaaggataaggggtctttgtggtcatttgcaccctgggctgagctggatatttgcgatgctgtgcagaaaggacttatgagtataaatgtgattgcaaagagaatgtttatctcacctaagagaaaattctctattttaaacttgagtagctaacatttaaagtgatttcaaaaaaatttagggctgggcatggtggctcacacctgtaatcccagcactttgggaggccaaggcgggtggatcacttgaggtcaggagttcgagaccagcctgatcagcatggtgaaaccctgtctctactgaaaacacaaaaattagctgggcgtggtggcatgcacctgtggtcccagctacttgggaggctggggcaagagaattgcttgaacctgggaggcggaggttgcagtgagccgagacagtgtcactgcactccagcctgggtgacagagcaagacactgtctcaaaaaataaataaaataaaaataaagtgatttcattgaggccattgttgccaagcacatttcacagacgaagaaactgaggtccacagagaagggggaactttcccaaggtcacagactggcacagcggctctcaatctttgggggtcagacccttctttgaaaattggataaatgatcaatgcagcagtttgcacataactctggagggttcgctgcctctctaaactcctccgtgggtctgtagacctgggctccagtgccctgcagtgaggagatgagccatgatcagaatccaactttggcctctcagcctaatttcctctccttcccaccagccagcctcctgtttctgttagagcaggtctggcctactttggagcccttggcctgtattttgcttcgggcagctttgtatcatgtcaaacattctgggattcagactttcagtcctccagctggtctctcccgtacctgatgaagttagtgaagttgtgtgctgtgcagagcctcttggagggggatttatggagcaagccctagagacgtggcctgagcctgtcctttcttgggtgaacagggcaaatgtaatttgtgttccagggacaccaccagttaagggggaacatagagaccctctgcttgagtatttccatggctctgccccctcctctgctgtcagagccccatgatgggatttccagggtggttattgttttttaatgtgtgctctgtggatgggccctcttggccacatcagctgctgccctccttttctgcacacctctcttcatcactggggtgatggatccctgtgcttccaatggccagagcagcagttttgccagcagtgcctattgaaggtgacatctgcagatccatgcacgaggtgcatctatgctggggtctctgccgccaaagggtccatagcaccgcgcactgcactgacagggcctcctgcagaagctgctgaggccctgggtgtgcatcgtctccagacagcaaaggaaagcagcactgtcttttgtcaggcttttcctctcaagacttctccctaggacccagctgggtgcaggggctgggctagaggatggtatgtaagatggagtcacacaggctgtgctcagaacagctcctggccctacccagctttgggtcctcaacttcatccctcttgacgtgacagctctaagaggaggggcctcagtgtttcatgttaatatccccctggcaaggcccctgcagacctacctgactccttggggaaactccaagccctcactccagccccgtcagtgacctcatctgtatgtaggactcagcgaacattttctgtaaatggccagggagtaaatgtttttaggcatcgtgggccacacaccatctctgttgctgctgcttctccttctgttcctcctccgccttcccccatctttttttggtaaccctttacaaatgtaaaaaccatcactagtttgtggactgtacaaaaacaggccacaagccagctttggcccatgggctgtagtttgctgccttctgatccatagaatgggagatgtcaccaggtagggctgaagcagtcaaaagagggcctctggaggaggtgaatattgagctaagcagagaatttgggaaactgatagcattagtgcagaggctggaaggagccagttgcttctggagagaatggttaggacaccagtttggctgaagctgaggctcctacagtagaattagaaaacttaggggagggtaagcagcagccaacttctagaggtccttgaatcacgcttgaagcttgaagcattattctaaagtcactagggagccatagaaggtacttgagcatcaattcaaccacaggctcttcagcccttcctggttgaggcgtgtccacatcagccagggttgtatcagggtttggggagtgtatggcgaagggactgtaggaacttaagtgagctttattcatagtgttagggcccagtgagggtgggagcccctgttcacacttggagccaatggtgctgtcctccgggacatggggccaggcatgacagtctcactgttgctacttttcctctcagggcagcctatgacattccccccagaggccctgtgggtgaccgtggggctgtctgtctgtctcattgcactgctggtggccctggctttcgtgtgctggagaaagatcaaacagagctgtgaggaggagaatgcaggtgagtgtgtgtgtatgtgtgtgcgtgcgcatgcacacttatgtgtcttggggtatgttgctgtctttgatgtcaatagagtgtcactttctagtgacagaacgagtgtgtgtgtgcagatggggctggatttgtctgtgtgtgaccttgagtctacgtcttgtgtgtgtgaacaagcgtgagcctgtctgtccatgtgcagataccacaggatgaatgtggatgagtgtgactggaaggtggtgggagtgtaaggccaagtgctacaaagggatgagtgtgtgccaacaagtgtgcctgtgaaagtgtaagtcagtcacgtgtgtgtgagagagcaggccagagcatggaagctgtgcggcacaaatgtaggcatgccaggggcgtgcatggcactgggggtgatcgtgcctgccttggagtgagtttgaagcagctgccatttgcggggctgagggtcagcccgagctggcattggtgactggtaagtgggtgagaggacattggtgggtggtgagttgaccctggtgggtaaacagatgcatgagagtagatgggtagtcagaggctggggatggctggaggttgggaaggagagggaagaagagtggtcagttggcagataggtgagtacttgtgaggtagacaggtggaaggatgagcaggtagacggctggttggttacatctgttggaggttgatggttggcagggctactgagcgagcggatgggtgaggtgatgggtgggtgggctggtggagggtaggtggatggtctttggctgggtgtgtggcgggggctccaggttgagtggatggtctttggctgggtgagtggtgggctccaggctgggtggatggtccttgactgggtaagtggtgcactccaggctgggtggatggtctttggctgggtgagtggtgggggcgccaggctgggtagtttttggctgggtgagtggtgggctccaggctgggagccccttcatgttgtcacaggctcggctctgctgtgctctgctctcgggctctaacccgtgtctagcatttggtccgcaggtcaggcccactcaggccctgttcaccagcttcctgcactctcaggtgggaaagtgctggcatgaaaatgggcttgcaaaagatttttgtttattctgagttcttgcctttgcaggagctgaggaccaggatggggagggagaaggctccaagacaggtgagtctgaacttggagctggccctcttggctgggagagggacatatgggaaaggagagaggactctaggatctggaggggccagatttgctgtaaggtttgaatgaaatgtgttctgtggactcagacctccccaccccggtgagtctgctctttgcccagagttaggcaggaagtggatcacccagttccctcccaggtgtggcttcatttctcctgccaacctttacccatctgccagggccgattccacctgattggccccacaccgtggagtctggtggcttcctaggggtgggagcaggggctccggagatagggagtctgggtttaagttcctgctccatctcaggtaaacagagtggccttgagcaagatgctttgcctctctggcttcggtttcctcttatgtaaaatgaggataatcacagattcataggttgtttgaattattaattgagataatgtatataaaggacctagtatcatatctagtgccaagtgcttaatactctggagtcctattactattaggcaaacagcttaagacaatactgttctagttacagactgtgtagctttgggcaaggtgccttgctcctctgggcatcagtttcccatctgtaaaatgtcatcctgaccctgccctgatggcaccagagggctgttttgaagctctttcaggtgactggagagggaggtacttgcaaaggacataggagcatggcacagtaagctgggggcccagcttgggtgggtgccaaggcactggtgcccatggccgactcccaggggatcctgggctgggagaggcaggtttccgctgagccatttgggatggttccagttaatgccagttccctccccacccccgcagaaggaagggcaggagattgacacttggggactgctataaattatgccaattaattctttgcctgttggtgcccagcgtggcaggcgtagagacagctctgggatcagacctcattcttcatgctcagaggcagatgtagttggcagaagggagggagtgaggagaagagtgtgggtgatggagttggtcagtctcattccacatggtcccaggcccacctgcaaatctgccagcctcctttagcttctcacatcaccctgtgtgtacattgggctcagggcacttccgcatctccagctggaggtggagggctcgagggttgtcccattctatagatgcagaaaactaaggcccagagaggagaatgacaagccacagagtggaactgggacctgggactggggcttgggacagcaacctagggccccttcccttgtgctatgaagtggtcccactctgctgacttgtcccgccccttccagccctcactcctccctctgcctgactccctaccccaccacttcccatggttcctccctcaccgtgtgcgccttcctttttttacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctcaaaaaaaaaaaaaaaaaaaagtcagcttggttttgaagagttgctggagaatgtggcctggatgggcaaaccagtttgcttcctaaccctgctccttggtgaggcagcctgccccctcagtctctggccatgctggacaaccacagaggcagtgcccagatgggggagctcttctcctctccccagggacatacagagccccaagaatgggtgagggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctttttctctgtgaagtgtttggaagcagggtgggccccaggactcaaccagcaggattctctcctggatgttgcaggctggggtagggaagcctggccctccttatctcaccgtccttaaatcactggatccccaaggccatttggctccctccttggcttcagtttccctctgggtaaagtgaagttggttgtccagaaagccaggccctttggtcactgtatggggctcctcccactggaagcatcactcaatttctttgcctcagaaaactcaaacctaggcttgtttagggcctctactaatgaacccattttagagactgtgaagctgagacccagtaagaagctggcaccaggaaaagagttctgaatgctgtttctggctgactcaattggatgggcaccaggccagggatcagaggtccattcccaggacatagttctgccctatgaccctgagcaggacatttaccttctctgagccttggctttcttgtacaaaaaatagccacctatgcatagtggctcatgcctgtaatcccaacactttgggaggctgaggtgggaggatcgcttaaggccaggatttcaagactagcctgggcaacatagcaagaccctgtctctgcacagaaataaaaaattagcgaggtgcggtggcacccacctgtagtcctagttactcaggaggctgaggtgggaggatcgcttaaggccaggatttcaagactagcccgggcaacataacaagaccctgtctctgcacaaataaaaaattaactacaggcacacacctgtagtcctattactcaggaggctgaggtgggagaatcacttgatcttcagcccaggaggtcgaagttgccatgagctgtaattgtaccactgcattccagcctgggcaacagagcaagactctgtctctaaagaaaaaaaaaaaagaaaagaaaaataggactgaggttttaactaccttccattttgaaagactgagaggaggcgcacaggcttccagagagccagattcagggctatgggaacctgcctaggatactgcgttcgcttgcccctggatgacagtgtcctggcactgggacagcctggagctttgcagaccctgggcagcaggaggagcctgtgctgggggtgaggacacttgactttcaatcctggctctgctgctaacctgtgtccatgtccttcatacctctgagccttactttccttatccattagataggggtgacaagtcatctcccaaaaagtatgtggcattctttacaaactggaggctttgttataaagttgatggctctaggggtgagatcagtcatgttgcttgaggtcctgtcatcggtgctctgggtgggtattaggattgaaagacttatgcctttgccccttcaacccactgtgtgcccttgagcttgctgcttcaccacactgggcttcagtccctacctgtagagacagtaatagttcctgtttcaaagcactgttgagagggctggataaagcagtgggtgagaagacactgcaattaggccagatgcagtggctcacgcctgtaaacccagcattttgggaggctgaggcaggcagatcacctgaggtcaggagttcaagaccagcctggccaacatggtaaaaccctgtctccattaagaatacaaaaaaattagccgggtgtggtggcacgtgcctgtagtcccagctaatcagggggctgacacaggagaatcatttgagcccaggaggtggaagttgcagtgagctgagatcacgccactgcattccagcttgggtgacagagtgagactctatctcaaaaataaaaataaaaagacactgcaaaccattaggtgctgggcacatgtggggggctattctttccctccctgcagtcaggcccacgcgctgttgctccttaggtgattttgtagattgagcacagtgacttggaacaagctctctgaagcccagtttgttcatctgtaaaacaggcacaggaacccatgctttttctttgcgacagggctggataaggctcagacaggacactgtatcaagtgttctgggcacggacccagcaggtgtgggacttgcctggaggcttaggtgtaaagagagtggcaactaagtcctctggtgacaagtgccctggacagcagtatttttagctgcccttcctgggcaaagctccaactcctacattttaatggagaaataattctcacagtgcgacaagctatagcttgcaggtgtcacatccatattaaagaggggacagagcgaggttcatttgcctggctcaaggtgtgaccagaattcgcctccaggaccatttgtaaccagggcttgaagaccagtggatctgactactcaccacccagaaggaggagactgggaggaggggttaaaatggtgtggccagggcacctggatcatcctgcctcttctacttgtgtgtttggagcattctgcttacactcgcagaccctgggcagcaggagcctgggctgggggtcaggacacttgactttgaatcctggctctgctattagactggccaccttctagactgttgtatcagtcttacacatttacaaaaatatcataaacatcatgcaacccttttttctgtttttctttactcttttcccaagtcacttcttctagatagaagtgtccttgtcctctttaccttctatatcgatgtgtaacatacctctagtatttacaagatgctaatcctcagtgtatgactccatgaatttttacacaaatctctacccatgtaaccactacccagatcaagatatagaacagttcctggattccagaaagttccctagtgtccctacccaagcaacagccccgcccacttggctgctttcaccaattagttttacttattcttgaacttcatataaatggaatcctgcagtacatgctattttgtatctagcttcttgcaaagacctccctcgttctttttaaatggctacatagtatctcaaagtactgctgttctagcctatattttgctagttcctacagtttagacacaaataatgcaggcttgtgttcgagtttctacagtatggagccctagaagtgggatctctggatacattttaagtgttaccaattgtttcagctgcctttttagccagtccctgtggcagtaagaatgcaagtgaagaaaacttagggtggctggaaaaactgattctagacagggcagagatggtgcttggaattcacatccagttggtctctcagagacttcagagtggagcctgatttggtagtgtacagggcctgcagtcatcccttccacccgctctggaccaccttgcccttcagcatatgtcactgccgctgcctcagtttccaggagctatctgcgtccccgggaccccagtcctgggggagtgcgtctgcctcctagtggattatgtgggccgagcaccgtgttctgagtgtgtgtgtgccagggttgagccctgcacccgcagcaccataattgatggggggaggttctcagcatctttggggtttttctttaaaagaaggtctcactctgttgcccaggctggagtgcagtggtacggtcatagctcactgcagcctcgacctccagagctcgtgatctgcctgcctcagtctcctgagtagctgggactgcaggtgcctgccactacacctaattttatatatatatatatatatatatatatatatatatatatatatatatttttttttttttttttttttttttttttttttttgcagagacgggatcttgctatgtttcctgggctggtctcaaactcctgggttcaatcaatcctcctgccttggcctcccaaagtgctgggattacaggcaagagccactgtgcctggtcagcatcctgttggatgcaggtggctcaggttaggttaaatctcttgcacttgtgtcagagagtattcataacctttggcactgccagctccaggtaattatggtgacactacttcattactaatgaggcagctctttgttagcacagagaaacacctgggtctcatagaggaggcataacccagccctcagacagagggactgtgacctttgcctccagcctttctccagcatctgagcagcaaaatatcccctgcacctcagcttccttagctaatatgatttctccaccccagcgctctcctctggatgtgtttcatccgtgtcccttgcagattgaggctctggcatggatcacgatgcttcagctcatgatagatcacctctcacctcctgcatccagggcactatgttcctagtgatacagctccagatcccattagtccagcggttctcaaccctggctgcccattagaatcactttgggagttgtaaatggtgcctgggctccatccccagaagttctgatgcaattggttgagtttattgctaagtatttgatgtgcatatgccagtggctctagtctggcttataaattaatgtaaaataggattcagaagacagccctgagctgagacctttgagaccccacctcttagataagctagctattctcagtgatcaccatattggactgtgggttttttgtttttaattaagggaagcacacaaaatacaggagcaaggaaggttgagggaagtgataatctttagttcagaaaggagggggccctgttccctgtgttgtggggctggggaagagagcaggcatcctgagttcctgcattcagaccagacacataggctatgggagaatgatgaaggatggggtgccgctggtgatggctcaatcctttttagctctaggaaatggggggccctgcctactcctgatcatcccctcccccttctcctttcacggcctcccttttgcctctgtgtctctcccgtcacccccaggactccagatgtgcgcagccacgtggctgtttctgactccctcttccctccagcaccatgtcctccacggagggaaggaacatctgtcctgctccctgtagccgtcagtctacgtgcatgtgccaggctcagggaaataatagccttcgtgcttttcctgctccccgcccccccacctcccatctcacacatgcttcagaatcagggtatcctggggtctctaccacactgcagccctgtagtatccagagtgactgaagcacaggagctctcctctaccacccccaccctcctccttgcagctctctggcctctagttcttcctcagtctcaaaactcacctatctgaagtccacctgcctacctacctacccaccctaatttacaggccagcatgctccctgggtgctggtctacactctattctgtttccttcctgctcctcatgttgcaatatcctctcctaaaaagtccctgcagagtgtggcaccattgttggaggtggggaagagggactgatgtgtctgcagagcctgccagccactgactgacattttgccttatttgctaagataatttagtgtaatttgctaatgaatgaatgcacttcttgttcttatagcttttgtaattgcattgaaatccatgtgcttgctgacagtttcagcaaacgttccgggaactgaagctggccaggttacagagggctcagcctccttgggtgaccatgctgagggccttgatgacctgtgaggcatggccaggatgctgattttcttggtgtctctatctgtgctgcttttctcagcgtcctcccgtccactgcagccaggaggatctgggtcagcccaacaggagaatgtgctggcagccaggggttctggacctaggacatttttggaatgggctttgcagtgctagaagagagtgcattctgttctgtctgcaggatgggtgatgagggagtcagggggaagtataagggagaaggggacagagatgactggcgagtggcagaagttgcatgtttcatattcagtcgtgtttataagcatttgctccagctccccccatccttggatatgccctctctctcctccgcctgtgcagatcctagacacccccctcctatgtatccccccagatctctgcaactccgtgtttcatagctacgatgaagcacttgctcattcattgcactctgggaactcatctccccagagcagctctggctggcccccaagcccagagccgggcacagagcagctcctgtcctctggtctgctgcaagcaggaggtacccaaaccacattaattcaggtctctgaatggaagtaactaaggctgaagtttacttctacactatccatgaaaaaatgatttcccagcaaatgaacaatgtaaatgaggcagccaaatggtgcttcacctatttaaaggaataatctattttaaaaatcttttagaagcttttagttacccagaaacaattgatacggtaattgcaagccattttttaaatttacttattagagaagactccctaagctctgttcacccactcccatgctctgctaacccttagggagctgggtactaaatgctcgctgtccttgtaggccccatctgtaaaatggggtcaagagtagtaccttcccctccctagttgaccaaaatggacagagaatgcccaaaggacagagccttcacagggccacctcacctgcacttacacagtatgaatggacagatctgggcagatggcactggactcagccaggacaaaagagagctttgacctgagaccaatagggaggggctggatggtcagacaggatttgtgtggggaggatgggggtggaagcagaggcgatttctcattgctcagcccaagatggtagctgaaggagccccaggcacaaggagcagcagccatggccccctgagcaccagcaccgcagatccctggcctgcaaatcgattctgctttctgtttgatgggcttgttggcttcagcttggggaggaaaaacaagctctttcccaaggagaggagccgtgtcagaggtggctgtggtgcctccatccctgccgcacaccccatccccacccagccctgtgagagatgctgggtcagcgggcaggacaccattcttagcctctcccctggccctagccaggcctctgcctgcctggtggtgtggggcgaggcaggccaagatgcctgggttgaggggctcctgcgggcagttgtctggccctgtgcacctgctcaccgcggctgctcctggtccaatgtgtgtggccctggatggatgtgtgcatttggtggggtgagagagtaggtaagagtgaaaacaggaaagcaaagggcagcatccacaaacttggaaacatcagcctgctgtggaagggacgctcaagccccttgtccacagtattgctgagctctagaaggggaggaattgggagcagctgggagcaaagctcagaataggacccaggaggctctgcccccggctcagcgccatgtccacaagactctgtgatacacctctgtggggttcaatatgaggacaagaggatgggcatctgagcagccacttcctgcatgtggtgaggcagcccaacacagtgggcttttccgttttgcagcccccacagagccagcccctccaagggagcacgtttcattggcagcagtgctggcagtggcagctaagcccttatagggcaccactcctcccaacctcagcaacctcctctctcctcctgtggttttcctaataaacacctttaaaatatttatgaaggcagcttcaatgaagtaacacgacattgatttaaaatgattttcttctaataggtagcttgagcatgggctccatttcccaagctcctaagggcaggcccatcagggtgaacccccaggatgggcattcaaggctctccatcaatgagctgagcagtggggatcccttccctctctcagggcctccactggggggccaggtctggtgacaagtgtggtgtgacagtgtcatagggctcaggaactggactctggtagaaggggtctaggggatcaggcaggccaattagggctctggaagaacgcctgacatgggaagaagctgaaaactggaagtctccctagaaccatggatagcacctccaacctgtgcccctggggcactgagaagcccagaagctgggagctaggactcctcggtctctgtcccactttattgataggaatggagaaaggctgtactccagaaggaggtgatgagcgccatgggtttctagggaggaacctggactgggatgctgtggccactgaacagttggtagctgagtttagctgctccccagcagccctggctggaaaggacacaatggcaatgccttctgtgcacgtgtgggggtgggtcgggagcaagtcgggatctgcagttggccctcagatttgtctgtctggcctttgaaactccaagaagccaccacctaccctccttacacaaatccctgagctgccctctcttgacaggattgtactttgtccaatctcttcccggcacagagggggaaactgaggttcctccccatctaccagcctctccgcaggctagaaggaaaatcccatccatatctatctggcacgcagacagaaggccctgatggagaaattttgggaggaaggttctattctcaattctcaccccactcatccccagaaaagtctaacaagagctgttttcatcaccattgcctaaagcctggagctgctctaattacgtgtcaggcttgaatttgacaggaagcattttaattattaatttgaagtgtgctgagcatggggtggaggagggccggctctccaagctcaggcccagccctgtctgttgggacctcattaataatacctcagacctcccagcctttcttctccagatggagcctcttccctgccacggcccaggatctgcacctcccactcttctgaccttctaacctctcattttgcaccatgctttcttgttttccttattttcctaagccgtttggcacagagtctactgttcccattacatgggatggagcagactgaggtggagggagggcagggagtccagcggatgtcacaacatgcattagccacgggcagggcagggctttttggggttctttagttgttgcctgacagcagaggtggccttctgcagggctgtctctcacctgctgtgtgcctttatatccatatcatctagggtggcatgcaaagttttttcaatttgttgcctgcatctgatcccatctgatcctttttttttttttttttaaatgcagagtcttgctctgttacccaggctgaagtgcagtggtgcgatctcagctcactgcaacctctgcctcccgggttcaagtgattctcctgcctcagtctcctgaatagctgggattctaggcgcctgccaccatgcctggttaattttgtacttttagtagagatgggttttcaccatgtttgccaggctggtctggaactcctggcctccagtgatctgcccgcctctgcctcccaaagtgctgggattacaggtgtgagccactgcacctggcctgcatctgatccttttaaagatcagtttctttgcttcatttacacccaggtatgggtgtgccctttgggctcaggggccagaccacttgttcagtcctaggtgaaagagtcagagcctgtcgtaggctaaggacatcattttgcccattttctctcctgccctcaattaagaaagattcatcccctgctcattggttgttttctgagtttaaaccctggcactgtcctgtgtgttggggcctgtctcttctgtcacacgtcattgtttctgccttctggattcaggaccacaaagctgcaggctgggacgcagccctggggctgaagattgtgctgtgtcacatgggtctagctgctgctgtggtatgtgacactgagattgcatttctgtcccaggcttccttccttctgttgctggccaatccccttcctctccagggcatccctgcctctgcctgcatcccaggcttggtgctcaggggcctgtgctcagccacccgcccctacttcatttcttgatgcaaccttccttagtgttagattctgtgctgtagttggattggaaagtcatgatccactaggggagataagcatttatgtgaatttgatctaggcagaactgtggggtccagaggagggatcaaggaatcctggaagaattggggcagattttccagacacggtgatgtgagagctgagtcttgcaggacatttggtatgttattcatagttgggtacattgaacagaagcaactgtattttaaacagaaaggaatttagtacagggtattgggtgcttacaaagactgaaggagcctgcttggggctgggtctcaggaaatgattttttttgaaatggagtcttgctctgtggtccaggctggagtgcagtggtgtgatcgcagctcactgaaacctccgcctcctgggttcaagctatcctcctgcctcagcctcccaagtagctgggattacaggtgtgcaccaccacgcctggctgatttttctttttttgtttgtttcctttttttcttttctttttgagacagagtctcactctgttgcccagactggagtgcaatggcacgaccttggctcactgcagcctctgccacctgggttcaagcgattctcatgtctaagcctcccatgtagctgggactacaggcacacgccaccatgccctgctaatttttgtatttttagtaaagatggggtttcaccatgttggccaggctggtcttgaacttctgacctcaagtgatccacctgcctcagcctcccaaagtgctgggattataggcgtgagccacagtgcctggccaggaaatacttccagaatacagaatatcacagaactgaacaaccagggggctgctactttgtcatgcagtaggttgaataatggtccccaaagatgtccatgttctaattcctggagcctgtgaatattaccttacctggcaaaaaggacttcacaaatgtaattaggttaagaatcttgagatgggaagatgatcctggattatctaggtgggcccaatataacaacaagggtccttataaggaggcaataaagcagaatcaggaaaaaacaaaggagatggatgacagaccaggagctggcttgaagacggaggaaggggctgtgagccaaggaaggcaggaggcctctagaaactggacaaggcaaggaaatggactgtccttggagcctccagaaggaactcagagctgctgacaccttgactttagcccagtgaaaccgattttggacttctgacctccacagctatgagagaataaatgtgtgttgttacaagcctctgaatttgtggtatttagttatagcagcaaaaatatggggaatgggggaagaatcattggaaccattgggttcaagaccatgcttcaacctgatccagggtacaaaaagaaacccatcgctgctacccttccacacccctgaatctgaggcctcagcactgaaatgctgctgcagttccacaggcttactggctgaaagcagccacagataagcctccaaatctgccttccaggttttgccaaagggcctctaattgctggaacttaattcacacacaacttcagctgcaagggagccctgcatgtttagcttcccaggcactgcagtctagcaaggccatgagaagatggcaggaaagggatgctgagtgttcaccaaacatctcagacacaatggggaaccattaatgatgaaaatgagtaatatgcattaaaacctgaccacgggctcaccaggaaaatctcccaccagcccatgcatgaatattgagtatgcctctgtgtaaagatgaagctaagctatttgcccaaaaatcccacagcaaggaagtgacggaggcaggtttgaatccagctttcgtctactttagcgcttgagcttctaactgctacacagtactgaagaggggcagggtcagtgccacgaggggaaatggccttgaagaacacagatgcatgaagtaaccaggcacttcagggaactgcaagcagctcctatgccttgaacaaaagctgcatggagaggagaagcaaggtgagtagagagcagcagaggccaggccacgagggtctccggcgctctgccaaatggctgcactgcattcctaaagaccaccaggcaccatggaaatcttttttgcaggcttttcccataaaaggtcttaagacaggagagcaacaatttgtttcacattttgtatgtgaagaaaggtttatactagatcagagaactgagtcatataggaaagacaaaaccctgaccctggtcacacactaaaccctgaccctgtgatgggctcagggtcatagactgagccccaaccctggagacacacttagctccaaccctggtcatagactgagctccaattctggtcacacactgaaccctgattctaatcatacactgagcccttaccccagtcacgcactgagccttgatcctggtcacacactgaaccctgacgctgtgatgggctcagggtcacagactgagccccaaccatgggaacacactgagctgactgtggtcacacactaagctcaatctctggtcatagactgagctacaattctggtcacagagccctgatctggtcacacactgaaccctgaccccagtggtgcactgagtcctgatcctgatcacacactgaaccctaatcctggtcatatactgagccctgatcctggtcacagatagaaccctgattctagttatagactcagccccttccttgatctgaactgagtcctatttttggtctctccctgggccctatctctggttgtagaccggcctgtcttacagttgagctcttattcccatccaaccactaggaaggccacttatcactggggcagtcaggcaaaagtgtgattcattcagtgcagcccttctctattgctgtgtccacagcccaggatgcacatctttaaaaagcagagaagtctgtttgtgtgacgtgaaagatgactagacatgcttacttagtgcttgatgagtcaaggagtaggagaaggtggaagaggagaaggagatgagttcctagaacattaagctcccttttctataatgaagggagctctcactacaagcctagagctccctgccaaccagataggaatgcagagggcatagcgacaacctgggactagctgtgctctggcctggggcctgctgggcttccgggagagaaatcagacctcagcctctcccacggccagaggccagtaggatcttacttagtgagatcctgcatgtcacacggggtagcaggcagagtgggcccttgtggctgggccctgaggaaacaacccatttgtctgccggcaggtgggtccaaggtactcacagtatacttgagtcaccccaaagtggttgtagatggggtaaatctcttccttgtgctggaacccgtgcattgccctccacaccccacccctcctttccccttacagctctagaggtcacttgggccattcctctccacaccgccaagcaaatttccactaattaaaactggaatttaaccactctagcagccttctgtcctgtccatacagtctccagggctcaacaatggggtctacccactaccagatgtggtcgtctccagcgtggaggagagaaaccattcttaatgggcagcttgttaacatccccaggacatgactggttcggatagacccacttccagcaaagtgcagctgcctgtgaggctctgctccagccccaccctcctgtcctgcctctgcgatgacatatggggcaggtactatccctctctggaccttgcgaactgaccctgggagcagccacaagaatgccgccctgaacccttgttcctgagctcaggacatttcctatgcccaatatgacagggaggcagagagcccttgagagagaaggaaacaagacggtggtggtgcatattctggcaggccctggggaaggggcttcacacatattttttcattgagccttcacagcagggccattggtgggttttatatccttaagaaaatgaagctccaagaggtgaaatagctggtgcaaggtcacaaaggtaggaggagatggacccccagtctggaaccagggctttctggctctgaagccagagttaggattagggacctcacttgtaggccagccttctcctggctggccctgcccaccatttggtccagaatacaaagcagcttctgaatctggccacggttggggcaggggttggtcagctatcttgagcctcaagactctgggatggtgtctgccagccttggcctgccatggatcctgccctctgcatctgaagttttgggatgaggtctctgccagggacagaaggtggtgaggtggggattatggatcctcttgggacaagcctggggccaggaagggaccctttcactagccacactctgtcccctgctctgttccatgtggaaatctctctgggccccagtgtgtgcggtgagggtaccgtgggcagctagagctcaaaagcatgaggtctgaggctctcaacctggtccagaagccctggcagcctcagcttggtgtcagggccatacgtccttgtggccctgtgcaggtgtcataatcaccatactgcctacctccagggcacactgctgtggtgtctccagcagagctgtgctgaggggggccatttacataggtgacagtgtgagtggtgtccctggagttgtgcagtggctctgacaggtgccctcaacactccctagggaaagaagttctgatagtgatggggcaggggcacagggccaaagggaagagagcttgtctgaggggtacattgcagggcttctgggacagcctcccaaggccagcagtaatggggaaacgagggaatctgatactgatgcatttagctaaaccttgcttttagggcacaccactgggccttcagaatatgcaagcctatggggcaaagatacaagaaaaattcacttactgacatcttgctatgtcccattcagtacttgaaaaatggcaattactcagtgaatgagttatccatgtggctggcactacagtggattgatgaaatagcaacaagggctatttgatttgaagattcccttattaaaaagcatgaaatcatccctcagccctgcaatgatgctctaaatttaaaagcaaacaaagcaacaagaaaccaaaaccagaaaaaaaaaaaaaaccaccaaaacaaaactgggtgagtgcttcgcaaagtccagcagaggcctgctgcctcaaagcaccagagggtcaaagtggcctgtgcctgccttcactgccccacgacccagaatgaaacttcctccctttcaggaagcctttgggagtcttgaccctccaactctgaatctggagagggagttaggtcccatggacaagggtgggccaagcaaaggcaagacgtgtgtttattcaatgtacattcactgagaaccttatggaagcattgtttctgccctcgggcttgcagtcaactggaggagacagctgtatgggggaagataaacctcagtgcagtgatgagggtgggtcagaggcacacttaagacgcagcaaggcagaaaggaaaagacacggcgaaacaagagtttggggtaggctgaattggcaggaatcagcctcatatgcctgcaggtgccagtgcgaataaatgagtccctgggccagtgtggggacactggtgagtgcctgtcccacccagaagggccctgctgctcagttcctgctgactggttctgtgcggaaatgccagcccagtgttgtcacagctactgattttttctaagaaatctgaaattttacgtaaaatgctgtttttaaactactgtaggaagcaaaacaggtatgcaggccaccagtctgcaacctgtggataagagaaataaatatccaaggaaccgaaaggtgagcagggttagcccgacctgaaaaagggtgttctctgggctagagttctcaggacgtccccacccaccccgggtagaaggaccatctgcagtttccctgacaccaccgccagcctccagcccaagcacaagggaccgcattttttttttaggaagccagaggaaagactggaaccctctgggaggcccatatgttgactgggaagactgaactccatgtctggggcaccatcctgaaaaactttttctcgtttacaccaggcattggagtgaaaagtctgtcttgagaggggctggcagctcttaagtaccaggacactgcagcatgtgccactcattgaagtggtgtcaagactgagcacacctgggaacatgtcctagacctacccccttgccaagtggggctcctggctcctgctcccagcccatatcccagagacctgctgacgctccccttggtgcctttgggatcacaggtttacccctaaccaccctcaccccctgcaggtcagaaaatgagctcatcatacctagaattcacctgctctcaatggttggttttctagatttaagcctccgccctcccgctaggtctacaggaggaaataagcctcctcttagtactgtctctacggaaacggtagtgtctggagggcaaaatagatagtgccgattgttcactatgggcagggggcagtgagcagggttctatcccctccccacactcccaggttactcttactatatgaacctcctccctcccctcccccttccccttccccacctcacgagctggacttgtgtccggaatccgtaggttctcggtctgacttcaaaaatgaagccgcagaccctcgcagttgagtgttacttagttcttaaaggcgcgtttctggagtttgctccttcccatattcggatgtgttgagagttttttccgtccggtggattcggtggtctcgctcgttcagaaacgaagctacagactttctccgtgagtgttacagttctcaaggtagcgcgtctggaatcgttcgttcttcctggtggttttgtagtctcgctaacctcaagactgaaactgcagactttcgtgataagcgttacaactcacaaaaacagtgtaaacccaaaacataaaaaaaaaaaccgcctccacaggatggaaaacaaacccaccaggttaccactacgggctcgggcagcccgcttttattctctcatctggccccacccacatcctgctgattggtccattttacagagagccgattggtctgttttacagagagctgattggtccgttttgacagggtgctgattggtgcgtttacaatccctgagctagacacaaaagttctccatgtccccactaggttagctagatacagagtgttgattggtgtatttacaaaccctgagctagacacagagtgctgattggttcatttgcaaaccttgagctagatacagagtgccgattggtgcattcacaatcccttagctagacataaagattctccaagtcaccaccagactcaggagcccagctggcttcacccagtggatcccccaccgggactacaggtggagctgcctgccagtcccgcgccctgagcccgcactccttagcccttgggcggtcgatgggactgggcgctgtggagcagggggcagcggtcgtcggggaggctcgggccgcgcaggagccgacggcgggttgggggcgtggctcaggcatggcgggctgcaggtcccaagccctgccccgcggggaggcagctaaggccaggcgagaaatccagcacagccgctgctggcccaggtgctaagcccctcactgcccggggccggccggccggcggttcccagtgcgagtgcggggcccgcggagcccacgcccgcccggaactcgcgctggcccacaagcgccgcgcggagtcctgttcccacccgcgcctctccctccacacctccccgcaagctgagggagctggctccggccttggccagcccagaaaggggctcccacagtgcagcggtgggctgaagggctcctcaagcgcggccagaatgggcgccgaggccgaggaggcactgagagcgagcgcgggctgtgagggctgccagcactacctcctttgggaagctgctcacactcagccatttagctaaggaaaaattctccattttacaggggtctcctgggaaggccccaccactggccatcgtgtgtcaaggaaccccacaaagatcagggcccctcgggatctttccacagctgctccacaggcagtgccttgcagtgacacctgcaacccccaccccatcctgctttcttgggggtggaggacaggtcgggtgatgcctggagactgggtttctgtggctcttctaagatagtgggggaggagaggacaccagggtgggtctgcaccatcagatttgttgtccacagtgggaagtgcctgactttacacatcccagcataataggaatggagcagcctgaacaggaactgagagccaaaagcctcaggcaggtgtgtaagcttgagtgttcctggcagggagtcatgtctgatcagcacagtgtctgagccctggatagcgtcagcctgaggtcaccctccaagaccccttggtcccctagtctggcatggctggtacaggtaaggtgggggtgggcaggtggtgatggcagctgtgctcgcccctctggtaggggttcggggcaggccaatggaggagtcaggttgcatcagaattccagctagctcccgtgtaacatgttacaggaaggtgcagctccagcatcccacccctctgccctgtgggagaaagaaaagggcactgcaaatgcattgcaggagggacgtttaacccgcttgcaagatccaattatcttcaagggcttagcatatctatgttacttaccaatgtgctaattgtgtgctgttcttatctattcataagagtgggtccctatcatgatggtctactggataactgttgctgagctatcataaagctattctcccagtatcagactagacaggataccctggcttcctcccccacagttaaagaggatggagtggctctgagtggggctctggggactcaaaagtcccttgcagaaggtgctcttatcttttccattttgcaccaatgtgcacctctactttaacaagggctctctccaccatctcctatatggttcccccagccacctttgtgaagttccaccagtatctcatgtccttcattcccacttctaggtgacccagctctattccatttcaagtgaaattccatgtgaaatcctccctccttccagaagccttttccttttttttttttttttttttaaatggagttttgctctgtcgccaggctggagtgcagtggtgcaatctcagctcactgcaacctccacctcctgggttcaagtgattttcctgcctctgcctcctgagtagctgggactacaggctcccgccacaatacccggctaattttttgtatttttagtagagacagggtttcaccatgttggccaggatggtctccatctcttgacctcatgatccacccgcctcagcctcccaaagtggtgggattacaggcgtgagccactgtacccggcccccagaagccttttctagatactccagccccacccattgtcaggtaagcctagaccagaaagggcagtgatatttactgggcttagggcaggctagtcttggctctgccagagaaatggaaagggggaaggatgctttggacttggagctgtttttctgctagtcacccagtcagtgccccagacccaccagaaactagggggtggttctgaaagtctggcctaaagcggagttgaagtcagggcccaaaccctggtgagcactatgtaaagtgcctaacaatcacatagtatgctatacattgtagcacttatatatagtgtaaataataatggcaatgtcagtccccagagcagccaatttctggctgtgtaacttagaatgaattccttatttgttcatcagttgcctcccctgacctgtaaaataaaaattgtggttaattcatttactcaacaaataattattgagcaacatattctgttctaggtacaactaaatctgtcatttagtatttgttaaaagatgtagcacggtacctgacatatatatactaggttgtcaataaacatcagttttcttacacaagtctcagctgtggaatgggagatgggtgggtgtgggaagcgccggaacagagaaacagaaagtcaggagtggacagggtggagggctggtcttgttgcctctggaattcccagccccactacacccactttcccttcttgttgacaagtcctcattaaggacaggggatggtgctggggtctctgaatagtttaccctcctttctgtcccttgatcccattagaccacttctgtggatgacatcatctgtccctcatctataaaatacagacagtgatgcctcctcattcttagacaccaaagacatggcaatgtgcccaccctattaatggagtgtcaggttggggacccccacccttcccaggacatctcccagagtggtctcctcaccaagctgacttgcctcccacttctggttccttaccctggcatcccaggctagacccagcagcagctatggctcccttagtgctgaaaccccacacccttcagttttgactttccccagccccaaggcacaccagaccagaccctcacagaggagttgtgtatacctatgtgtgcaagcaccatgacacctggtacacaggaggtctgcaataaaagctgattgaatgaatgcatagtggatacccttctgcaaatggggctcgtttattcattcaacaaacatttattgaacccataatccatttggtgccagtctccgagtcaggggtggtgacattcaggttaacagtaactaagttctccaaagactgaggcatgttcacatgtttcctcaccccaacactcccctcaccccgaagacccgcctggctctcagacgacccagccccgaccctcacctccagtgaccaggccacccactccaggcattttaactgcagtggatgtttgcagtagatgatgctaagtcactgtgtttgtggttgaatcctggttccatagcccatcctgtgtttccttaggcaagttacttcacttcccagagcctcagtttcctcatctggaagctacttagacataagtaagattgcttatctcatacgtgctgtgaggagtaaatgagataagacatacacttagaacaatgcccagtgcctagcacgtgcccagtggacatgagttattcatcatgctatgacttctctccatcaccaggttccagctcccttctgcccctccacagcaccactcagcacaagcctgtgcacacagtaggtggtcagtggaataggacttcccggaagcagagagatctgatggaacatcctgggtaaagaaactcaaaaactggcaaaggtttggaggcagggaagagcagcaaagggctgtacctggaaggtctggaggaaggacccaagggatggctgtgtctaccccaaggacagggagctcactacccagaagcagcccatgccatgactcagcagtgttgaaagtcagaattctctctatccctagctggccacattttgtgtttcaagtctgaagaagccactggggccaggtgcggtggctcacgcctgtaatcccatcactttgggaggccaaggcaggtggatcatcggaggtcaggagttcaaagatgaggctggccaacatagtgaaactccatctctaagaaaatacaaaaattaacccgggcatgatggtgggtgcctgtaatcccagctacttgggaggctgaggcaggagaatcgcttgaacccaggaggcagaggttgcagtgagctgagatcacgccattgctctccagcctgggagatggagcaagactccatctcaaaaaaacaaaacaaaaaaaaattggccaggcgtagtggcccacgcctgtaatcccagtgctttgcgaggccaaggtgggcagatcacaaagtcaagagatcaagaccatcctggccatgtggtgaaaccccatctctactaaaaatacaaaacttagtagctggggtggtggcgggtgcctgtagtccaagctactcaggtggctgagacaggagaattgtttgaacctgggaggtggaagttgcagtgagctgaaatcgcaccattgcactccagcctggatgatagagggagactccatctaaaaaaaaacaaaacaaaacaaaaacaagaaaaaggaagccacagggatcccactccactgtcaggaggtccagactgggtgtagcaaaattgtgaagtcagccaagtactacctatatcccacttccccctcctccaggatatactcccaccactgccctatttgggggcaaatggccaggcaggggagcagggggcgactgatggacattagccactactacagagtcacatagagccagtgtggggtgcaggatcccatggctgtgtcagagacccctagctctggccctcagtttcttcctctgtgaaatgcgaactattccataggtttcttttccctgactgttgaaaagatgagaaactgtgagcctgaaagtgctcttgccatgacagatgaaatgcaagcctcagagggagaactgttatgtccattcttagcaccaggtaggcccattcctggtcggggactgcccccttctcactctcagggtggggcggaatgcagctggcccctctccccagaggagcccctggcactcatcctgtgaaccagagccctatcgctgatcagcaccaaatggctgaggatttcctggggctgatagaggggctcagacccttggttctcagacgtgagctgggaagagctggccatggcctgcgccatccctggatttccacactggtggctgcaccctggctaactctttagggctccaatctcaccatgagcttgaggaataagctctacattgcagagcctcctaggtctgctcagtcttatccagatcatatcccctgcagctgctccagaccggcctgtacaatctcactgtatgtccacagccggggctggatagcacctcttcaggcaggagcagtgggtgctgccaggcctgctgctcaggccccctccggacagacgctggggggctgtaaacctgccttaattgaaatatgcaacagggaggcccccaaggagcgatgtctttgctgtgctgccagtcccacctccctgctctgagcgaggggctgtgaatcaagctgcagtcaacttctgacctcgagctactgcgagggaccaagcaatggagtgtttgtgacccaggggtggctcccagttggatggaggtgtcttctttggccatcccactcaaagcccctgtgccctggaaatcactggacatctgggttgaggccacactgaccacaaggcatgtccagtgccttcagtttgtcaagtgctttcacagtcaccatctcgtcggagctccacagcagctggtgaggtaggtgaagactaccagacccattatacagaggaggtagataggctcagagaggcaaacggacttgccaaggtcacacagctgctagctagcagagccaggcacagcctggaaatcactaattcttgggggcagagtagcacaggctttgtggctttggggcaggtactgaactactttgaacctcagtcatctcatttgaaaaatggggataggtgggggcacagtggctcacgcctgtaatcccgggactttgggaggctgaggctgacgaatcacttgaggtcaggagttcagaccagcctgcccaacatggtgaaaccccgtctctactaaaaatacaaaaattagctaggcgtggtgacgcatgcctgtagtcccagttgctctggaggctgaagtgggagaattgcttgaacctggcaggtggaggttgcagtgagccaagatcgccccactgcactccagcctgggtgacagagcgagactccatctcaaaaataaaaaaaataaaaataaaaaaagaaagaaagaaaaagaaaaatggggtaataatacttcctgtctcatcaggttattgtggtgattaaatgagatgctgctataaaaagtattcggcatagaagtagcatagagacctgctcaataaatgtgagcaatataattgtcattattatcccaaggatattcagctgctgtccctgtgctggccatgccccagatgaagccctggtacctctaggctgtaacctcatctttgttcaggacctgctgagatgggctcaggggctgggtgtggagacatcgggacggagtggggaccactgggctcctttccaaggctgcccacctggtgaaggtggccaggagcctgtctacggccctaatttttagccccatggaagtggctgcctacttcctcgcacagatctcaggtctgcttagggccacgccaggactggctgaggctttgccctgaggttttggtcttggtctcagaatcaggctgagaatgggagctgaaaggattgggggtggtccagaccctccaatcaaacccctgcccagcccaggcgatccttcaggctctgtggatgcccagcatcccagcacggaggcctgcgccatgggagcagcttgccattcccctatgtcccaggcaaccctaagatggaagggggtgaggcaggactgtgtatagccgagtaagtctgccttggagtagaaggatggtgggtgcaagtgacgcagggcctggccagactgatgccacccccaggccctgagtcctgcagtctccagaccaccccgactgtgaaccctggcctaaagggacaccactccctttagagcccgcctcctgcaggggagtcccctctaggacatggccctggccatcagccagactccaccacagagttcaggggctagcaaaaggaggatcagacctcccatcagttttacatactttcagatacccccttcaggagccccgcaatgagaacggaggaagggcagtcctgcccacacctcctgggacctaggaggccaatgggcatcttcatgtctaagaggagctctgtgaaagctttggggcctgtggggccagatccttagcatttttaaattttattatgacttcatttgtttaaatatatatatatatatatatatatatatatttatttatagctctatgtgcccaccgcccccggccccctccccggcccctagtttttccccctggctttctgtctagtggctgtgtagggcagaaccgtctgcgtgctcttgtctgacactgtctgggtgctgctgttcctcgtgacccttcgagtctgttcaggggccaaggtagagcctgagtggcggctggtcagtggagagcgccgtgacttgtagggggctggggagggcttgtgggggcctgcatgggcctctgtatgggcaggctcagggggcaagcccacttcttcctcctccacctcctgctcaccgtccccctcctcatcgtcacagcacagagcatggtagagcactttgtcactgaaccgcaccctctcccgtgtccctggggtccgctggggcagctggctcttcaccgtggggccagcaccaaaggcctcctcactggaggagtctggggtctccactcgtggcccattggggatgggcgtgccaccattcatgaggcggtagtcagggccagcccctggccgagtcgactcgggaccatccacggagtccgagggggtagagacgtccaggaaggagcagaactcccagctgtctgagaggatatcggctgtcatgaagtccaggtggcccaggtcaaaggggccacccatgcccgccttgtcactgctagaggtgctgctcacagtggccgtggtccagtcgtccggctccagttcaaagtcgaagtccgaggttagcttatcgatctggctcaccacctgaccagggaaggggagaggagatgagaggggccaggtgggtccctgcatcagccaggtgtgagtgtgtctccaccccatccctgtagacccctggctgatgagcgtactggacaggggagagcctgtaggatggtgactggcctggaggtcacaggttggtttgccctgtggagggcccaaatcagatcaggctggacagagcttgttccggcccttcccaaaggtctgtttaccactgttcagtgccctgggggagagggaactgctttccagccctgcacaccatccattcactcacccctgtctctcaaacacagcagctgctctgggggcagccctggtgatcagggatgaatcttccttagtttgagagggggccacttcagaggggctgagggcctccagcaagcccattccacaaagagctgagcagcccatgcaccctcagagaggaaatgatgtgggtgatcacaaggaagaccctgtgtgggctttctaaagcatcctggaccagtccttgcagctgactggtgactgtcgcccctgggtctccaccatccctcacggcaagaacaccaggtgtacagcactggctgggtcaccccacccccatctccatctcccggagcctcctcattccttccccttccctgcccactgacaagtggagatcaatcctggcttgttgagagaaggaataaagcaagcattatttgataagcaataaagaagccatctattctgggcccagagctgcttgttcaatgcactcagggggcagctcagctgtggaggtcactccaccctggcctgcctcgcataaagtgaagcccttggcttctatacagaaggccctggcttgggacactcccttgcctgggtggccactgtcagcacataaatcagggaggaagacagtgagggaaagagggagatccagtcagagacacagggatgggacagggcaagagaagggagagagaagattccaaccaaaaacaaaacagaaaaacaatgaaaacaaagcagcgaggccaagagtcagagtaacagagaccaagagatccacagtgagtcatccagatcagaatccagcccccagcacctctctggcgcccttcaacctggggtcagagcaggcaattaattaattaactcattaagtccttaattcaacaaacagttgctaagggctgctgctgtccagggatgtgctagtatttggcaaggagtgggggtagtgagtgccccaaagtgagaggaaagcaaggacaaaagtgatggccagagtggcttgggccagtgggaagactacttgatcaggagtcaggggctggatgcaggagacctggtcaaccatttttcctctgtaggtctcagttgcccagtctgtaagcgaagagggtgggtgaactagtttatttccaaggttccttccatgtctgagattctaggactctgtttataggaatgactctgagaggctgcttgggtgctgatgcctagggatggcccctcaaccattgcccaggccaggagtggggaaaccacttggctgaggcctccagaagagctggaggaatcaggacatctggattccagacttagctttgacattgttctgtgtgtcttttggaagatcacagaacctctctggacctcaacctcattcacctccaagtgggtatgacaatcccagaccaccaagtgagtatgacaatcccagccaaccttatgagagcttcatgaaggacagtgagaagggcagcaaaaggactctgcaaagcactggggatgaaaatgacaccacctcccatctctgagcacctaccatgcaccatgctttcgagtgctcacctccacccatgagatcattatctcctgtgtctacagatgaggagtcttgggcactagtccctggaaagctgagaatctccccctgcggccccctgcaaaactgcacaccatcatgaagtgctgctgtgactgctgggcttgggcaggcggcagggatagggccctaccctccaatctggctacttcttcttgtgcttctcccaggatgatgccttcctgccccaaaggaacctcagagaaactcctatctcccagaagcccttgctcaacccaagctccacccaagggctggtgggagcactggcctagcgtagggacactcagacttgagtgtccctcagctcactccccagagtttctggttctgctggtctggggtggtgctggagaaggtgcctacctagtgtgcctccaggtgctgttgctgctggtccagagacctgctttgaaaaccactagcctagggcactgggagatttaagctgggtgaagaccagcaattcaaggcattgatggcctcaggagaggcccaccacctctggggcagctatgccctcaaatgagactcccctgatcaagccagagctgtggagtttgctgctgcctgagggcggggcagaatgccagtaggaattggagttgcatgacttggctgtgacctcacagggtcagctgaggccaggctgggcccagaagctgggtctcctgatgcttagtgaggacaagcaccattgggcctcaggcagggaagatccagggtacacatggcaggagcccaagccttcaggctggaacactcccccaacccaagaagcccttcctcttctttattagtacactcctctctggttccaacctggggggatggaggaaagagaaagagggaggcctgcattcccgagtcccacgtctgccacctcttggctgagagaccttaggcagatgattatccccctctggggcttgatttcctgtcctataaaaggaagtaacactcccctcctcacccagggtgatgaaaatttaacagatatgggccgggtgtggtggctcatgcctgtaatcccagcactttgggaggccgaggcgggcagatcatgaggtcaggagattgagaccatcctggccaacatggtgaaatcccgtctctactaaaaaataaaaataaattaaaaaaattagctgggcgtggtggtgcgtgcatagagtcccagctactcgggaggctgaggcagaggaatctcttgaacccaggaggcggagattgcagtgagccgagatcgcgccactgcactccagcctggcaacagagagagactctgtctcaaaaaaaaaaaaaaaaaaaaaaaaaaaaaagaaagaaaaagaaaatttaacagatatgaatgtgtcacagagtcaagatagctaaatacttaagaacctgggctctggagccagacatggagtcctaccctggcttcactgcttaccagctgtgtgaccttggccaagttactcaacgtctctgtgcctaagttcatcatcaaaggagaattctagtaatacctacttgatagggctgttgtgaggatttaatggcttaatgcgctttggacagcatatggaacaaggcagactaccaacatctacaatgcaccgttgggggctaacatgtgatcatgcccccgcaccaggcctaagagcagtgggaattagttctgcaccaaaggaatgaccctctgatgtgggtccagtgactgtggcagaatttccagtgcctgtggcagaataatgggacatgccaggcctttcaaaacctagcacatggacagtacctattttgcccaaagttagggctgtctccagaaagaacagaaccagaagaagttctaaaaaccaactggctatgaggcccacaggcaaatctggcccaacctattaggtgagacaggtcacaccacttgatgaatgacatagtgaggatgtgaaagggaagccatgtgcccaagggtatgcagcttctctgtggggggcctgggtcagttcacaatccccactgctcttccctggtgcctcgtttcctgggccaatggtgagggcaggtgtggagcagaccccagtcttgtcttgctctctgctttggatgtcttgaaatctgtgatttttccctgaggtttaataatcattttgcctacatgtaatttgggattgtcttggagtgcatggaaataattatatacacagaaggaaagagagggggagagagagagtggagagagaaattgaaccataaaattacagaatcagacaacccccaagccagaagggactgcaggcactgttgagtccacctgtctcaatgtgtttgccgaggggggcaatgaggctcagagactgggaggagctgagctgggaccagagggtgagtcttgactcctgggcattgcaccttaagaccaagaatgacttgctctgaagagaccaagagggagccctagagagcaagggcaggactgagggctgtggcagaacctgcaaacctcgtgccagaggtgtccccaacctctgtcctggtcacagccttagcgcccctcgctgaaaaactgcacccatctagtctttccaccgatagcaacttcctcccagctcttgcttcatgctgcacctagggaactttcttatcagccaacaggtccacgttgcccctgtgcttccagcccttccatactccccaaactcctaagcctcccaaacataactccctacccaccccctttcctctccagcaagcagcctccaccctgccaggcctgcctcctcaccacccctacacactcacactccatcgagctcacttctgcctctgggcctcacctgacacgccctccctcctttcctactcactccgtcttcacttcgagaaggaagccttccctgatccccagctgaggtcaggttccctatgaaaggctctcaaagcaccctgcacctctcctgaaaatgttacacaatatttaacactgctacaattttgcacctatatgttataacgtggttgatgtctgtctccccactacacagtaaaccccatgaggagcaggactaggtctcttgctcaccgctacatccccagctcggcacagggatcggcacattctgcaaacacagctgttggatgagtgatgagttgagacagatggcttaataaaaactactcgggaggctgaggcaggagaatggtgtgaacccaggaggcagagcttgcagtgagccgagatcacaccactgcactccagcctgggcgacagagcgagactccgtctcaaaaaacaaaacaaaacaaaacaaaacaaaaaaactgctgggggcttcttttctgaggaagagttccatagacctggacaatcctatattgccagacgccaaccctctctccagccctggctgagccccctctccagtggaagctttgctgtgttccttaaggccttagagctaggactgaggacctgtagtcccagaaccagcatcctgtacccccggaccccccaccacaccccccaccctgccccacctcacctcccctgacaagctgccacctccttccctctctcccagctccccaaggcagctggttacataactggggattctgcattatttatgaccactgattattttttaattctgtgattacgttattatcttcttggggggctgtggagttggaggggcagcgagctgatcgtgattcatggctctcatcctgcaatttggcctaattggccagggagctttggtaaatctgtccggaggaggagaaggcaaagggaaaagggaggaaaggaaggcgtgaacaaaaataataagaaaaaaatccacgcaattcttgctgagctgcaggtgatggagctgacccactttggcgcagctccgtggtccccagcctctcctgctccagctgcttcctggctgggccccatttatctcacacttgcatggcctatggctttccctgccaccttcagacaaagccccttgccgatgggactgcacaatggaatggccaggaaacagaatgccaggatgactgcttcctaggcaaatccggtgggggatcctccactgccacccaaggctggggaaacgttgtgccaacccctccatcttcctgaggtgtttgggccaaagtgagcaactgtgcccttaagttatatcccacccaagagtcaccgatgatgtgggagacactggtgttaatgcaaggatcactattgagcccccatgttgagtgacgcctgggggagggggaaaccaaggatgaggaggccaagtacctgctcaaggtaagctcaatacctgggggccaaggacaggggcccttaaccctgcctttgggagcttctggtgggtgggtaacaggggagcagtggggaggcagattcccacccagaaacatgaccagcagattcctggagagtgtgtgggattctcactgagaacgaatccaaattccgtgcatgctgtgcatggctcgacggaatctgactccctgctccctctttgacctttcctctactcttctccttgttcactgccctccagctgctctggcttccttagctgaacctgcatatgccaagcacacttcctcttcgagaccttggcaccggctgcaccctcagccgggaatgctcttcccctagatagccatgtgacttgtatcctcacttctgtggggtctctgttcaaaggccaccttattggagacccccttcctgcccccatccctgtcactctctatctgcttttcccactggcagggagtgagactgctgactgcaggagaaactaaagggccccagccaggaggccaggatgtggtcctgacctccctggtcatggctaagaaactgatgtgattccagaaaacaaggccgtacgtggagctgaggagcaggccagttttagaataattcattaaaaacatcaaacagatacggagtgagctttgtgcctctcattgtgctaagtgctttatatatgtctcatttaattctcgcaacaaccctggggcaggggtaggggaggatgcctaaaatgtagtctccccatttttaccaatgggaaaacagaagcacagagaggtaaagtaactttcgcaagttcacacagctaaggagagggtggagctcagatttgaactacaggcatctagctgcagagcccatgctcatagcccctgagctgttctgcatctcttacttaagatctacagaactttgaggagcttagagaacctgctgggactggcccggtatcctggagtactggggagcctgggagagataagggctaattaacgattgaccgtcatatccctctgcagcacaattttagctttcaaagcacttttacatcctcacctcacttaatcctttaaaagactttccccaccaatgggatagaacttgctcatcgcccagggagccagtggcagagctatagtaggggtttgcgagggcgagggaggtgtgggagagggaacttcaactcttctaggagtgtgagtaggtgttgatccccgcgcccccagcccactgcatgccaagcccctaataaatccttataagatcaccgtgcagtgcaaatcaccacatcccaatttcagagatgagcaaactgaggctgagggacctggggaggaagtgctttggtgtggctcatctttcagtgaatttcaggccatatgctcgagaggatgaggagagtctgccatgatcagtggcatcagggggctggggaaggggagcagcaggcagaggaggaagatggctgaggggaataaagctaagcccttccactccgctggccttgttctttcaccaagcatatgtgcagccccccacccccaacagtcttgtatgtgactctcatctccacttctaagtgcttggcctgagacaagaacacagctggtgggctctaagctggtgctgcccaggtcatggggtgaggtgagggaacaagtgagtgcctctcaaccttgagcctacccatgcccccgataaaaaaatgctacacaaagggactgaggagagccaggcagattcagctttacagctcccttggagagccaagagccaagaccacaggttccagagagcagggagattccaacccttttctccaaaccggggtctggcacccccccttggtaaccccatccctggcaaatcccatctcacaggaagacggtgatggcatctcttcttttgcttgggcctcccagagcttcacctgccttcctccacactcccctctgcctgtcaccctgtgtctagaccctgcctgggggacgagagagttctgaggcttacccactcccccagctgggtgccattggcagcgggcaggcagtggcatacggggtaggctctggttgccgtagcaacctgccaaagtcttgggtggaggcacatggcctacagggtgtgtggggggaggggactcattttctctgtcctggctgaggcctctgggctgcatagcctgtgaacctggagctctgctattggagacatgggagtgggtgagtgtgaaagggaaggagagggcatctaaacgatctgcaaataaatcctagagctattgcatcacagatgagcataagagatcatctctggaaggcccctgtcaaaatgcaaagagatcgcccagtagctcacctgctgaaaccccagaaaaggcatcaggaacccgagttctaggcatacttctgccactggtaggctgtgtaaccttggacaagcccctattgctctctgggcctcagtttcttcaatagtaaatggacagagctggtctggattacctatgagatcctttgaagctctgggtggctatgcggtggggagagggaacacagatgcctggaagatgcccaactgggaaaaggctgggagttgtatcagagttgactcccaggcctagagtcaatcctggctctttgtgggtacctgccggggcataggtctcatgtccctggccaagactgagactttggacagttcccatggccctgatctaaaataagatggaggcagggggaaaactgtagtgccttggacccaagagtttggaggaggaagcgttccgcaggggcatctggcgcttgatctccaaattgtactgtccaaagatgtgcaacccagactatggccggcccagtccatgggcagaagcaccaccacctcagtctgcctgaagcaacagtcattctcatcttctgagatgggatttcctggtaggctccacgaggctgaccctggacagctcttgtcctggcatctctatgcccactccctatcccattctgaacacagtgcccttcaaacaacccctcctccttggctctcaggccaggctgcaatgccactttgccagcctggagttggtacctaccatcaccccacctcttcagccttcctagagcccctatcctccctgcacagctggccagggagagcttgagcccataactccaattcaatcactctccctgccatctctgcaggggccctgattacaaggagttgaaatttgcctaaagcccacctggctggtataatggcacccagtgggcaaattcaggctagcagctcagaacgctggtcatgcattttggactcgaacgcagcacagggggcagggctgaagacatgtgtacctcattaccctagcgatgtgagaagcagtaattaaaccaggctccacttagaaagacagagagggacacacacatcccagcatttctcagtggcttttcagccttggcaaaaatatttagaacagtgggatggagactcgcatccccttagggaagactcctgcccctgccaaaatatgcaaggaactctgttatccactacagcacccccagacccattcttacccccggacaaagaggacatagctggcttaaatttttccaagatcaagggttctcagtatctgtgtgatttctagggatatgctttgagctgggcctcaagcagtggaaaccacctcagcacaactatctgcactctcccagggtcccttgtgaccagatcagagtctgggagacagatggtgggttcaagggtcagcttgggtcccagaaggttgtcttccactaagaagctgtggcgggattcagtccttactggccatcttggcagccctttgtgctaacccagagctccaggcccactgacatgctgctcaagtaacctctacaacaccgaggcccctccagccttggggtctgatgagatttttagcaaagcagatttgcggaaaggagagcaaggagaaagaaggtccccagtagagtgacacatgtgcacgcagctttgcacactccaacgtatttatgagtacgtttttgtgccaaacccaagaaggttggcttagggtctgtctggtccctcctcacccctcacttacctccctcagctccttggccacctccttgagctcgcgaaggatgccctcaagctgcccgatgaccatcttcatgcgctgtcgaatccgctcccgctcaccaccactgctggggtcgtcactgggctgcccgaggtccggggcgccccgaatgttcatcgtttaccacgtggccgcaggcctgcccatactccccccagctgggcacacactgcgtctgcctccacggagcccccctcggctgggcagagctccacattttaacggccccccagcccaccctggccctgggcggccctcaaccagcccctgccccctgccacccagcctcctctgcctctgggtggagagtgggacacccagagggagacagagtctagcagagggggtcaaggtgaggacacaggagaggagggggagggaccttgggtcccaggagtggcctccaggtcttgaagtgcctgtgggtgtgcagagctgatctctgcctgagcttgaacacagaggcagggggatgactctgcagggactaagggtaagagatgcccttgggatgggggaaggcagcagggatcccctcacaactcctaggcagttgcaaaggcagaggtctctggatgcaactgacacctgcagagggatggtggccagggtcttccagatgtggaaggggctccggatatgggcagctctggggagggagctggattggaagagggcagccccctgcggagagagcgagcctggcgtcagccctcccaggctgcagcaccagccggcaatgccgctgcctccctcctctcgccagcctgcacccttcctcgctggggatttttttttctttgtggggaggggtggtggaggcagacggtttacagcacagcccctcctctagagggaaagggagggagcccctgctttagaagcagaagtcctcagcctgctacggggcaccctggccgtagctcccgccctccccccccaccttccccccagccaggcctgcccaggctggttcaccagagggcctctccagtcacccatcctccctcctagcgcccccagggtgccctcgttcccagcggaccctccctcccccagccccgccttccctcagaacccccactcctggactcaccgagggtgggggcaccggccttccctccaagcagcgtcgggggccaagccccaagacggagttggggggcccccaaggctccctagggcgggcttctctctctggacccttcggccccgggcctcagggaggtcctccgagccgtgaccggagacatctgggcggtgggagggggcggggcctccgcgctccagggaagggggcaggaaaaatctttctcaagcctctccaggctcggggtcgggaatgagcgagggtccggcagatttggggctccgaggccacaggtgaccggggcgcggggaggccgaggagacgccgggcaggtcccagcgcgtgagccaaagtcggagggctgggagggcgccgggatcccctcagcccacgcccggcattccccgggctctgcaccgtccgggattcgctctgtccagtccagatcggccgggtccgtgttccgctggggtctgccctgccctaccccgcccggagtgagctggcaccgccgggcgcccgggacgcgctcagcccggacccagaacgtccgtgccccggcacccgcggcgtccggagcggccgcgagggtctgctcagcccagccccgcggtcggccctgggcgagaccgctcccacggctcagttcacgttccgaaaggtccggaatccaccgggtccccgaggaggggcgatgtcagccgcggggacccggtccccgccgggcccagccgagagcgcgcgaagccgggggccccggccgggctgggttcggcggcccgggcgcaggcgggagcagcgccgggcggaggagaggagaggaggcgagaagaggcgaggggaggaggcgcggcgaggggaagggaggggagggggcgagcggcgggccgggccgggccggggcgcactaggctcgcagcctccgctcggctccgctacctcccgtccgttcgctctcggctccccgcctcagcagcccccgggcgccgggtcgccgccggtggggcaaacaggcgccgggtcggggctgggcctcccttcaccgcctcgccctgccctgccccgccgggctcccggggcctgggcccgctccccaagcgccgcggcgccgcgccgcccgcgccccggccgcccccggcccgccccgccgccccccgccggactggccgcccgggcgggcgctggctcccttaaaggccgcccggctcgcttggctccgcttgcctcggcgctgtcagggaaggggccggcccgccgcgccgggagggagcttttaaagcgacacacacgcctcccaaccccgagggccaagcgtgcgagccaggggggtctcgccacccgggcgagggggaagggtctcgctggcggggctggaggcggactgaccggaccccacgccggctgacctggggcgcggagggacagcgttctggggacttcgttcctttcccacctctccagacacccccattgcccccttcccctactgcactgcccccaagcttcccttttggccacgtttcccgcatccagaccctcccttctaccacccacataacccagcccctgaccttgcctgaaatcacattcattcagaaaatagaatactgccaacctttcctgagaacctactgtgtgccaagctctgggtcggcagggctgggggttggaggctgtcttggacacccatcgtttccttcagctattcaacaattgactcatgtattagaggccttctgtgcatcaggttccatgctaggctccggggccaccagagcatttcaggaagctcacggctcggggacactcctgagtcacaacagaggcaaattctggaagcaatgttaacaggggagtagggaagtgtgggttgggtggtgcagttcaggccagggcctggcgggttctgccaggtaggccacccctgagctgaatctcaaaggaggagtaggagtgactgtcagtgtggggggttggggatcagcattccaggcagggaggagggtgggagcacaggctcagaagcagaaatgggaggaggggagtttaagttaactggggccttttagataccattttgactgcagaccacagagagactcagagaccatggttaggagcttagattttatcccggggcggagggagctttgatattgggaggaacctgggcctgcttgccttctcaggaaacccctctggggcattgtgagtgggtgtgaggaggtgccaccgagatagagcagttaggaggctatttcaccgttggccagaagacagtggagtctatgaatctatgctcatgagagaggctggggcttgagagtaacattttgtttgtttttttttttgaaccatcattagaggggtgagatgaacagggacgctgcgtagaagtaacaaaagcagtagttctgggctggaacctcagaaaagagtccatgagtgagagggaggagtgattagaaagataggagaagaaccagaaagtggagagttatgtaggcccagtaggaggagtttgggagaagcaagtgctcatcagtgtcgaacgcggcagggagtggctgtgagagaaggaacagaaagtgtctatttgtcttggtactcaggaggccacgggtgacatggcaggggcaattggttttggagggtagaaggtgacaggaaccaaactgttgggcatcgaggactatgtgcccaacagtgaggaacaggagtgagtacagatgacattttcaaaagtttaagtggcggggaagcagagatcttgaactagaggcagaggaggggtcaagggaggtggggctaggtggtggttttaggctggcccatgggggacttgaattccagagacagtgatggtactgtgggtgctaatgatgttccttggtctctgagttatctcagagatgtattcacagggggctgctgggggaactgactcctacttccttgagattcagctcaggggttgcctttggagaaccagaagctgtgagggtgggaatccagctgccctgggttggggagatgttcttctgatggggtggatccagagggcccaccaatcacttaaaaaattgtagcaaaatatgcgtaacataaaatctaccttttttttttttttttttttgagacagagtctcgctctgtcacccaggctggagtgcagtggcgcgatctcggcttactgcaagctccgcctcccaggttcatgccattttcctgcctcagcctcccaagtagctgggactacaggcacccaccaccacgcccggctaatttttttgtgtttttagtagagacggggtttcaccgtgttagccaggatggtctccatctcctgacctcgtgacccgcctgtctcggcctcccaaagtgctgggattacaggcgtgagccactgcgcccggcctaaaatctaccatcttaaccattcgtaagtgcatagttcagtggcactaagtacattcacattgttgtgtaaccatcaccaccacccatctccagaaccttttcatcatcccaaactgaaactctgtgattaagagctgatagcagccactctctgtggagcacctaccaggcaccaggcactgggccaagtacttccacatgcattatcttattccatctcacagtgactttccatcacccctccccccgccagcccctggcaaccaccattctatcttctgtctctgtgactctgactactctaggtgcctcatataagtggaatcacacagtctcaccaatcacttttgtggaagcagtgatgctaaggaacagccgagaccaaaaatgggctaagcctgaaaaaaaagagtttctagtcttaggtccagggaatcatccgccctcatccaggatgagggagatgtgtttgaactggcaaggttaggagacagtgagcttgattggacagggtggactgtgactgcttaatacataattgatctcgggtctcattaatagaagcacagtgttttgaaaaagggaggtaacatttcttctgtcatttgtgtggatcaaactgtgcctagcacctcaattcattgggtgtgtccataggaggacagccaagtagaataggggaggtgactggtgtatatgttctatgaaggatggtagggctggtcagagcaggctagagaagaggagactcaggagaaggggtctctgattgtaaatctccaaagagctgccacaggcgagagggaatagatagtatctgggtggtgctcagacctgccttccttagtgtttggggattgatccatcctttcttccacccaacctccctggccacctgcctagatgtcccatcctttagatctctgcttattcaccgccaacctccaccctctaggcagccttccctagtgctttagtctacggagagaaatggaagcacttttttttgcccttaaccaaatgcttcccagggcattcatttaatgtgctagctgtgtgaccttgagcaagtcacttaacctctctgagcaaggatagcagcctataaacattttaattctttcttgaattgggtctcttgtaaaaaaaaaaagggggggggatgtatttcactgtctctctgattcagaaaaatcaggacaataatgactactttccagggtcactgtgaacatggaataagataatgcacatggaagtacttggcccagtgcctggcacctggtaggtgctctgtaaatggtagctgctatcagctcttattcatggcttcatgtctgtaagccttatttccatgtgagtctgtgaactcctcatgatgggcttgtgtgtgtctgcccatctctcacatggaccactgcagtagacagtagacagcgatttttacctgtctgcctgttttccaccatccagttctagcattccttttcttggggaaactccctgctgtcatcacataatcctagtgggttgtcagttaaagtgcccactactcccacccatccctatcccactgccactaactaggcatgtgactcagactgcaccaaccgtggaaccccatcctccagcaacagtgattggtccaaggggtgggcacataacctaagcaggaccaatcagattctttccctgggattgatatgtggatgctgggaggaagaacccctcttcctagtggggtgcaaaactggatgttatggtccaaacctgctgacaagccatttttcccactcaatctaggaagctgagcaaggcagcagagaggagaggaatttagagagcatgctagcagcattgagtcccagtttttgttctcatggccttcactcctgcagttcttctttcagtctggagagctgcaacaacatcctactcatctctaagagctgataaattcctcatattgctccagttcgtttggtggggtctctgtctcgtgtaaccaactggagcctgacagatgcactcaggaaatactaaatgagctgactaaatgattgactgagtaattgggttcccagatggggtaagatgtctccaaatcctgaagccagagggttgggacctgctgccctgtggccatggaggggaagtgggggcatttgggagattattgcaacaggccaacttggatttgggccccagctttgtcatttgctagctgtgtgatctcaggcaagttacttgccctctctgaacttgagatcctttgtctataaaataggcaaagtactagtgactgcctagggttgctttgaggatggaatgagataaggagcaaaaagcaccaagcacagtgcctggggtgtgggggtgagggagcaggagttggaagaatggtaagaaatggtaactgtttttatttagtctgcagtctactctctctaatagcgcaggactgagactggcatgcagctcaggagagaacgaggattcagtctgcaagctagattctcagaagcaatggatcctgacaccagggaagcagtgccggggtgacagtgggcatgtttgggcttcgaacagataatagagacagtagagagagtctacagagagaaatggaagcactgcctaacacttaggcagtagagttggaatgatagggcaccaatgccagcttttccattaaccatgtgactcatttaatcttcccaagcctaagtttctcgttctgtaaataccttcctggtagctgtcttgaggactaaataaaacagttcatgtatcatgttcagcacagggcttagtaggcgtttgataagtattacctattattattgatattgggggcttagggaaattttctaaacacaaaggttgggatgagtggcagtcaggtgggatcagaggcaaacttttcatgacaaagtccccaaataaaggagttatagagaatcatatctgaatagccaaggaaaggccatttcagaatgacagggtgacatatctccttctgtggctggacagtgtcgggttcacactgggaaagccatgtctgaggacatttctgtcatcttgctgcccacaataatctccccagctgagtcaagtttctcaagagttttctacactgactccttccacttcctcacttcccactcactcctcaaaccttgtaacccgcgcctgctggcactgcattgctggaataaccctcactgtgcaggacattatccttgctaagaccagcagacacttttcttcccctatccaaggcagcgaccttgggggacctgaccctgctgagcttgtcttacttccgggtcccctgtcctgtgtggcctcatgtctcctttctctactgattcccttcctgcctctctggctgctgcttctcagttggcttcaggtgttcatcttctttctctggccccttaaaagttaagtcctcagggccaggcacggtggctcatggctgtaatcccagcactttgggaggctgaggggggtggatcacgaggtcaagagatcgagaccatcctggccaacagggtaaaccccatctctactgaaaatacaaaaaaattagctgggtgtggtggtgcgtgcctgtagtcccagctactcaggaagctgaggcaggagaatcacttgaacctgggagatggaggttacagtgagccaagattgcaccactgcactccagcctggtgacagagtgagacttcgtctcaaaaaaaaaaaaaaaaaaaaaaaaaaagctgggtcctcgagattctcgtctagactctcttctcactctatacaccttccgtaagggagctcttcacactcccaaaaagtttttgacttccaattcactgtctccagaggagacctttccaaagcttcagatcatattgccacttgcctactggacagttcatgaggttgtcttgcaggcacctaaaactcaacatgcccaagttggaacccattacctttcctccaaatgtatccccttttgtcttcctaatttcagagaatgtcaatgccctctactcctccatgcacgccacaaacttgtgatcgcactagagtcagagccagagttagagccaccctagagccagagctcttccacatttcttcagttactaagtcctgttgcttccacccactttatctccctgtcgataaccaggctcttgattgcacccatgagcccctgtattagccagcagcctcctgatggatctgctaatcttcacacttaccctatgaagtctgctgttgctgttgctggtaccagccttctgatctacccacttatgaccatccacagctccctgtctttatgaggaagtccggtctccctagtttggcgtccacatctttccaggagcctgcccttgtctagctctccaacctcatctctattgcctcttgctctctgtgcctctgccaggctgaactgctttcagctttttcctcaccaccaccttatacctgccctcctctttgcctggaatgctcctctcctctctcttctcgagaccaacccccagaccctcctgaaatattcttccagtgtgcaaggtccctcctctgcaccaccccagagccctcgtccaccgcaagtacagtgtctgccacacttccttgccattgtgaatccagctctcttccacagaccacatgctgctggagagcacctccatgcccttgacatccagtagagccagtcaaagtcagttctcaaggcatgttttgtaaatattgagtgactctctcaaataattatttattttgcatctttgttaaacacactattttaaagatgaccctaaggtggaaaaaactggaaggaaggggcatggcacataactcaggggtccccccaacacgtaccctgaaccttaatggccttccccagaactctaacactcagacatcactttccccaggaaagacctgtatgcaaagccctgctgtgtgacttagaccaagcatatgccctctctgtgcctctacttcctcttctgaaaatgggatgttggggtattacaggaagatgatattttgcagagtactttcaaagaatcttcagttagcttgccacggcatggaaaaagtatgctgttatcatttctgcctgccttctggggaatttaggctgcccattaccctactccccattctcttatccttaaatctctctctctcacttactctctctctctgtctctcctggttccttcccatcagcatttaaactggctctctaaattctttcatcttacaagtaagatcccacttccctctccaagtactgtctcgtctttcctctttccacagccaaactcacgccaagagttgtccccattccctgcctctccttccctggctctcactcatccctcttccttgcaatctggcatccgcctccaccactcccctgaaaagcctttaaatgctaaacacacccgtgacctctaagatgctcaatccacaggacacgtttgagccctgatctgacttgtcttctcactgcatttggacattcagccgcctgtcctctctcggcatcagggatttccagccttcctggatttctgcaggctgcatgttcatggctggctctcagcttcctctgcccactttccacactgcccaactttggatgctggagttgctcaaggctcagttctgggtcctttgctttctcatgtctctctctgcctcctcagttgtatatccttctctgctgattgccgttactaccaatatggccacgaatcccaaatccacatctccagcccagattctccaattccagactcatggatccatcttcatgtcttccgagaagctcagattcaaaactgacctcaggataaactctttgctatggtctaaatgtggtgtctctcaaatattcatgtgttggaacctaatccccagtgtaatagtattaagagatggggcctttgggaagtgattaaatcatgagggctccaccttcacaaatgggattagtgcccttgggagctggcttgcccctttcaccacgtgaggatggagaaggtaccatctctggcgagcaggccctcaccagacactgaatctgctggcatcttgatcttggatttccagcctccagaactgtgagcaatgaatttcttttgtttataaattacccaggctaaggtattttgttgtagcaacagaaatggactaagacactcttcttccccatgttccctacctcagccactcttaccagaactctgtgagtcttcctttatatcttcctcccctctctcctgcctgcctcaaatccgcctccatttgctcattctcctcctgaagatccctcctgtctcaattctctgctgctaccacctttgtctgagcacctgcatctcaaccagacagtgaaacccccagaccccaccatgtgctctctggtcctcttccatatattcttctcataggagcacagtattcttaaaaaacttggagtgtgacagtctaacatatcattctcctgctccaaacctctcacgatttcacatcttccaagccccaaattctcaccacgttcacaagaccctgaggtctggctcccgtggctctctcctgtgcccctctttcctcactttcattgctctctgcccttcagtcactccagcctgccttcattgccttggatgtgcacattttttgcctcttgactctttttttttttttcacatgctgtttcctctgcctggggcactcttgctgcttcttcacctagctaacttccactcaccctggaagacttgacttaaatttcaagcctccagaaagccatcccccagggggatgtcctccttcccattatttgtcacagcataacacttacatttcctgctagaatgtatatcccttgaagtgactacaatatgaagtgactgcaatacacttgctcaatgaatacaactgatggagttcagggtagttaaacaacttgcttgaggtcgcacagctcattagcagcaggtctcatcttaaacccttttagactatttttcatgcctctgccatggggcaccaccacacacaaattcttatcaaaacagtaaccacactttattgtagctgtgtgttcaatggcccgtcttccccactaagcagtaagcttctaaagcagaggccatgctgtcttgtttattcttgtgtccctcacttttagctatgcgtctggagtgttctggggatggagaactatgaatgcttgttgatggactctctggtgatgagtcccccagatttgtttccaggtctgacttcctaacaagcaccaatcttattcattagcccagctatggattgtgtttcctttgaattttcattcaaagttaactctttggaagtaacttttattaaaaaaagaacaaatcagtgaataatggagggaagcacacaggaaataagacaaaaagcgtaaaacacaagatgctagaaaaggttgaggcacagaagttcagctccatatagaatctgtgccaaggccggatgcggtggctcacgcctgtaatcccagcactctgggaggccaaggcaggtggatcatctgaggtcaggagttcaagacctgtctggccaagatggtgaaacccatctctactaaaaatacaaaaatagccaagcccctgtaatcccagctactcaggaggctgaggcaggagaacccttgaacctgggagtgggaggttgcagtgagccaagatctcaccactgcactccagcctggttgacaagagagagactccatcaaacaaaaaaaaaaaaaaaaaaaaagaatctgtgccaagttatccacaagtcactgtcccccacccaattctgcccttttggttcttgagccaatctcccacctgcgactcccaaccctcctaccccattctctgagctcagtcctggttaggtgatacttcctactctttggaaggcttctttgggcaaactcacttcctattcatgccctagttggcaaatctgggaaaatacttctaaaaggcttggggtctgtcttagtctgttttgtgttgctgtaacagaataccacagactggataatttgttttaaaaagaaacttatttttcacagttctggaggatggtaagtccaataccagggtgccagtatctcttgaggccctcttgctgcgtcatcccatactggaaagcaagaggttgaaagaggccaagagagattgaacttgaagcctcaagcccttatataataagcatgaatccatttatgagggcagagcactcatgacctaaacacctcccattaggccccatttcccaacactattgcattggggactaaatttccaagacatgctttttgggggacacatgtaaaccatagcacatcaatgatggggaaacaaaggcccagtgagagttagaaatggacaatggagttctgtgtttatcccacagacatgggttatgctagtgctggctgagcctgtctgcactttcccccagagagctatgtgaccttgactgggctatttacacccctctggatatggaaggagaggagcagagggctcgaggctggactgctggggagtgagggtggtggcggctgaactgactgggaaggaagctggcaagactgaggctgaactcaggaggaagggcgggacaagggggccaaggctggacaagaacagcaggttcttgtcaaacacacagtttaattctgaggctgtattccttgtgcctgggagattttcagcttgcaatagtgtcatttacagatggatttgcagcggcgaattacaagtttgtaagcaacagcttctctgacgccttgaagaaaaaaaagccttatccctctgcaaattataaattcataactaacagtgttatccaactgaatgcaaaacaaattcattaccaactacattattccattgaataccaagtgaatgaacttcacagggctttgtgcagatcggggacatgttgggagatgggaacgaaacagcactcccccacttgcctctcctttgtgtcctttcaggcccagaaggtgggcagaactggacagatgtacactgcttgaattaaaaggtcactcgaagttatgatggcgatggtggcgatggtgatgatgatggtgctggtggtgtaccaaaaccaatgaccacactgcgattgtgtgtgtacctcttatatgattattaggattgctgtggtgacatcttaagacactatcttgtgaaggcttacatgcctaagtccctgtgactcgcaggacacccctgaaaagggggatcacctcctgtcgttcaccatgcaggaagatgtgggtcctctgagcttctcatcagagtgagaagatggggctaaatttaggcattcgagcagggattccctgtgtctcctcaggacgttgctctcttgggatcaggcttcaaagtgctgagacatctagatagaagcttctgggtgctgggtatcaagacagtgcccacagtgtgcaaacagcctggggtctatgggagaggacataggccacattttgtaacccagattcttcacttccctctgactttatgatgtattccccatttgtggtccctgatatttactatttttcttttctgtctcttttagaaaattagaagatacaaataaaactaacaaatatataagtcatccctaattttttttccaccagaaagaaccactttggggtggatcagacctgaaacttggccccttttccaattctcacagaaaaatccttcattcagaaactctgagcattcagtagacttgactgaaaatttgatatgggggaaaagaagaaatggttcatactgtagccacacaaacaactttaattatttatttatattttttgtagagacgggggtctcattatgtttcccaggctagtcttgaactctttgtctaaagcaatcctccctcctcggcctcccaaagtggtgagattacaggcgtgagctctggggcccggccacaaaagcaactttggagaaagagcaatgatctgggaaattaaaaggccttcccccactccccacctcactaggcatttttcttggcatctgcaccatctcctccatgctaacttctttggctctcccttctcctctgatcatctcacctttctctgccatcttcctcaggagcaaaaggaattcctctccttgtctcatgctgagtggtttgcaatcactgtatgtctagatagtttaccaaagttttttttttttcccaaagacagttttccatctaagaagaattttgatgccaggtgtgaaaatattttcatcttgtttcgtgaagacattacacttttagaactagaggataattttataaatgctgatatgaaacctgcttttgcttataacaatatagagtcagcatatttttatgtcaataggcaaatctatattttctgttttaatggctgcatattaatccatatagtttctttaaacaatctctttttttgctatacatttaggctgtttccaatgattgttattataacatccacacatcatctttgcaaatttatctaattattgccttatgataacttcttagaagtaagatttctgagaatgcacttttcaaagatttttcttgtattgttcagctactcttcaggaagttcgtgccagtttatactctcatcagttgtttaatattattgtcccacttactatgaatgctctagctctatctcagctgtgccttgaggtgttaaagaaagagctcctagggccagtttggtggcaacagtagccaattagtgtgagattatccaaaggatacagaatcccagggagcaagaatgggggccgtgaggtccagctgtttcactctatgtaggttcttttatggcctctcttgaaggatttgaaattgattgcttgattgattttatgaaggaacacattatttccctccaaatgatggtggtggcgatgagtgcatggtcatgatgataccaatgtgtggtcatgacagtgtgatattgatgagggtatggacaatggtagtaacaggttaacagtggttctgacggtgagtgcagtgccaatgatggagatggtggtggtgctggtgttgacaataggatggcagttatggtggtggtagtggtgacaatgttggtgatgatgacttatgatggtggtaagaatggtgatggtaactgtggtggtaatagtgagttcagcactgataagggagatggtggtggtggtactgacagtagggtggtaggaatggtggttgtggtcacagctatgttgtgatggtggttaagaaggtggtgagaatggtgttgacagttggtgatggtagaaatggtggtgtggcattgactgtgggatggtggtgacaatggtgagaagatgtgacagtggtgaggggcagcgtgatagaagggggatggtggtggttcacgatagtggtgagtggagttggtgctgatgggaagcctggtgctgatggtagtgctggggtgttgtggaaacagaaaggtgaaagtgcatagatgatggtgaaggaatgcaatacaggattaaaatagatacaaagggagagagaggttgtcttaggaatgtgaataaaggaagcagcatattctagacctagaacagtgaggagacccactggccagaggggatggtgggggagacgtgcagcaggagtgggtgctgggaagagtcctggaagtagtgagaagaatgtggactccaggagggcagcacggggaggcattctgggtcctgggagggataggtcagagccgattggcctgctagagaagaaaagtggatgaggagccagctgttggccctcatgctggcctcaaatggaggcagaaggtaggctaggccctctccagtgcaggcaagtgtcccaggcatgctggcagcatggaggaagcgggtgtgaagggccttcagtagctgagccaaccttagaatgcatgggcatggggagaggtaaaataccctgtgctcttgtaccagctgtacctggcagctcctactctcacctttgcttgagagggagaagggtctgaagcagggacccagagctccagctcccttctctcccccggctccctgcctctcaacagctccctgaatctccagtaggcagtttttgttcactagaattgcctggattcagagctccttccccacctttccaggtatagcatgaagctgtttggtgtgtatacaaagctgcaggattcactcttccggggcacagatgcctgagaaacttcagagaggcagaaggcgtgagtctgagcagccatcatctgggcatcaaggggttaacccatccctgagggctgggccaggtcttttcctcggactgggccccgccctccggttcctccatagaagccactggagtcaactaggagctcactttgtgggagggagaaacgtttttttctcttatttgaatggtgctggtgacctcacaaggtttccatggtgacaagaccaagggagccagggggccttggtgaattaggccaaacaaacccacctccaagagtcttctcccagactccagccttgaggatgaggactccaggtaatcagtgagcttgctgaagagggaaggttgggggctggggacatgccaggccaggacctgcaacagaaaccgccgccccacctttcctttctgtgccccaccccatcctgcctaaaaagttgctttccatgagggcttggtgctgagtgtggcccccacagggatgtctgtgtggtcacagagtacctgtgggagggcaattctgaccccaaggtaggaagcagtgatccggtaattccaggcaccaaggcagataaaaagaccaaggtaggtgaacagcagagtagaggcctgggtgtgaaaggagaaagccatgagcatctggttgggagtgggagccctgctctctgaagcttgactttctcaggagcagctgggggctggagcttgggaacacaggatcatgggatccaagtgaccagggtttgaaaccaggcataaataatgcctgcactctatggttgtggcctacatgggacatcacagggaaagcaccgagtaggtgctcaatatgtgtttgtttcctccctccttcccttcctctcctctccaccactcaacagccacagcctcctcaagaagtttgaagtctgcattgaactcattaatttccagcttttggccgggcgtggtggctcatgactataattccagcactttaggaggccaaggtgggcggatcacctgaggtcaggagtttgtgaccagcctcacctacatggtaaagcctcgtctctataaaaatacaaaaattaggcgggcatggtggtggccacctgttatcccagattcttgggaggctgaggcatgagaattgcttgaacttgggaggtggatgttgcagtgagtggagaacatgccactgtgctccagccagggcaacagagcgagactccgtctcaaaaagaaaaaaaaattccagctttcaattatttgatcctcacataattcaatgtctaaaatattgtactcctacatattgtcctaaaattctaccatggaagctccaaccattgctttgcatgaaatctccttgtaaatggcaacatcttatctggaagtaattgtcttttccctggacaggggcagttgtatgagtgggtggggagcaaatggggtggggtggggtgggagggtagacggggggaatgagtgatgtcttgtttgtttgatttttgttttttctttttctttttctttcttctcttctcttctctcctttcctcttctctcctctcctctcctcctctcttctcttcttctcttttcttctcatgcagatggggcccatgagtgaggaggacaagagagaaaggagaagtttgggtgtaaatcccagagattgttcatcatgtgagaggagccgtgcatgcatttcatgccatactcacaccatggatggagaaaaaaaatcaagcttcactttctgagaatggccctgggggcactgcatctagtgcctgtgcatctgcagacctgccggatgcctccaggggaatcatgccaccccaagcaagaaagggcccagttgccaggagcctggaggcagagagctgaggagccagcccctgacatcagaatggagctcaaaggttggctgggtgtgactctgccgtggacagcttctcttgggaaatctactttaatgaatccaggggaccaatttgtaatcagcccatcagatgttcagcgacacttagctggaatctcgttgctggactctgtgccccgcagtggatgacagttctccatcagggtctgcagtcctctaccctggacttgctgcatcctggagcccccagcagtcaggtaccggctctcagaactgcctgcatcccattggcctgagctgctgtctgccagggctgctggtaaccaggcccacagggttggatattcccccaacagggcagctcccagtccaagcccaactgttaccagcccagaaagatgtttcaggatacccctttcctccccacttccctgccctctgcagctccagctggtgcaccccatctttctctccccctccctgctaggctgggccctaacaggagacctttgaggtggttgggcttgttctgcaaccttgagtacccttgagctactgcctcactcctcagttttcttcttcttaaggtttctaattggactttgccagtgtatttatttcaaaactggtcatcttactgacctcgctcatagtctcttattacttttctagttgattctcttgagttttctggataaacaataatatcatgtacaaataatgatgacaatttctcctcctttccaaatgttgtgtttccttttgtgtattaatgtactcttgccttggctaaaacttccaaaacaatgtaaaataattgtgttaatagcaggctttctcattctaccctgactaaaatatgaatgaccctggctaggtgttttattgctaagaatgatgttgacggttggttgcagataggttttttttattattattatgccaaggaaatgttcttttatttttattttactaagggttttcagcagaatggatattcagttctgtcaaatgagtttttgatgtcagttaagatgatcacaaaactatttcctttctggtaattgacatgattaattataggggtggattttctgatatgtaaacgtcatcacttctaatgtagacatctttgaattgcggaagagatccattgccagggagaatctgtattggttggatctgtattgtgctgagtcccatgaatgtgaactcataacttttcccgcatcaccccctaatccaggatggcctgtcaggcaggagcactgtgacgcctaagggcttgagctggggctctggagagctggatggggtgtcagcttgtcccagggtgatctttctaaaggccagtccaatcacatgactccctttagtggctccccattgccttcagcaggaaactcgagcttctgtgtgcattttccaggcctcttacaactggcctctgtccacaccacttatcacctccaatctctcacctagaaccatataggaccagaactcctggaaggaggctcccccacatctcctatgcctccggccctctcacttggctgctctcctgcctggaatgtcctttccaccttccttcccaggcaggacttatcagtccctgctcttccgaccccacaaagctcagttactgcgtcattgctacttaccagggggaggttagtttctatgttcacctctatctctagaagccccaggaggttgaggacctgcctgatccaccccatctcatctcccagcccagtgtctgccccatcacaaatgttgctcaatcagccctaggtcaaacattttgttcacactcatggaccccctacttgacccaccgcctgtgacctgcagggttcgctgtcccagtggtgggcactgagaggccccagtcgcaggcctcacaggtggctgcagctccctggagcctctttagaaaatgcagtcggccttgtttcctcctcagaaacaacgacttagcacagcatccgggccccaggggagagtgttcccccctcaaaagctgctgccattggagatgcaggagaggaagccaagtgggcccaggagggaccggatgattcggggtagatgggagggagtgagcaggaggggctctgataggctgcatccctggggtttcctgcacatcccagatgctggcacctgctctgggcctgggccggcaatagctctgtgtctggctctccaccgggccttgggtgcatcccctgattcccccagggtcttctcacccgactctccatgggatccattttcaactctctgtgttccctcaactactaggcagccagctagagtcctcacctcttcagaaaagctgatactagttaagcatcccaagtctgaaaatctgaaacctgcaatactccagaatttgaaactttttgagcgtggacatgatgctcaaaggaaacgctcatcagagcatttcagatttgggatttggagatttgggatgcttaaccagtaactatttgtaaatattccaaaatctgaaaaaaaaatccccaatcggaaacacttatgatcctaagcattttggataagggatgttcaacctgtatcaaatggagggctgcttggctgctaagcctggggtgggacaggagcagcccagacctgccccttcttttttgccaagcaatcctgagttacacaacacattcctggctactatataataagaggttaggtgacatgacttcaagggcatcggagttgggttgtggagtctggcagacccgggttcaagttctagctccacctcttgctaactgtgtgattttgggcaagttacttagcctctctgagacccaatttcttcatctgtggaacagagtacctacctatggaggtgttgtgaggattacatgaaatgactgactgactataaagcacttaacacagtgcctggcacgtagtcggagttcaatgtacattagctgttttataagttacaggtcagcacaggctgggccatagctgtcgcttcatacacctttgtcccccatgcatgggtggagaaactgaggcccagagaggagcgggacatcacatcgctgcatccccttcatcagcctgggctgacacctactgaggagctctctgctgtaatggtttcaatcacaacaaacctgacgcatggagtcttagatcttgggcttgccttctgcacagcctggcaccctcttgtttaagaaacctttacattgcactaaatgccaggaacagttataagccctttatacgtataataacaatattatgcatattaaccttaatccttctagcaaacccatgagagagatactatcattatccccattttacagatgagggaatggaacagttcgagggcttgcccaaggtcacacggctagcaagtgggaggaccactattcaccagcagggatgccatcgacaaggtttccaccctgaggtgaacatagcctgggctctgtggtgtgatcatcgcggggtgatctggggtgtctggggcacctgaagcctgtcttctccctgcaccctgatgctcgggtggaggaggcattttggaggggacttggtggcctgtgactgggcacagcgggagcatctgctttgtcctattaatgctattcactagatgccacatctcaggccacagcaggtatttccctcgagagaggacagtgaaaacttggaacagaagagctttttattattcagaataactgcactatttaatttactattaataatagctcttgagtcaaccttctcctgaagagaagtgagaactgaaaggatgtccctctcttctctcccctcctccctccttttctgcctccttacttcggaatgctgtgaactcagtcacgaatgattgagctgttttgggggtaggagtgggagaaatggaggcccagctcatgcagcgagcctggttactcctcctccctgcagagccttgctctgctgctcctcgggggtccctggaggccatgacccatctgttgtcagatccctccgggaaagaggatgacctgtcctcctaggctgggctggaggctagaggccaggaggctgtttcagctgcagcaaagggaaggctgcatccagcaatccttgccctccttgtcctgagggcaggagtgtgtgtgctgaaataagaagatggggatcccgtcagagacccatcttctgccctctgcatccagcgaagggctcagcgttaagaaggagcacgtccagagaggactacagccaggaatgagacttgaacccaagccaggggaggaggatttggtttggagttcagaagagttgggggactgagaactgctttcaaagaacctgagggatttggttcttcatctacaagccctcactgagggcctgctcttccaggtgctgggaacatgtgaagcccccagaggggcagaggcaatgagatataactaatgctactgtaaggcagtgctccaaggacaggaccaccatgtccggtgaagtcctaggaggtgaggacttggcttgcctcattcagagctaaatgggcctcctggctccctgaggcaaaggatatagatggtcttctagggttgactttatcccttgggcatttattcaagacgtcaggcacgctcccggcatctacatccttgactctgcctcctgtattggggccctgtgggatctcaggtgtgtcaggtggcccactggggctgaccttccagaagatagaggcctgtttctctctttctcctaactacccaactgtgcagagctagaggacagtggctgtccccacaaaggtctctcacggctgcagaccagcaccccgtccacctcctctcacccctgggacatagccaaccagcctgctctcctcttgtcaatctcctcacaccctgcccatctgtagagtgggctgaatcctagatatccttaggtgattgaagagtgctttctaacactctggtgcggggtggtttcggtctggctttccgaacgtgccagagctgggttccacatacctgcatgcacatacactcctaagcacacacgctgcctccacgcatcccggctttcattgtgagggccccactctttattcaaggagcggtctcgggtgtctgaatggatgcttgaaggctccgtctttgcaattaacacgctgctgcagtattattagcctctgataggcaggtctgcctttgccagaaactataaatatgtggggccaatgactcagcaaatctgttgctatttttcttgcaggtccgtgtggatctgtatctgtgtacaccatggccccatctcccagcagctcccatggcttgtatccatggaaacgcagtcctccccaactatggttctctgctgacaaaacctgggagtctccccagccccctacccacctcggaaaaggagcgtggaccacacaggctccagccagcaggagggcggcactgtggaggaggtggccactttctcagttgctttgaagggccaggcaaggccaggcctccaagaccttcctccgcgggtctgtggtcaaggccttgtcacctgcttaaggggagcggcctgttgagagagccatcactgaggccctgggccctggtgggattcagttggcagggcagtccctgagggctgtgggcagtgcggcaggggagggggggggaggggttactgccctcacgagtggggagcactagcacttgggagagggaggctgaggagtagggagagggccagtggcagtgaggtgggggaaggggatgtgcaatgtgggatgaaatcttggagccttggccgggcaccgtggctcatgcctataatcccagcactttgggaggctgaggtgggcagatcacctgaggtcgggagttcgagaccagccagaccaacatgaagaaactccgtctctactaaaaatacaaaaaaattagccaggcgtggtggcacatacctgtaatcccagctacttgggaggctgaggcaggagaatcgcttgaacctgggaggcagaggttgtggtgagccgagatcgtgccattgcactgcagcctgggcaacaacagagaaactccatctcaaaaaacaaacaaacaaacaaacaaacaaaaaacaaatcttagagccttggctgtgtcaaataagctgtgggatagaagaaagagcatggccttggagtccctccctctgtccctcctttccttccacaaacattcgcatttgcttcttctggaccagactctatgctggatgtgaagacccagaaatgtttcagaattagactctttctcctcaacgacccacagtctcgggagagaagacagattcttcatcaagtcagagagctcaggggtcctgaaggtcaggatggttgtctgtatcagagcagtggggcacaggagggtggtcagagaggcctcctagggagctgcagcccagggggcaggccaggaagatgaggcagtgtgtgggacgactggcaggaggcaagagagggcagtgccgggagccagtgggtgagagactcgcgcactagagttctaactctggctcctgttggcggtgctccctggagaaagccacctaaggtctctggtgtgtaaaatgggaaatggcaatacctaccttatgggccaggatggaggattaaataaaacatctggcccctcatgcagcatttattgtattcattctatgccggggctgtcccatgccttttgctttcctccctacagggtctctgtcacttcgtctgtcaaatgagggagctgggccagatgatgtctagagcctctgacattccctgtcctcagtttccccgtttttgaaataggaagaagaatcttccaacacgctccagaagtgaaggaatggatcgtggaatcaacagatatttactaagagtagcttgggacagggcgcagtgactcatgcctgtaatccaagcactttgggaggccaaggtgggaggattgcttgagccctggagttcgagatcagcctgggcaacagcaatcaaaaaatcaaaacgccgggtgtggtggcatgtgcctgtaatcctagctactcgggaggctgaggtgggagggtgcttgagcctgggaggtcaaggatgcagtgaccccagtgagccatgattgcactactactgcactccagcctgggtgacagagcaagaccctgtatgttcaaaaaaagaaaatataaaaaaaagagaaaaagaaaaaagcagcttgcttttccccagcttagggaaagcagaacccagacagatatcaccactgctacctccatgggatgtggaggagcaggacacccagcactcccaatgtggctggagaggcccagtgtggtctgcagccatggagcagtgactctgggtgtctcgtgtcgctgctctgctgctttctctcttcctgtgtcttgtctgtcttgggtaaggaaggacttgctcaaggccctgggatctgatttctaaggaccatcttgcccaccagggacctccagacccttaaatccttgtactcaaagccctagggaagctgaggatcaggctgaggatctgaaattattaacaccgctttgtcatatcatagtggagtctcacactgagcctctgaggtaacccctattgctatctccattttgcaggtgaggaaactggggctcagagattttagggactggctcaaggtcacccagatgcaatggcaggaccaggatttcaatctaggtcagcatgactccagccccatgttctttctggggctctgtacccaccctctggaactctggtaaacctcctgaatccatcgggaaagtaaaggagatataaatagcacgtgggattgtgaagtgaaaaaagcaagttgcagaacaatacctgcaggattattgcagtcatgtaaaagaactacttgaaatgatgcgtctatataatgagataaatgcacagaagcaggtctggagggagatctatccagggttgaatggtattcccctctgggtagggttcaacatatttcagaattggttaagtttttattacaatgagaatgtatttatgtactacttgtgcaataacaacctccctctcccataaggcaggagatggggtgacccacctccttatgacatgagccatgtaaaggctggggcaggtggagacctgcaggggaatgtaggctcatgggaaccttggagacagaatggcagttttatgtcagaactctttgtgtgtttttcttgtcttttaacagcctggagagaaactccttcagtcattttacagtgaggaacccttggctgggtgcagtggctcatgcctgtaatcccagcattttgggaggctgaggtgggtgtatcatttgaggtcaggagttcaagaccagcatggccagcaaggtgaaactgcctctcctgggcgtggtgacatatgcctgtaataccagttactcgggaggctgagcaagagaatcgcttgaacccaggaggcggaggttgcagtgagccgagatctcaccactgcactctagcctggggaacagagtgagattctgtctcaaaaaataaataaataaaaaagaaagacagaaagaaagaagaaaaaaaggaaggaaggaaggaaggaaggaaggaagaaagaaagaaagaaagaaagaaagaaagaaagaaaaagaaagaaagaaagaaagaaagaaagaaggaaagaaagaaaaagaaagagagagagaaaggaacccttaaatctagatagcctcagcccaaggtcagagagctttgttgccacggattggttggttagtaacttgctttatgttgaagacaggcctggctttgactttatacagttacttgcagattctttgaacctcagttttcctacctgtaaaatgggattgatatagctactttgaagagtgttcgtgaggattcagcaagatcaagtttgctaagtggccatcaccggacaggggctgttttcaacatcattccccaaccctcttttctgttccctttgtctaaggaatgccattctagactcagcatggtgcagatgagacataggctttggcctgaattggggcttggccacgtcaattattggcatctaacattgaggacatattagatgtcaggaatcatgctaagggccatacatacaactcccttaatccaaatcttgctgcctacctcagaggtgggcaccacctattattatccccactttacagatgtgggaattgagatatcaacatcaccctggcctcataaaatgacttaggaagaatttcctctttttctgttatctggaggagtttgcataataaggtttgtttatttacacttaaatattcacaagaattcaccaggagaatcatctgggcctggagttttctctgtgaaaagagttttgactataaattcaatttctttaggagttctagaagcagtcctgttcctctgcccatgcctcctccttaatcctcagctcccaaatctgagtcctggaggaggtgattataattgcaggccctgcaaggtacccccagttttatttaccccccatgtggacactctggccttgactctcctccttattgaatggcagggcagagtggggtgggggaggaggcagaatgccaagaatgagatccgactttgctatcttggctccaagcttgcacctctccctgctctggtaagctgtaaggagcaaggcctgtggctggaggacccatccctgaggccaaccttctgggactgttcctgaggatccactatgcaaggtgcactgggccctgtgacagcttagcagagcagagctgctccacctggcattgggatctctaggagaagctcggtaaacctagaatgaatgaatgagcaagttaacaatgacttcctgaatgactggaacacctgctctaggtacccagcttagaaaggttaaaaagacacttcatctggtgcaaggcagacacatggacacatggtccatgacatctttggtgacaaatgctgtgctacgggtggcatagggtactgtaggggtacaagggaaaatgtctgacccatcctgggggtgggtgatgggggtggcaggggctttttggaagaggggacacaggctgagtcttgaaagacactaggagttagtcaggaggctggtggaactgggagagagcatggggtaagaaaagcagggcacttccacagaaggggaagacactgcatggtccctgagctcggtctattagagaagctactggtcactcaaaagtcagcctcatttccaggccatttattgctccaaaggatcctggactcacagtgcattggaagctcagtgttctgacctttcctgccaatatcaaggtcaggggaaagagatccctttctacccgagctcagcatttctaactggaggagggtgataaaacaattaaggatgcatctgacagtgagtaagagagaacctaataaatagtgtcctaactgtttattagggtgcagtgggggtgaggagggtatttattccatataaaaagaaattcagggatgggcagtctggggccaccaggccgtcaaggctccaggctcctctcattgtcccttccaccaaccttagtgtgaaagcctttgtcttcatgcttgttgcctcataattgcaagatggctgcagcaactccacacctagatccaacttccaggcagaaagaagatggaaaggctgaggggaatgccagttctgtaccttctagaaagaatgtcctgaagccctacccggtgacttcactcctatctcattgaccagaagtgggtcccgtggccatctctaggccagtcactggaaggtggctggggaaaaaggggtgtggagaggcttgggccaaccagccaggagcatctgctacaggtggtcacccaccccagaaagcacagccctcagccccctagctgtgagagccagcagaggcaggggggaagctggccactccagaaaggtctcgcttcaacagtcattcaacaaatgctaaccattgcccccactgtgcccagcaacttgggccctggagcccagtagaggaagtgagctttcaacacaaggccaggcagaaaggagagccagaccccaaagcagagagcccctctctgggtgggagcatcagagggtcccaagcctgccaaggcctttccttgcctttgaagaaaaggagattaaataggaccagcctcaaaaccccagcagaaaggacctggcctctttatctgactgactgatgaagtggcttcctctgggggttgaaggaaggtatgcagataagtgtgagtagtagttacgccacgatcattcaggaagaattggggtggtgtgggggcggggagaggtcactgctgtgccatcaatgtcagcctcacacagtgttgcagagcccaggctcatcccctactcctcccatttcactgatgtaatctgacatagccttcccccttggaggcctgagcccaggaagttaccttatgttaccgcccagcaaggtcgctcaggccttcttgagcttgccccgtgattctgccaaccaatttcagacagagcagatcactctgggtctagtaggaaatgcccaggtctgggcatcagaaggcctgtgtgaccttggaccagtcagccaacctctctgagcctttactgacaccttgtggcagcttctgcccaaaaccaaagtgcttgggtgaaaataaaaacctgtatttcccttccactactcccctgccactatgctctggtctgagtcacatcactgcagaaggatagccttccaacacacctccccatcccacctctctaggccactgtcctgaaagaatcagtgaaaaggcttcccagggaagcagttacggctcagtcctccagtctccagttgcaggtctcagaactcagtcctgcacagtactagtactttcatcagctccaggatgaggatatggtggacacgtgcttatcacatgatgtcagaaaatctccagaggccaggcattggtggcttatgcctgtaagctttgggaggccaaggtgggaggagtgcttgaggccaggagttcaagaccagccttgaacaacatggtgagatgagaccccatctctacaaaaaatttaaaaattagctaggcatagtggcacatgcctgtagtcctagttacttgggagaatcgcctgagccccagaggttgagtctgcagtgagctgtgaacatgccactgcacttcagcctgggtgacagagcgagaccccgtctcaaaaaaaaaaaaaaaaaaaaagaaagaaagaaaagaaaatcttcagaagggaaaagtaagtccacagcctctcctagattactgcttggtcatgtgtttgtgtgtgtgtgtctgtgcacatgtgcgctcacatctgtgtacacaaacacctgtgtgtgttttgtcatggacctggggaacttcctaccaggctcctgcaatggaatggtttcaaccgaagctctagctgggacagggcccctcgtttttggcttttgagatgaacgccccaacctagttagttatcagtgctcggttttcttggcttcctttcctgccccatctatatcctctgtcttccaatcccaccatccaaacctgctccaaaccagaggtttaaatgaatctaataaaaccactcctagaggcagctgttcatggctaataagggtgcccagagtggatggataggttgggaagggccttccaggcctagcgccaaacattattggtagaatttcaaaccaggtctctgtggctaaaactttgtctcttccaggctactggtctgacccactggcacagggaagcagttttgggtatgagggaaaagctgtcctgagctctccacacctccacccagccatctgggaattctggggtagggtatgatctgtggatgtggcttggggacttggcgtggacctgcagtggttggctggctccactccatcaagaagattaagaggtaattgagcagctgttctggatgagggagttgctgcttgaaagttggaggttggcctgaaaccctcccattaaatgtgcttgtccctgggattcaagagctctcttcaaaaggcagggagcccatccaggccctcctatggctggaagaaaccagtagcaacccagagcatatggggaaactgaggatcagagaggagtagctgactcccattttaccaggttgagtgtcatggcagcctgctgcctgaggttgggtggtatggccaaaggtggttctgggccagaatccttcctgctgggctccaggaacctcctctcctgttggttaagagccaggagtgcaggcttttggagccaggggctagaccaccctcctggcactgctatattccagctccttctccccaccctacaacactgtccctaacgcatttttccattacttttgtgctctgaaacattcgatggctccctatcacctccaggatctgctgcaacattccctgctggcccctccccgcatcaccagcctcactctgtctggactgcctgctactcttagcacccacctgccctctgccctctcctccatctccactgtggccttcctgccatcttcccatcccttaaaagccatttctccaggaagccttcctgtctccactccgtaattggggcaagctacttaacctttccaagcttcagatggcacctctgggaaaaaatgagggaataacaagatgctgcctccaaagggttgtcgtgaggctgtcaccaatgaaataatgcatacccagggcacatcacagtacctcttgtacaatgaggactccaacaaaggatgctgggtcaatttcatcatcatcattgatatgttatggctatctcatcgtgaattgtaggtcccataatccccatgtgtcatgggaaggaccaggtggagataattgaatcgtggggcacagtttcccccatcctgttctcatgatagtgagttagttctcataagatctgatggtttttataagaggcttcctcctttactgggcactgattcttctttctcctgatgccatgtgaaggacatgtttgcttccccttctgccatgattgtaagtttcctgaggcctccccagccatgctgaactgtgagtaaattaaacctctttcctttataaattactcctttataaattacatctcagtacatgtaatgtacatctgtaacgtacatgtaatgtactgagtaatgtacatctcaggtacatctttattagcagcaggagaatggactgatacaatcatcatcatcaaccactcttcctcctcctttctgtggaataataaggggataataagagggactctgtggctccctcttctgagctgtcagagtacccttggtctctgtcctgtgctccatttaattagagaagcaatgtgtgggcatgcgcccctcccctcagactcctccatggctgggtcctgaacccctgaactccagggcccaggacaacagtgctcacacttttgaatctcaggacagcctgagttgctaggctttcttcctcagccctggagagcactaatggtgtctttcaaacctggtatcctggatgtgtgagcgtgattgggtgggggccagccctgggctgggctttgaccccctcctcgggcctgatgagagctctcattaccttccttccttgccagctaggccttggggtgaagccagccctcaacctttgatgggaggaaggcttaattaccccctcaggcagagggagaggataatgaggagcagatgaaaagcctgggaaggttgctccttccagaggcccccacctcttagcacccaggctgcccccggccccaccttcagcctctttgggcttaggttaaggccttgcaccctggtctgcagagggccccagcacccatggcccttgtgtgattcacagatcacagggattaccttggattctctctaccacagtgcctgaaatctcattagcacttcctattggggtcacaccaagcactcctacccaatctagaaagaatggttagaatttttcataccacactgggatcctgggacagtttggataaggaagccatacattaaggcctctggtttgtatgaaacctgaaatttgtgatggaatgggaagcaaaggacaaatttcacagaaggaagccagtggaaggggtcataggcctgcctcctcttggggcttggctggggatttgtggttgggacaacatggctgggcttggagactctcttccctccattgcagagcagctgaagggcttggtgtgttcttggctctcagtgggcaggcaggaggggaagaggaggtgtcaagtgtgtctgggcaacagtgacaaaagatgagggagagtagttgggcagacaagtaaagatcattcttgcagggcaggcccaggatcctgggttctttcttgtggggggcacggggtgatgtgggtagaactagggtgttttgtcttcttgttccccaactcctgggccatcccttggaaatgccactgtgctcagcccaacagggaaaccctgagggctctggccccacagctgcacacaggcttgcagggtgtttagcttgaatgccagtctgtcctccccggcgttgtagcaggactagccgcagacaaaacctctcagacaccaagatgtagaaggaagggctttattccgctgggagcattggcaagctactgccttaaaatccaagcttcccgaatgcacaatttctgtcccttttaagggctcacaacactaaagatttcacatgaaagggttgtgactgatttgagcaagcaggtggtatgtaacaggggctgcatgcaccgggggtcagagagaaacagaacagggcagggagtttcacaatgttcttctatacaatgtctggaatctatgaataacatcggtttctaagttatgagttgatttttaactactgggtttaggccaagcaggcccaggcctggtttcgggcctggcgccaggctacctgtctttggttttacctccttgttgttttttcttaaaacaggtactgagtataaaacaatataaaacaatatgagagggtctctctcttcgctcagcgtgggcacctctggagcaggacagtggagaggggcctgaggaaagtacttctgcctggactagcacctgccccggtcatggttccccaaactccccattagtgctagttcttcccaaagaggcatcagaggggcagggaggtgctgggggacactgtggtccatgctgccattgactgattttagggtcctgggccagttaatttactcttctaagacctagttgccccatctgtaaaatggggtttgtaacagtatctcaaggttgtagtgaggactaaaaaaacatagtgtatgtaaaatgctcagcataatgcctggcatggggcaaatgctcaccactgttaactgttattacagttattattaatcccgctgggcaacgtttctcaacctttttaaattccaggctcacttgtgataagcatacaaacctcatactcctcccagtaatagtataggatttaaaacatcaaggaaatagaaggttgaggcaaaaaacaaatcgaagcacttattatatagaacatgctttttcagatgagagagcacccctgcccccgcccccccaacacacatacacaattgaggctcactacaggggtgggagctgggaggactggcagccccctctgagaggcctcagggtggagggccaggagcacagggtggcctctggtgggtgcctctcctccctcgctggcccacagtggcctctggatcccagcccagcctcccagctctggcaacaagggctttgagggaacagaggaagctctttggaatacaaatatctttggatcctccggtctcagccggcgccctattctcatgctaatacggagagagtttgggggatgcttgaaggggaaattgccaactgtaggaaacccagcccaagcctggggccctggggacagggctagagcctctggggtcctttcccgtgtagcttcccagtacccagcactaagttccagccccatgccccaacagtcctggcacatcccctggcgggctgggtagattctacaactcagggtctatttgctggacaattgccccttccagttttccccatgcaaataataattcacttggcaaataataattcactagcggctgtttaccgcagccctccagtgccaggctttggggagatgctccgtgcatcttagttatctcatgtaaccctcactgtgcagcccatggaaatgaaactcaaagagagtggcaatttgccccagatctcgcaactgtggtgccaggatccaagtgcaggtgtgtgcaccccactggactcacagggctggtggctttggagacctcatgagccacaagatggcatcaggggggcctgggaggtgaggggcatggggtttggcacagcagcagtctaggccgtaggtactacaggcatagacaggacccgcatgtcaaaaaaggactcggttggtggctcaggtcaggcagacagtctccccaggtgctgagtctgagttctcagcccccaggccaggctggggcagaggagcagatggagatgggtaggcgttcttgagttgacctggaatttagaaaggtgatctgctgatggcttagggggtatgctgggggcaggctctggacctggacaatctttccctacttctcagcttggtcaatacctactcctccttcaaggcccaattcaaaccccagctcactggtggaggcttccctgactctcccaagctaacacctagctccatactcctctcttccccaacctctgtggcatcatttaggtgcggctctgcctcctgccctaggctgggaagtcctgagggaagaggccttgcctgattcatctccatgactccagtgcccagcatgggacctggcactcagcatggctcaggaaatgtttgcagaatgaatgagtgactctacaggatgaaggaggctgtgatcttcactcttgcagagtctccaacaaaaggaagccactgaaacctaagcaggagggtgctgcttagtatcattgatttctctgtgcccagcaccacatctcccctgctcttctctgatttccaccataattgtgtggatggttctggatggacttgggctcaccctgtgctggcccttttcccctcaagtgcaccaacgccaggaaaggcagtttgaccggtggatcaaagcaggctggaagtgcgggggagagaatacctccaggacagccctcaaccagcagggatgggagccagtgtgtagctgctccagcctcccgctttccagtggggagttctggagacagaggccccaccctccactaagggacccgtaagactgtcccgttaggttggccgtccctctttcctggtttgcgctcctgctccctcaagatggcaagctatgcagtagaaatttcgtgactgtggagtcttattctcactgggctctgaccctgattcctgaggcttccaagggttctctggaggtatgtaggaagctccagtggaagagagctattcagggaattatgtcctgaaattaaactccacggtccccaagggagggagagaatggggcatggtgacactggggtggggatgggagagagaagttgttgggggtttgatgggaaacccattttgccgtaatcgtattgtgcacattaaaaccacagctaccagagcaaaggggtgggggtggaggcagagcagaaaaatggctagaatgagctggcaggggagggcgtgtctgcagactcatttgggataaggggttgggggttagggatcccttggccagtcaaggacagccccacccacctcttgccaattggagtatagagaaggtggcaggcagagagtggaaactgggactctgctgcattgacacctgctaggtgccaggcacggcagtaggtgctttgctgaacgccactcatttataaactgctttacatgcaccaccacatttaacctttgcagtagaccttggagcttggcactattgctatcctaagttgctatgagggaactacacagagagggaagtgacttgctcaggatcccccagccgtttaacaaccccatgcaccacagctggatgagcaagatgtctgcagtgaagggacagaggaattgaggccaagctactggggaggggtggaaatgccattctggaggatctgtgacgttgacagagactttatcgacacaacaagccagctaacccctaacgaacgtgttgattcattcattcattccatcagttactccaacatgtgggactgcatggttgtgaaaacagaatatgaccttgtaaaaggagaagccttgggcccttgatgccaggtgggaggaggatggagagctctaagaggactggagatgccaagacggcttcttaaagaggtgtggaaggactgcggatggctgctttccctctttagatcctgctgtgggatgctagcacaaagtctggaaaatgcacctgactttgcctagagggcaataggtctcttcctgggggtgtcacgcaggagggtacctctcttgctagtcttgcccagagctcctgaggaagggtccctgtgacagctccttctctcccctgatcaagtggcctaggcttcaggtagcaggactggtgaactggttgggcagacatggctgtccttgcctaggccaatgtagtgccagccatggccttcccagaagccttagactacaggcagagctgcctcactctagctgtcctagctgctggatgcctgccaggtgtgtctctgaaggcctatcttccaagactcagagagtgaccactggaaaagacacatctggaccctgagatctccaataaacttcaagtgttccctcatcagcgtctcatgtggcataaacttcccaaatccttactgaggaggtcatgatctgtgcatatctctcaggagcccaacagcaactatctattcaacaaatattggtgctggcctttattctgaatgtagacttccatcggggctcagtgtgaggccagggtcaaggctcagtgtacgatcagggttggggcttggtctatgaccagagtcagggctcagtgtgtgcccagggtcaggagccactgcatggacagagtcacgactcagtctatgaatgcgatcagagttcagcctggagctgctgtcagagactaatcttttccaggccttgactttcctttagagcaagactacaggctcagggactgcctgctaagagcaaggtaaggcaaaacaggctgagttcaaatcctggcttaccacttgccaactcacctggagcaatatcctgatcctgcaaaccttgagttgcttacctgtaaatgaggacaaggggaggcacctgccttagttcattctgtgctgctgtaacagaattcttgagactgggtaacttaaaatgaagaagtatttattggttcatgattctggaggctgtggagtccaagatcaaggtgtcagcatctaataagggccttcttgctgtatcatcccatggtggaagcagagaaggcatgtgcacatggggaagtgggtggagcgtaaaagggggccaaacttgtccttttataaggaacccactcccaagataacaaacccgctcctatgataatgacattaatccattcatgagggcagagcccttatggcctaatcacctctcattagaccccaccactaaacattattgcattgggaattaagtttacaacacataccttttggggcacatatacaaaccatagcagtgcctcataggttgggaaggcttaacaggtgaaaaacacctagctctgaatgtggcacttagtgaatgctcaggaaatggcaaactctgctttatccattataaccatcatactagaggctcaggatctaaacactttacacctggttccagtcctgccctcctgattcaggtttgagtcagagagtcaaagggaccagtctccctgctcatccacggccaaggaagtcactgggtcctgggaaacttccctggagtcaggaaagcttgggatagggaagcctcttggggcaaaatctcacccctttgatgaccatcagcttttctcagaggcttcaagactctacctgcctgctgcttgtgctctctggtgggcagatgagccctgcagccctggtcccttcagtccccagatttgggatgaagaccccagtctcctagatgaagcttgtagcactccctcctgtctgccctactctgctccaagggccctttgctgtccaggctctgtgtgcctcttcctgccttctccagcagtcccatggcccacttcttagcctctcccatcacaaccctccaggattctttcattgtttttggcttcctctcccacccatctttcatttggatgtttcctaagaggacagaattctaaccaccagccagcccttcctgccccatccaacaaaacagataatctgttctccattttcccagaggagaaatgaaaacaagtggctgagattgcaacaggaattgagacgagttgcattggcatgggagagctgtgggaggcaggcatgagctggggatggggtgctcttttgggattctggtcactaatcttgagtggcgtagggacgttttgtcagaaacaaagaatgaactgagtaatctagaatccctgcttcctgtctgaggaccccagtcttatcagagaagcattatggattctcagctagaccactgggggcacatcccagccctgcatcttccaggctgagtggccttgggcatgtcactcaacatttctgggcttcagttttcttatctgtaaaatgggctgttgtgagaagtaaaggagcatggagcacatgttccatgtaattgttagctattattatctacagtagcagaccctaaacacttccagcagctcactcccagcagtaaaaaaagtaagtgtgggctgggcgcagtggctcacgcctgtaaatcccaacactttgagaggctgaggcaggcagatcatgaggtcaagagatcgagaccatcctggccaacatggtgaaaccccgtctctactaaaaatacaaaaattagccgggcgtggtggcatgcatctgtagtcccagctactcaggaggctgaggcagaagaatcgcttgaacccagcaggcagaggttgcagtgagccgagttcgcgccactacactccagcctggcaacagagtgagactcagtctcaaaaaaaaaaaaaaaaattaagcgtgtccctaatacatatcaatattaattcattcataaattatatgcatgtatttctgtgctaatatagtctatatgttataaaatatatacaatagtcatattaaaagtataagataaagaacaaaatataaatagaagctctaatagcttcttcccataccccagcggatcctcttatgcccccactggaggcaggaacagtactttggaaacctcttcatgtgccggtagcctgagtaaattgcagaaaagcttctgccagggccgatgtgagaggagaagctccagagcccccacgtgggagccagggagtgctaatgtgggtgattaaatcatttacaataatccatttggaacagcagccgtgtctaacatggggcgtgatgactgctccacaaatagaaaggtggccagggaggcagttggtgggacatattccaagggcatggggtaggcgcacagacttacccttgctactcactgtcttgctgcagttcacctgccagcctctgtgcctgcccagtgcaatggatcagtctgccccctccctgcataaatgtgcctgtcctcttctgcatctgaatcggtcccatctcttctaggaagcctcattgatggctcttttctttctctctctctctctcttttttttttgagatggagtcttgctctgttgcccaggctggagtgcagtggtgtgatcttggctcactgcaacctccgcctcctgggttcaagtgattctcctgcttcagcctcccgagtagctgggattacaggcacacaccaccaagcctggctaatttttgtatttttagtagagacacggtttcaatatgttggccaggctggtctcaaactcctgacctcaagtgatccgcccaccccctacctcaagtgatccgcccacctcagcctccaaaagtgctgggattacaggagtgagccaccacatctggcccctcagactactttttctacactgcaccaggctggtgctttgctccataccctcagtgtacttgacactgtggcctctttggcccttgatgaccaccttcccttaccaacctgactcccctcctgttgctctcctcttcactcattctgttccagccacactggcctccttgctgtgtctcaacaaatgctgagcacttccccacctctcggcctttgcactggctgttccctctgctggttacagcccctaagcccaggtgaccctcaaggtttactctatcatggcttttccatctcatctcagctgacgtctttcctgaccagctagtagaaaatagcaaaccacccccgtcactccttatttccttagcctgctttgatttttccatagcccttgtgtttaattgttctttttttttttttaactgtccacctctgccagctaacctgtaagctccataagattaggcctttgctttgtaaactgcagcatccccaggttctagaactgaacctgacacatggcaggtgttcaggaaacattggttgaatgaatgtgttccattgctatcccatgaggctgaatcctgtctctccctggcctaggcccataggagagaggctggagcttttcctcttccatctctcccgttggtcaactctccaatttagtggctggtccctcccatccggcattctccttcaccatatccatcacatgtttaattactttttgggaaggtgtctagcttccccatcacctaaccccctaattgctcaaaactaatttttttgggggtgaggatctaaacggtgctggataagagggaaccaggagggccgaggagccacccagacagccccttcaagatttccaagtcagttttgaaagagcagcaggcagttactttgctccctaattaccagcctcactgtggacatcctcagaagacacatctttcctaattgaaacagcagggtggattgcaggctctgggcagcctcctttgccttttctggcaggagccagaggcaggcaaaggtgtttcattaaaagagagctgtggaaagggagtggtcatggtgcccactgcctcctggaggcccacaatttagacgcacaatgaaacagcaaatatgacaacaaaagaatcaagtccctggtctgtctccccatctcagggcctgggcctcacctggcctctccttctcccatcaactctctcctgcatagccacagactccagccaagtggcaactctgctgagcacctgcccgagtggactttggcctcctgccatctgtgagcagggaggtgtagctcaggggtggtcccgggatcgtgggcagcccctctcctccctggaagagataaaatcttggcccaggccagccaagctcaaggtcttaaggcttattcagcttgctggagttgctgcttatggcggagcctactgagcctactgactgcattccctgtacctagtctcctccttttttctgagtaataagaacacttcagttttcctctaggtggcaagatgcccagctaaaagactacatttcccagtttcccttgcagctacatgtcaccagtgattttgtggggtggatttttaagcagatgttgtagggaggatttgggggaatatcccttcagggaaagacaggtagataacatgtgcccttttatttttcactatcctccttatttctgcttcttgcccagaatgtggatgtgatgaatggagctcaagtagccatcttgggcccacgaggatgacagccatatataagggatggtaggtcaaaagatagaaggaaagtagattcctgagcatcatggagctgccatacaaccttggacagcttaactccagacttcttttttggcagagaataaactgcaaatgtgcttttgccactatagttgagtttctgttattaacggctgaaagcaaatcctaattcactgacccctttaagaatgtggtaaaatgtgggccctcactccacaggtgcatagaacagcaagagacatggacacacgtgtacacacacacacacacatgcactctctctctctattttttacacaatttgtgggggagaaaaagccatagacattctccaagtaagcagactcaatcattgttttagtctgtcacccaggctttagtccttgttgctcactgtgtctggggctttgaggtacaaacccatgacctggcatttagaatgtgttttattgacagcccttttgcatttactgctgttagatcaagtatttgcatcatggagtagaaaataacccagtacctgttcttgccgagtcctgagtggggatggggaaggaacactagactgatttattaccaatacagatgggataaaagttaggtctgcagagggccataaccaggaggtgctctggatcacaggaaacagtggcctgcaggaatgagagagggcttcctggaggaggaaggaacactagacctggaagggccagctgagagatgtagagggaacagggatcacctgaaggcagcagctaagatgacaatgctaaggggactttggcctcggtgtccataggggactgagcaggcaaaataccttcacctggagacacagagatcactgtggtcataccaagccctggtgggagggcgaggagtgtgaactcagtcttttcatcctaagaatatgacggagagccttgcacattgggcctggcaggcagaacgtggggccagagaccatgtgggccatttcagagaatgggaggctggaggtccccacctttcccaccctgcaacaggtgcagctcatgaggatctgaggaagccgccctacgtggtcccaattccttgcgcacactgctggctgtcagtgcctcactctgtttcctctgcctgtcttcctcaaggcttgtgccctccgctggcccttccaggtctagtgttccttcctcctccaggaagcgctctcttattcctgcaggccactgtttcctgagatccagaacacctcctggttatggccctctgcagacctaaattttatcctgacctctgcctccaggcctcgctctgccagcagttctcctctatgccttccttctagtctctctcttctcccacccacagatctccatgctctggggctctcaaagaattcagggactgtggcattcaaggccagctggttgatgtcactccttctagcctcgaggagaaatctgctccgttgcaacctatgccagctcagaggcccccctcctcccacagatacccactctaaaaagtcctcctcctcctctcacctgtcttcccccataagggtgacggaggtcagagagacataaacaacctacggtttccaattaatttttaattgcaacttgaaattcttaattgcagctgacacgctatctctgatggaggcgcgatggtgaaggtgggggtggcggtgacccagttagagatgttcagcccctgtcggaccaggcactgagccagctgaggagaggaccagagggcagcctgagcctggctgggcgtgctggccaattgccccaggaatgccatggtggagtagttgtgcctcgggccctgggcctgctccctcagaggccagaggcctgcactttggcccatcctctggggagggctaccagagatgccccatttgtcactgtctcattatggccactgagggtcctgacaggacaatgcggcaagctccaagtggcccatcagggcctctactggagcccgtttggacatgcaaaaaccagccaagttccagacaaacagatgagttggtcaccctagctggaaaacaattagcccctttgacacccttagttctgggaagcggggagctgccattgagacactcttagatggctggggagctgcccctcccctcctcccacagctgttccttgacctgaggtgccaacattgggtctgtgcgaccacagggtctgtgggtgcagcttctctcctgggctagtcgcctgtgcgttctgcccagcaatctctacctccccccttggtagggagacagacaggtagatctgtctgtctaccagctccacaggcaggttgttatctgatctggagcaagacatgtccctggtctgagccttagttactccctttgcccttcctctagttcaggagtagcctggtagtgccactcgggggtagccagtagtgtggttgggagttgcaggacaggaaggggccagagatggacagcatcatctgcctctgcagcctgtcctgagggaggagctctcagagtgtgggagaaatctcgcccagctgccaccctgctgtgggagtggggcgcccatggaaggagccagtccgaggcgttctgccatcctctgctcacccacccactcctggcatgcatttgcaaattctttggctaaggtagctagttctccacaggcgctattacctgagacctgccagctagtgacaacagaaagcccgcacgttgacgtccctctttggcttgcctggaagtctactcggggctgcaggactggcaggagcgggggctagggtcagagtggggcagagaccgtggctgcttatggggcagggagagggtctgggccgggtcaggggctgggggagtgggaggatctggagaggatgggctttcctggggagctgggggagcatcccatgggtgtgctctgctgagtgacacaaatctggctttcactcactcattcattaatgcattcattcattcactcattcattcattcgctcaacagaggtttactgagcagctgccaactgcaggccccattctgggccctgggggaacttaggaaggaaacaggccaaagccagaataccagtcccaggaagccaccttttctccaggggtgtggttcatgccccctcctggcttggccccctccctggtggaccccctaccttctctatcacaagtccaggtctgcagtaaggtagacacagggtcctggggttccaacctggtccaagggagcagcctggagtgtgcttagaaacatttgttgactaatgggctcagggactgagggcctggggagcctgatcagggagcctgcacctgcctgtccctcgatgtcattccctcagtcttcccggcactgaatgaggcccagtgtgggcaaagccgcgtcatccttagcaggggcccccatcccagggcttatgaggcaccccagctccccaggagcccctctgggaagctgcaaactctgctttccatacttcagaattcatctgtcctgccaccccttccttcagaccccctgggagtcaatgggactcaagggatcagtgaaataacccaaagtacatttatgatacaaccccctcaaccatgcattctgcacctccacacccctccaaagccctgcccttggggagcctggagacacatggagagggacctgcctgggtcctaacaactgtaacatgtgaacactgaccccaagtgacatggaacccttgtgatatggcaggtgccacacttggcactttacatacatagtcacatgcactgcttatagtaaccccggaataggcactatcactatccccattttacagatgaggacactgaggtgtagggagggctctcacttgcccatgatcattcagctggggagtgggacctcacacacaaacccaggggtctgactgctgagcccatgctcctaatgtccacacggtgccctcctacgaagcgaacctaacagcagagcacgattaacagcaggtgaggacaaaagtacatcagcctgttggtgctcagaggggacgaggcccctgtaaacggaacactcagcgaagggccctaaaggagcggggatgggggctcctcaaggcagatcctgagcaggacccgcccagcacccgctcccagcctgtcaggaaggctgaatgaaagaacaccgtgtggatcttcctctggcccttggaggctgtgccctctgctcagagaggaggagcaaggacattagcaggaagggctgcagagtgagctaaggtctggaggtgaggatgactctgaaggccttcctggagagcaggctgaggaggtaatgcctgacttggtgggggaggggtgctgaggacccgcaggccactgtggaattggacccatctggctgaggcaaaggcgctggcagttatgttgcactaagtgggccaagaggtgacctctgctttggtctgactttggccacagacctaagaatctggatacagttgggctagaagggccttggcagactgcacagctcaacctgtcttgtgcaggtgggaagtgggagatccagggaggagggacttgcctgcaccctccccacctcctgcttgggtgtgtggccctcccgctgggtgggaagagcaggcaggaaacattgtctgaggtttccaaccacacgggaggaaccctgaaaagacattcctgagagaggcataaactaagacctagaaaagacagaggctgacctcacagcccctgacttcctgcttcaacctcccttcccagcccaggccagtctcttccccatggtcgcacctttgctcagcagttcttcccagcgggaatgactgcccccactttctatctttctgtctctctaacactcacttgatattgactggacttttatgtatagttgggcccaacccttagaactagctccaagggctctggttcctccaagaattctcccgtgatcgcatctacctgctgacctctcactcccttgtgtgaccctgaacctgagactggctctgacgagacaaatggggtgctgtgaaacttccctcatccgtccacaggcctgctgctcctcccctgccatgctctgagctccctgaagaggtgaccccactgcaggctgccctccagtcctctctgcaactcccagagcaatcatactggagaagagaaggtcaccaaggcctgggtcccaggggaagctgaagaagacccctccagctcacactgcctgcccttgtcacctgcatggacagagaaatggcttctgtccctgcagtcagacaaccaggcttgtgggctctgtaatctccatgactttatccacccttcccctcagggtcttacgggacatcgctatctttcaatctctccaagacttatttagccagagtctttaccacactcctacctgagtttatccagcttctcttgcatgcctccggtgacaggctgctcactatccacagggtcacttcttatcctaccagggctggtcaaaacctgtgtctctttaggtcagcagtgcctggtgccagaggtcctatcagtagacccaaagctgggtgaacaaaacaaaggctgggcaactcactgtcacctgggcatgtgaccagcctttgctctccactctggctaattcttttgtctgggggccacatcgcctgcctgccctccctccttctgtgcgattttcttcttcttctctctttcctccccccacttccttgtatctaaggattgcatgagtcacttcactttgagctgccagatgtcggatgcagttgggcttggagtggaagccaattttttccctttactcaaaaagagcttggggctgatgaaagcccccaacactgtcatcctggatttttcaggacggtaggatggctgcgtcagctagcaccacttcttccaggttctggcctgcccaccgtccgttcccaacttgggagggcaacttgtcctctcactggcaccaggcatagggccaggccagctctgtgcagtccaaggcacgctcagaatggccctcatcatctggccatgcagagctttgccagtctgagtggagcccagggctcagggccaatccccgctccatccagggagttttcaatgagagctaggtacctagctccatgctggagctgtgggggagacaggaaaaaataaagaagggcctcgccttcaaggaattggcagtctgtctagggagatgaaattcatacaaatagtggttcatgcgtttctgtttggattgtgcatccactcccagacatgacctcatccagttctcacagctattcagcatgggtgtcatcatcttcgttttacagatgagaaaaatggggctctgagagattaagtgacttgcccaggtcacataggtggttgtggagctgggccctgcctcattcgctgggctccagagcctggcatctgtgctgaagttggaaaggagggagggatggcttccaggaggagaaggcccactgtcctctccccgtctcctccaactgaggctgggctctctcctttgccatgagaatatacctatcttgagcacattccagaggtgctaggcaggccagagatcttgtctgttggggagtatggaagtggtggggtgctttcttagattgggctcccttgaacctaaagcctggggccaggacttgggtacaggaagtgtattgggagatttcaggaagagggtagctgggtagtgagacagggaaggaggaaaagctgatataaaggagcattaacagagaagccgctgtggagggcagggctctactcccctggtatctcccaggactgaaggcctaaaggacggaagtcaggggggcgggttatatattggccaccatcacccattggttggggggcttctccagggaggtgatggctcctctggactccaggaagaaagtggaatccctggcctcaagtgcttgaagcggatgctgaacttgcacagaactgcctatcccagagtgtggctgggctggaagtgtcttctgcggcagagagttaggaacatttggttccgggcaaccacatcttaggccctgctgccaccatggaaggccctgcttcaatgacccagtgggcaagttttatcgagcagttactggtgggtgtctggctgggagtcccggagtcaggtcaagagagaagtaaagatttaggggaaggggaagaaaaagacgtctacacactcctgattcattttgcctaccgtcagcatcagttccgtaaatctctccccttcctgctggctggctggttcctcaagggcaagaatcaagtgctatccatccgtgtgctcagctccagcacagggcctagccccgacatgcccagaggtgctgcactgaaaatccagcatgggattatggcccagccttggctcttggctgccaaaggttgaatgtgggtctctgggctcatctcacaaggccctgggtctccagggcaggggaaatgaggagcaaagccacccttttttttttgtcattaacagagtagggcctctggctcataaagccctgggatcccgctccctcccttctctttccacttgattacttgtctctggaatggagtggtttcaggctgccaagtgttttggggaaaatatcctgtataagaaagacacattccctccataaactcgtattgtgtttttgattgtctcccataaaggaagagatgtatcttccagtttatgtttacgactgtgtagattaaaaaaaatcaattctttcactctacattttttcagccaaacttcccccagcagcctttctgctgggccaacaggctgatgcccagaactcggggctggaggtttctctgccatctgtaggcaagcaggagaggccaaagcctcggactggctgcaggcctggcacaggaagggaacttcttgtccctgcttgatttctaagccaagttggctctggaaggcaaggggttggctgagagaaggtggccggcagggaaataggaggcagccccagcctgcaccagcacccttcaccaggcccagtgaagcctctgatggaggtggcagggagctctccccgaccagcctcaagtgctgctgcctccttcatgaagccttcctgattgcccagggtaaatggaactccttgatctgttagcttctttgctggaccctctagattgatttctgattgatttttgtctgctccagggtcatttggagtgatggttgcctggtatttgaataaagagctcccctatcagaacattcaggttcaaatcttagtgcctctgttcctactgtatgaccttgggcaaccaacctacttaacctttctgagtctcactttcctcaactggcagatgaggggcattttgaggattaaaccaggggtattttgaggattatggtcgggtttcaaaccataccttctttcctgctttctttttctccacatcacttagcaccatctcacatcttatgcttcgttttgttcagtgcctgtccgccctcactccaggagggcaggggtgcctgtgcattgctccctgccacatacctggcacagagaggcggctccatggagcggaccggatggatggtgcaggatgagcaccaggctccgcatcagggcacagtaaatgttggctctgtgccctttcatgtctggaatccccagtttggcattgcaggcaggggaagcactgtccatccaaggccgatcctgaaggtggcccaagagcctgtccccagcagcagactgcaaaccctttgggtacagggactgtctcttgccattccagggtcctcaatgcctatcaaggggcttgctcacatgggccctcttgggatcagaatttcttcctataagaggccagagaactgatggagggtagttttagtctaaaccatgctggcgggtgccaggctgtggactgccccatgtctgtcaccaagctcagcccagatgagccaggcataggtcaccaacacactcgcccaccagctcagcccacagctcacactagcctcagttatctggttccagtttgccaaaggcactctgactccaaggtggagtggggaagccactgacttctgtgtctggcaggctccatttctggagagtcaactgaggccaagcccaaccttcttgagcctcacttttgacatctgcagaatgggtgtgggtggagatttcaagcaggaagctagttctccagtgggaccccttctcctggcagcccctcgacttgccgcaagttccagcaatcacccctcacctccctctgcttttcctcaaaccttttacaaccttttattttgtctaatcctcatgacagattggtggaaaagccaccaggagttattatgctcattttaaagatgaagagactgaggccaagaggcaaaaatcatgcttgggggttggcgagggggtcccccagcagcctggggccagacagacagttctcctgcctaccaggcaagccccagcaccagctccaagcatctggagggctgcagcagggcgctggagggctgccccctgtccccctccctccctcccagctccactgggggggtctgccgggctcttctccctctgccttctaattgcttggaaacagagctgacggcagtgggaacagctcagccactgctggtctcatgactggaggcttttgtttgttcacagaatcatatttttacactctggcttccgctaatttatgccgcagactgagctctcccttgctgaagattgagtttgggagggtggggagttgattcctgggtttatttagtcatcttggagcctatcagaagccaagcaggggataaattaacaacaacaaaaagtaataatagccaggctcagggtttattttctggcggttccctcctccaataggcctgccgtgttcccttagctcatctgctgaaggaagcttcgctgggaaaattaaacggctcctcatttaagatggagcaatcagccctgagctagtcgctgctcagcacctatgggagctcatcccagctcagctgcaaggggagagggaggcagggaagcctcagagcacccccaacacacacacacacacacacacacacacacacacacacacacacgcacacgcactgtagctgctacctcgctctgtgtgaaatgatgacgctcaggtgcacagttgcaacatcctgtaggaaactgggctctgttggaagcaatccaggagggcttcctagaggaaaggacccagggatctgagaatgggaaggagtctgagcctgacccataataggccaaaggcggggatggggacagcactgccgcagagaagtggggaggggaagaaagccatttggggagcctaaatttttgcaacatctctcctgagatgggctctgcctctacaagtgagggttggggcaaaaacactctgtacctactgcaaataaagtgagcgctggtgctgatgaaagggcatggaaggacctcccctcaactcctgtaagccccaggaacataaaagaattgtcttgtacttaggaactgagtcaggaagggcctgagaaggcccatggaggtcaagttcatgcacacaaggtcatgagagcagggagaggggatcgatggggacaagagagagaaagccagccttgtgcctcaaagctggcacatagtaggtgcacaacgcatgttagttcttggctccttctttccctctcaggacatatgtggctaccttgtcacctgccatgccccccagggccaattttgccagtgggcacaaacctgctgattgtattcacccatccatccaccctcccacccaccagtctccctttcatcatctgccccttcactcatctacccacccatccacccatcgttccacacccagcctccgatgcagccagctcctacgcaatggagccagcagagccagcacagaacctcaccggcaacccggctggctgcctggaggtctctcatggtggcgtctactttgagaaagtaccacgggccttgctgccagcactggagacataggaatctgctttggtgagctgggtgctaaggagattcatctctctgtggcagattcacatttaccaagctcacagggactgatatttatatacataccctgatgccaatttattaatttataataagaaatgctactcaagtgcagcggatgtttgtcttggcagaatagcatcgctcccagtaggcaagctacagtaggaagtcaaattatcatcaaaacgctgggttaggaattcacaacgagaaatagaacttctgagggttttctgggtacatgtatactcctgggtccgcttctctccccaaaagcaagttacaagagaagatgatctgaagtctctctggtgaacctgaattagagagctgaggtggcacagggttgttggtcatatgatttgctatctgatggcctgatgcacctgtcccaccacagccccagatctgtctcaggcatcctctggcctggaggtcagcgagttccaacccccaccgcctagtttttagacagcctgcaagctaagaatggtttttacatttttaaatgattgagggggaaatgagaagaagaataatatttcatgacatgtgataattatacgaaattcaaatttcagtgccccaaaataaagttttaatggaacacagccacatttgttcgttacatattatctatggttgcttttgcgctgcaactgcagatttgagacgtggcaacagactgtttagcttgaaaagctgaaaatatttccccgctggccctttatagaagtctgccgacccctctccctttggtggcctttgtccctttactgaactgctgccattcttcagctctgttgacctgagatcgtccacagatcacctggccttcacaagtcaacaaactcccagctttgtttgaaacttttatcagaggtgaaaggctggtaagaagaccatggtctctccagtggttcaggcttcaggtaccctgggcaggctgtccatctccagggagaatgttctctgagggagaatgaacagcacaactgagaccctgtggccttcctctgctttaagactgtgaagcgtcgtctggagttcttaagaggcagctgtgtgggagagagagagagaaaaagaagaggaggtgagggaggggaaggggagagggagcaaagagacagaacaagaaggagcccaggagaaggcgggaggggaagcagagagattcaccgccctgtaggaagcattcaaagcattcaaatggcagtggctccaggcccattggtccattcttccaggactcctttgtcctgagcctgggaggtgtgggcgagcttgtccaggagtgcccagggtggtatgggcacagctgggcgcttgggcagtcaggttctgggcatggcctcccatgttccctctgccctgctggggactgggtttctgcctcctcttgagtagctgaggaggctgggcaggattcagattgagctttaggggcattcaggttgacaggcccctcaaagattgagaaaggggggctttctctgcatttggtggcacctgtcctgtggtccagagccagctccaaccctgcctcagctggcttctgctggcctcaaatgtaggccctgggcagggtagtgcagaccacacagaggtaccagagaagatggggcactgaaacccagagtctgagatccttgcttcaggcactgtcctctactccaaactgctaggagaaaataaaccctggtttgtttcacatctgcctcacttagccaggcttccagaggccatggacagaaggctgtaattaaacaaataaagcaaagagaagaaaacctttaaaacaacaattaagcaaagcaaacagaagacaacctttaaaacaagatgtccacgggaaagcacatttattgtctttcctgctactggcataggccttaagctggaagcacctgtcctcccattttatggatggagaagtcaaggcctcaggttacaaagagccagacacagccatgatgggtcttaggcctcctgacctcgagtccaggactcctgtctctacagagaggcagcgtaacatcacagaacggttaagaccttgggctcttgtgtcagaaagacatgagttcaatgcctgcccccattcctagacagtgcaagtttcaatctcctttataaaatgggaatgtcacaaagagaactgacccacaggttgttttgaggaattaaaaaagagactccttgtcaagtgcctggcacatgtagttggccaacatgtattaactttaaaaagtctctgacgggtacggtggctcacgcctgtaatccagtactttgggaggctgaggcgggtagatcacttgaagtcaggagtttgagaccagcctggccaagtgaaaccccgtttctactaaaaatacaaaaattatctgggtgtggtggcacccgcctgtaatcccagctacgtgggatgctgaggcaggaaaattgcttgaacctgggaggcagaggttacagtgagctgagatcatgccactgctctccagcctgggtaacagagcaatactctgtcttaaaaaaaaaaaatctctattgtgcattagatgctggggttagagaactgaacaaaaccctgtatgtaagaaggcttccatttagtgggggagagatatcaactcactgtcgtggaggatatggggtgctgtgggttgacgagaggaagggaaccagaggtcacttcacagaaatggcaggtgtactaactcctggcggcagagccgttgttcctcaggtggaagaggggaggggagaacattccagaacatcaaggcagatggcccagcacaagcagaggcagaaagagacgtgtgtccctcccaggtgtgaggctgcctcactgggcagtcctgggggcattctctttgccaatgaagggtcgctatttggcctcccatggcctgagctcgtcataccctccctccagtgtcagctctgggaaagcaaactggttcaatatttgctaaagccaaacaccattttgtttcagcaaattttctgatggaaaaaattattctgtaatgaggtcccaagttaaatagacttggcgtttggaatcatctggccctacactttgccaggtaagatagaaatgcggtatgaggatgagggggattagtctccttcactgtctctccctccagaaagtcctcctagcttttaccctcataggcacacacatagatagacaccccgccccccaccaccacatcctagcaccatttagcctacattcagaatttgtctcataccccacccaagcaccctgccacaaatagttaggcacagttacactcacctctgagcatatgcagtctcccagacttacaatgttatagcttctgtgcacaagtgcacgtgcatacacacacacatatgcacacacacacacacacacatacacacacacggggctgttctgggtgtttcctaaggccactgctccactgctgcttctaataaccttccagatgctggagaacagaagaattggggggtccaggacctatgaaggactccagcctcccatttgctgctgtctgcttcccccaggctgggagggcacatgcaatgctcctacccagccctggctgtgcagagcccagaactgtaggcacctgctctaaccatgtgctcactcagagtcggtgggggcactccaggaacactctatggccagagcccagggaagaccccatgggaggcagtggagtccagtgtgtctggttcagaatggcccgtggactaaaatcatgtcactgccaggctccatggggatgtagttgggtctgacagtccttgactaatctgtgcttctcttcctgaaaccctggcactctgccctctgccagcccagccacccacagccctgggcactaactcagctgagacagactcaggagagggaggaaggaagggaagagcaggggcagagatccagttccagaaccagagaaagacaccacctcagacacatggacccagacgggctctggttttcagaattaaacctggaaactctggaccctgcctatgtctgttttcctgcctatcacacctctcccagccttagtcacctccgcagttgggtgagcgcgtccctgctctggggtcagaagggaggggtgtcatccacccagcagatgctgactcgcacttacagcctgtcacccgacagagcaggctgcacccaggctgctgagatgcgccggctatttttgtggatgaagtgtgatgtcacaggtacagggacttcctggataccagggggagtggcagctgggagggagacctgtgcctgctccactgcttagctccaatggtccctggtcaggggtggtctccagggtcaccaacagctttctctttccattggcctgcccgtcctgcaggggaggagtccaagcatttctcaacatctcggtgtgcctaggcctgagccagggtgctctggggacagagctcaccaacagtaggaagattcctgggtcccggaccagttgggaatatgtgcagtcaggtgcccaaccttgagtgccccaggggttctgagatgagaattccccatggtggtgcagtggtcagggaagccttaagaggactggcatcctagccagggctggtgggagccaagactcagcggccaggggaatagtgaacatgccctgagggctcaccataagccaggacttgttccagtgcttgtacatggctcagtttatttaaccttcataacagctaaggcacagagaagttaaataacttgcccaaggtcacacagctagttagtgacaaggcctagatgtgaacccaaggcaatctagttcagagaccatgctcatagccacttggctctgctttgtatgtagaaattatcctgctagaggaagggtttagggtgggggaagttggagaggcaaggacatggggagggagttgtaaagggactgcatgccgggtgaggtggctcacgcctgtaatcccagcactttgggaggctgaggcaggtggatcacctgaggtcaggagttcaggaccagcctggccaacatgatgaaaccccgtctctactaaaaatacaaaaattagctgagtgtggtggtgtgtcctcaggaggctgagacaggagaatggcctgaacctgggaggtggaggttgcagtgagccaagatcatgccattgcactccagcctgggcgacaagagcgaaactccatctcaaaaaaaaaaaatgggactgaaatgccaaagagaggatttgagagctgatccgatgggtgactgagagctgatcccagggagtaggagaggtgatagcccctgcatgacccctatacacttccctaactatatcagcccacccctggctcagaggaagaagggatgttgcaggtgaactgagatgctttttgctttgtctgtccaatctccacccttcttcttgtaacagagtgccattcctcagggacctgccaatcacagaatatcccccccacccaccccacagggacaggcacatgatccaagcatggccagtcaacatctcttgaaaatttagaacccaggaaagacagcccttctccgcaggtagctctgggcagagagagccctggagcagcctgtgggcaatatgctggcctgtggagagggctggcaggagaaaaagaggctggcagccagcggaagcaggggagaccccaagagggaggccgtgtggcttaggagtctcactttcagtctccacgaggcttgctactcccctggccttccctaccacttggttttgtgatccagcgacatctctttgtgcccacctggctcaaattgggtttccatcatttgttactacaagggccctaaaaggtagtgcctcctagactggagaagggacctttgagagcccctagtgaagtctctatgcagaactcagggtcccctgacggatatccactcacctctcccaagatggggagatcaccctgcgcatatgctctgtccaagtccagtctgtacgacgctggggtcagggatgaatgggacagtctatgcccctgaagctctaagcctgacagggagacagacctcagacggggagcacacaccatagcagaatggagcctggacagtgtggaggtgccacccccaaccataagagccagcccccatcccctgatcctgagctgcctccatataaacttttgggggatgagggggaagactaattctggagacccagggtctatccggcctggctgcctgccccagccctgggaaagagcctggcccatctctgagcagatgagccagcctgggccaggtacaacaaacactgtttgctggtcttccccgggtgttgaccactagccctggctactgttccagcagcagggcctgcctccagactatttagggaggttctggaaaaacagcaacaatacaacaaaacctcaacacagaatcattggagctgtcattcctttccctggagccagtccttcctcccacagtgccagcccagctgccctctggtccctgcatcccaggtggctgtgccgatgttggcagctgtgtgctctaggtcaaggtgcctgttgtccagctatgtccttaccttcttctgtgtgtgccttccactctctgttctgttccaggtgtctggctggtttcctcatgcctctatctccccctctctcagacaatggtctctctgagatagacgctggaggcccaagcctgggtgattccacttccccaagtcagctgttgcaccccaccctctcttccctttctaagctgaccaatttctctctccccttaaaaatagtttaaaaaaagtgtttcctaaatcctggagcactggaatttggtgattgttcatggagatttgggccagctgtttcctatgctggggctctagcagggcagtgataagggaggggagaggaactcagacccagggagggagggaggcccttggtgggctcagcagcagaccaccagagaggacactgtgtgagtccctaccatgttacatttcacgctggggacctaggctcactcaggagctgtgatgccaggagaacaaatcgtggcaacacgctccacttggcttttggacttaaaagcgtaacccaaagggcaactgacaatttatgaatgactctttctggctgcctaggcttggttccaggccccttgtgtgtgtccctgtgcgtgtgcatatggttatgtgtatgcgtacttggcccaatgtctgcctctgagctcacatgtgcacacaagcatgtatacatgccaaggcttggctacatctgcctctgtcttctgctcatgacaagagctaatctacagcaaagctgaggagttttaagattctgaggctggcacctccatggaccccttgctgtctctggcccttgccaccttcccagccagcccctctgcccttcctttctgtactggaatccccatgaggtgcctctcctgactgacaggtgcacaatttgattcaatttgtgggtatatgaagaatactgtttataaatgcagtattttccttaaagccttataaaccagattcgatacttctcacagtctctggaagttacctttcggtaagagaaatattagaacatctgctccttgtctgttggataagctccccaccctgggagctgctccaggctttctctagcctttccccaaactcactattctgcctcattagacctttctggaccctcatctctccgcacacaggagaatgaggggtgggaggaggtggcctggggccatgggaggactgggagtccttggggggctcttgggtaccagtcctgtctctgccaatcactacttttgtgaccttgtgcaagtctctgcctttttctgacctcagttttcttctgtctaaattggatacattaggcaacaccaagcccttggcctggaggatggtcagaacctccaagggtggctttagaggttcgcaaactactcgtttaattcactgaggctctgatttgttttaaatcattttactggtttcctgtggcttctgtaacaaattatcgcacactgggtggcttaaaacaacagaaactttttctctcacagttctggaggccttaagtctgcaatcaatagtactgggctggaatcaaggacttcagcacagccactctctggaggctctagcagagaagctattcctggcctcctgcaaattctgctggcagctgacattcctgggcttgtggccacatcacttcaggctctgcctctggggtcacattgccttccttctgtgtacccatcagatctccctcttcctctctcttgtaaggatacttgtgatggtatttagggtcgatctagttaatccaacataatctcctagtctcaaaatcattaacttaatcacatctgcaaagaccctttttctaaataaggtaacatttacaggtcccagagattcggggctgatatgtttgggggctgtcgttcggcctactacaaccaaaggtgaaataatttagaaatgtcgcttaccactaaagtgaagaatgagatttctatatgaagcaaagggaggcaggagttttaaaagcttgagtgaacaaaacgacttgcaagggtcctccctgtcctatcactgcaattttaactgccacatgctgagggagacacaaattaattgagtttccttcaaagcaacacacaatcaaaaagtgaaatccattaccactagacaaaactgatcccaggcacatggcctgagatgcccctgtggataaaatgttacctggatccatgagggtctttggttcaggggggaaccccattccagggcctcaaacgtctctggctcctggttccatggtgggccccaggctcaggaaagacagagctcaggccaggctggtggatgggttggaaaggccaagattgcaggcctactgaatgccccagagattcagggccacacctcagcaggaatacagcccaggaagagggggcaggccctctggttatgccctctggccttgctgtgagaagacggccacttctcagactattccagacaagcctgtggagcctctgggcctactgccttgaattaggtgcctgttacaatggacccctttgcttccctcatgcctggcacatcctgcctgtagccttatagcctcagggagcaataacctgaggataagaatgcgggcagagtttaaaatcagacagtctcgcgctcaaatcctggccctgtcgtttgccagctgaatttgcttgggcaactgatttcacctatctgacttggggactgcctctgtgaaatggagacaatgctctctgggtccttgggaggcatgagggtggaactgtgcccagtaatagtggtcatttttatttggctggggaagagattcacagcgtgtacttattagcagcaaaagccaggagatcaaggaatccagagaggctgggttaggtcatgtgcagctgaaatgattgaggagcagaagctgtgtaggagccaatgtgaccccaggctataggaacagagatagccagttggaggcaggacagaaggaagcaggcaggatgacattcaaatgccttatggaggtctacaagaccctatgtggctgccctgctcacttctctggccctttctgcccctgctcctccagatatgctgtgtccagcctcactggcctttttatcattctctcagtgttccaagctccttgccacctctgggcctttgcacatgctgtgcttccttaccactcagctaaacttacttaccgttcagtctcagcttaaatatcactttttcaaggaagctctcccacaaagactgtttcccaggtctatgttcatcagcacaggtcactggttcattaacactggaccacgtgccaacctacctctgtcccatgagcagcagccaggtgaggtggttgctggtgggacaaagcatggggctcaggggctgtggcagggaggactttcttggatgcagctctgagcaggcaggtgccataaggcgtgtctgaggcacacagagagaagacagggaggtcagttgataacccagagcccctagtgaccaataagtccacatccactctctgccgggggatacctgtgatgaggaggggagtgatttgtctaaagccattcaaaggatgaaggcagggctggtctcctgacctcagctaaggatgccttccaatgccctgggctgcagagagaggagctgggctaatgagaactggggcaaaaatcgggagcccagggctgtgtggctgggaattcagagaggaggaaggtgggtttgtgtgaaggtactggcagggatctcctgggccaatgtgaccccaggctgcccacacctaggctgcattctcctcggccaagctagccaaggtagccctgcctgggcccagacttccagtgctgggcaggaaaggatggctgtgattcttggctgatggcatcttgagcccttctttttccatatcccttttcttgttttattttgttgtcttattaaataaaaaaaaaagatgggtctcttctagctggacccacactgcaggtcctgaaggtagaagccaggccacctaaggagggatctggaaaggggtgaggagtgttctgcaaattgtgggcgagtctcctgtctccacctggggaagctgctggtgcactgtgagggtctttggagggccctcctcttttggctacgagcgtctcacagagcccctttatttccacccccatccaatctgctttaccatgcaggccactgagaagggtcgcagcctgagtccttccatctttgagggaagtacattttctttgtgactagaaggtatggcaccaactgctgggtctggggcctccatggggaagcaggtaactaagggagacttggaaccttcactgcctggggtaagcctggtgccctggatgggatgggaggagtgaatgtaacatgggcagtgagccggggagtgggcgggggtcagggtccagctctgaccacttttatatcttgggtctggtgttaggctggggatgtgtgtaattagttggctaaaattaagaggtctattgtgcccctaactccttagaggccaggcaggggtttccagcagtagccgcacctcctccccacagggaccgatggcatggtcggtggctatgccggcacttctgcggctcacttcattctgtcaggataagagtcctgagtgggagacaggccggcctggttatgctctttacaggtaaagggggtagatatagagcagataaactaggccagggatgggaagggacttgccagcacccctgctcccctggccagcataggagtggctgctgcaggaacggagggcccagagaggggccttgggcccagcaaaatagctccaaggccacacaggtcaaagccctgggttaccttgttcccccacgcagcagcagggctggcgaagcaggaggagaaggcagggcaggactggtgccctccaaacctcagccagcaccccaggcccaggcctgcctctgctggtcccaacattagccacatgggttgtaactcaagctacacagcatcctgggccatctctcctcttttggggacagttgtgtgacgtcctgttcctgaccatgtgtcaagccacctgaaggcagcggtgctgtcccaccccaacgtggtattcccctctgctcccctgcccttggcgggaggaccatgcccagagaatgagggttgggaggactcaagtggtctgggcagctgccgggaggaggcatgtgaaagacagaaggactttggaaagggaggcagactcaggggagggatcccaggagaagggagatgcaccctgagcagaaggaaagatgaggccatggaaatgcctggtgtttgtggaggccaggtggccttcatcctaggggagggagcaggaaggactcctgtgcagggccttgagtgatcagccatgagaagaggatttgtcttcagggtagagaaggatcaccctggggccttcctgagctggtggggacactccctgcacattcgttcccgccactctctagggctgccagctggcctcccttcctggtgctgccatcactcctcctctctcctgaggactccgatactgggctcaggctccagctcctttctacggggtgagtgaaaccaaatgggcgggtttgctggcaaggggcaggaggcaccagggcacggtagggtggagaggaggccagttccaaaggctggggtctgggctccaaccacactctgcattcactgcctcctccctgagtaaaccaggcactctcctgggcctcaggctcctcctgacaaccagcaggatgccagcttcttttgggactgcaccagcgtggggctgtggcacagggccgggtgtgagcagctggtctgccctgcagctgctgcagagagcagctcccgtcctgggggcaggggccatgtggtctgtatttctcagtgtgtctccacctctgcttctctgtccattttcctctgtatctcttggtagctgctgctgcttctttcttatcttcctcctggaccctggaaatccctgtaattctgctgtcaatctcttcttcccttttttagtttcttttccccactatctccctcatctccgaacacccacacccagccagctccacatgtgctgcacttttcttggaagcagctctcacggctgtcccctgtcaaggctgccaccctggttcagatgcccagtggcctctgtcttaaattgctacagaaatctccaatggctcctatttctttcttgaaaccactgccaaaatattctcccagaataccatttctccttgtctctccctaggtcaaaaactgagcaccattcccggtgccttgagtgcaaaccattcctcttagtactcagaccctccgttctccgtctgggtcccccaagttagagcaaggaagagattggcatatgacctgtcagaggtagggcgctgcatacagataagggggcttgggagttggggctagcttagagagggtagggacttccccagtgagtgttggaggaggcattgctgaaaccagaggcagaattgtagctggaaggaactgggaaacaccccagagaatgtgctgaagcagagtggcaatagaggtgccaggatactagggccatgactggagaatccgggtgggatgaaagaatttctacatctaaagctgttctctaaggtcagcaatcagaactacattcctgatccaagaacctgcgtggtccttgggccagcacaacatgatgccaataaagtcagaagctggtctttctgatgctgcaggggtcaagatttattttgttgtcatttgtttgttttttgagacagagtctcactttgttgcccaggctggtcttggactcctggcctaaagcaatcctcccacctcagcctcccagtgtagggattataggcatgaaccactgtgcccaactggtttcaagaactttaataggactttgcattgcaagatttcagtttataaggtctggcctgcctttgccagaatatactaggcgtactgaaccttttcaccaaagaaacactaaaatatttacattcgacaattatcatctgtggtcatggtgatgttagcccctagttttgaggtaatggcctcccccagcttcagaacatgctctaagcctgtttggaacatatctcaggctagggacagcttgagactaagtcagcccaggcaatacagtgatgcttctcatctgtttggtcagtgctgagtggagacagagtggatcagacgatcctaggagaccccttcctcatactgctctggttctatccctgaagtgatttctgaagatgttggccatcaggcataaaaactcaaattgggccaggaacagtggcttaatgcttgtaatcccagcactttgggaggccaaggcagccaatctcttgagcccaggagttcgagaccagcctggcaacatggcaaaaccctgtctctacaaacaatacaaaatttaactgggtgtggtagggaatgcctgtaatcccaggggaagtggtgtatgtaagggtggaagtgtagataggggtagccaggcagggatgggcttgggagaggagacaagcaaggtttggagggcttaagactaacttgggcagaggcaagagcatacagaaaggctcagagacggggctgggcgtcgtggctcacgcctgtgtaatcccagcacttttggaggccgaggcgggcagatcacgaggtcaggaacttgagaccatcctggctaacacggtgaaatctcatctctactaaaaatacaaaaaattagccgggtgtggtggcgagtgcctgtagtcccagctacttgggaggctgaggcgggagactagcgtgaacccaggaggtggagcttgcagtgagctgagatctcgccactgcgttccatccagcctgggtgacagagtgagactccgtctaaaaaaaaaaaagaaagaaagaaaggctcagagacagaagagaacatggcatctttgagaacctgaggaaagtttaatatggcccacgcattgggttcactggcggcagatggagcttgagaaggaggcagtgcaggataacaaagggcttcctaagccgtattaagaaggtaggattggacttccccttgaaggtaatggggagccactgaaagttctaaataggagaatgaagtaattagatttgtgctttagaaagatcattctagcttctcgagtggaggcaatagaggaagatattggagatgggggcagttaggaagctctgggggtgtgagatggtgggggattggacctgggcagtggtggtgataggaagaggaagaggaagtggggaggatgcctgaaagtctggaggctggaacgataagctaatccagactagaggccacgctccctcttccagcagagtgtctgggggcctgctgcattttcccatgcactgtagtctgttgtcagagaggaagacacctaagagaaggggttgtgtgggctggagctgtggaggaaagcctgtggcatgccattaacaggatgggcctcaggtcaacaggacttagcctctaggttaatccccttggaaggaggacgagactttgcttcctcctctaagcccccaggccagcctcagcctgtgacctcatgccttgcctattctcatatgagcttctttcttgcctgttggcctctgaggcttcccacctgaataagcccagccaccgcttatgcttcctgatcccctgatccagttcctcacactgtaagaaagtcctgagcctccccatggaatgtcatgctcctacctctaaggcagccacttgctctatgcctttgagcactcttggctctgaaagtcttctattcatggagagctggtgcctagtggaaccaagagaggctgagtccagaaaagtggcttctttaggagtgggttaaactctccacctcagacaaacccatcccagacccaagctataagatcaagccaaaggcccaagtcctggttcagggctcccaagggtatgggctataactcccagctcctcttctgcacataccccatgagccacaaaagttcttctcccattcttggtgaatattcacaccaaatattgatgtcagagtgcatatttcccctaaaatgctccatccatgagcattgtgagagaggaatatgagtgcagggtcgagaggctctcttagctctgtaggtgggaggcagggagcagagttcttaagccagcccctcccggcagccctaccactgcctctgagcactaattagagatgagctcaggcctgtggaacatatggtttgtcagttttgtttccaggtgaagccaagaaaaggagatggaaaggaaactcttggcagagggagaggctctgaggagggggtgcccagagggtcccctggccttttcctcatggactggtgattatcagagcgcatgcctctggctgtaggtcatccagcccaaacaagaaggagctttatcatctcacaggacaagaaacccagaggtggggcgggatccagggcacaaggtgggctgctttggctctgctgctcctccatcagctgcactctattctgagggagaccagctctcttcctgcaatgtttaaaaatcaatgtgagatcattattcatgcctcccagcagactttctctcacatctcattggccaggattattcaaagatccctttctaaaacaattagcaagggacataggactgttgtgaccatcccggggaagcccttcaccttccggaggaggcagttgtccctgagcccaatccaggatccgtggaatgggagaaacgattggtagggggcatggatactggataggtaaccaaggccaacagggtgagattgacaccagtctggactctttctctgcatcatttagaaagaaaaggcaatctttctaatagtaagaaagaaagagatgagagttgtggcagatcaggggctaaactggacatttgcactcagagttcttcccatctgtactttctgctgttcacagcacttttctgcccaaagtctggttcaataatcataatgaccctgtgagtaaggcagggaaatgattatcatctccccttgacaggtgagaaaaaggaaacacaaggagctaaagtgacttcccagaccccttccaggcatcctttagtcatgccacctagatatattggcatgtcatgtggcttatttttagatcttttaggaaaaagtttcattctcaccaatctcaccagaggtctgcctgaggagtcaagtatccagggattcaaggagcttccagaatatccatgacattttttctcttccaactcatggaaggagatacaaagacctccttcctgacgcagagcacaggccttttctattattctggaaacaggttgcttcctaaatcaacgttgctgtccagggagcagcgctgtccttggtactgggcactacttcctgtcattggccatcctcaattgtctttccttttcagcttcaaggctgaattcttaaaccaagatctagagggattacaggaactatagttaaccctaacatcacatcttgttgccccactgaggaattcttctatggtagtgtgttaggctgtttttttaatttttattcttattttttttatttttttttttgcattggtataaagaaatagctgaggctaagtaatttataagaaaagaggtttaattggctcatggttatgcaggctttacaggaagcatggtgctggcatctgcttctggtgaggggcccaggaaattttcactcatgatggaaggcaaagtgggagcagccatcttacatggcaaaagtgggagcaaggggcgggggtgccacacacttttaaacaaccagatctcatgagaactcactattgcaaggacagcaccaagccatgagggatccacccccatgacccaaacacctcctaccaggccccacctccaacattggggattatattccaacatgagattttggttgtacaaatatccaaatcgtatcaggtaggcaaggtaggaatggatttgcaagttccagacacatgctcttgggctctcctgttgtcttagcacatgtctacagcactagttcaggggctcgtaagctatggcccacagtcaaatctggcctgccacctgtttttgtaaataaagttttattggaactcagccatgtgtgtttacttattgtctgtggctgcttttgctctaccacagcagagctgggcagtggtgacagagaccgtatggcttaaaaaggctaaatatttactaactggtcctttacagaaagaaattgccaactcctgttcttgtttattctctttggggcagatttttgttctgagcacaagcctgtgttactcataattccctttatccctattgatccctatctacccccaaccccctagcttaggatccatgcaatcctgaaagacacaatcccaaatgtttaaatcctgaaagctgaattctgggaaagggattagtgcagtttgggttatagcagcatagttgcatcatattaattgcatcctgttaagcggaactattatcttcttattatatttgttggtttaagaagatgcatgtgggagccaggttgacaaggggtagacttggggagttaattttaggtgtcaatttgaccagattaaggaaaacctagaaacctggtaaagcattgttttgggtgtgtctgtggggtgtttccagaggagattagtgtgtgagttcagtggactaggtggaaaagatctgccctcagtgttagcaggcaccatcctcttgcccaggggcccaaagagaacacatacagagggtggactccgctctctgagagctgggacaggcttttcttctgctgccttggacatcagaactccaggcccaccagcctttgactccaggcccaccaagattgacaccagcggcctcccaagtcctgaggctttctgccttggactgagagttaccccatctgcttccctggttctgaggtctttggacataggctgagccatgctactgacatcccagggtctttagcttgtagacagactgccaagggacttatcagccaccatagttttgtgagccaattcccctagtaaatcacctctcatatgtctatatacatatcctattggttctgtctctctggagaaccctgattaatataaatttggtcttggggaagctgaatattatttcttcttactgtattccttacaacacaacagaagagatctgtaaaatttttccctcagaaaaaggctgtgataagttaagtgacaaggctacttaatggtgaaacataaaagtttaaagactaataattactggtgctgcaaaagcagaaaattgcttaatggcaatggtcaagcaataaccagactttctaatggacaacacatctttacaaaatttgtaaaccacaatcactctccaaatacaagtgcagtgagtgttctgaagatcatacatgaactgaaaatgcaggcgaaaaatacaagaaatctccaatgccaaattagtcaatcatgtgtgacttctgacccttcacgcatagcatctatttgctatgctatgtatttcatctttgcatcatcttcaatattggaggtagaaattgtgtagacctttagagaattctaatttgttgtatgcattttttttcaagtttgactccataaaagtgcattatcacaatgttggctttgtgtgtaagtattgtgtatgtatataaaaatgtctaaacttcctcaagaaatgaagagatggctgagcgcggtggctcacgcctgtaatcccagtactttgggaggccaaggcaggcagatcacgaggtcaggagatcgagaccatcctggctaacatggtgaaaacccgtctctcctaaaaatacaaaaaattagccaggtgtggtggcaggcacctgtagtcccagctacttgggaggctgaggcaggagaatggcgtgaacccgggaggcagagcttgcagtcagccgagactgcaccactgcactccagcctgggcgacagagcgagactccatctcaaaaaaaaaaaaaaaaagaaatgaagagatgtcctccctgtatatctgcatttatgaaagataaaatttctagagattttaactctttgggtggctgtacccattgtagtttcagatcagtctcatcgaaagacttagggtgtccatcacggtccttaagatgacctcagttataaagctgggtgcacacaattaccaaacatagtgatacgcatgtacagcttttgctttttgacctatttctttatcaatgtgactcctctgctcataactgttatacccatgtgactgtcgttaggatactgaatgtttatgattacaaaaatacatatgccatcattgcctgtgttgttgtgtaaaggtgtcaatgaagtgttctgtcatgtttttatatgtttcccaaataatccattttaaaaatgtaagtaaatattttttaaagcattaaatttttttcagagttatattttcagggttttcatctttcaagaatgtgaatgtggggattttagactttagggattttgatattttaggattttgacatccaggattatggcatttgggatgtgtctttcaggactatggcccggaccatttaggaaggggtcttttcccagctttctcagttgctgggtaaactggcttcctgacctaaacgggtcctaggtccatctcatctctttaaattcaaactgctctcaaatacaaactcagtggtcctctctggcctcttcccacagatgtttctcaaacccattcatctaaggctgagcacacagcctacttagcttccccgagcaaagcctctagtctagacaaggccacagttaatacaggagtcacccctatgagacatacttctttataatctttctcagtgtgttaggactttttcagatgcaaataacagaaacctgatccaaattagcttaataaagaaaaaataactctgcagaaaattccagaaatagatctcactgctcccagcacacaggtgatgccatcagaactcagcctcatgttccatcttgactctgcattcctcaatattggctttgtttagacaggcctccaaatagctttggctcgtgtcctcagcagaaagagagatccccttcattctaacataagagcccagagctgagtctcagagctcaggtggatcacatgatcacctctgaaccaatcactatggcctgggggatgggatgttaggattggccaggcttggaccacatggtaatgcgaatattggggaggtaacgccactggacagacagagtggcagaggggtgatccagagtggagaatgctcctacctaccaggtggagggccaatgcaggctggccaggcaaggacaataggtggacacctcacctcacttgcctggtttgtttgacttctcacttacagattgtcattttcttcttctctgctgtcttctcaaggggctgtatcagcgttcaagtctctctcagcctacatgataaagtctgtgctgcttcttaggctgaaatacaccctcccttctgtctacccataagccttgcctcccaccatctcctttatctcacgagctctggcaatattgagcttccaccagcagtgccccagtggccccaggtctacagtctagttttgcactttccattccttttgcctttcccattttgtctgcatggcacacttctgatctactgcccagatcaagagtcctctcctctgggaagtcacatcctcacctctaggacagaagaaagcaccccctcatctgtgctatcactgccctgtactactgtcccatggggtctatctctctgtctctttctgtttatctttgtcttctgttttagacaatgagctcctcaaggtcagagatgttttcaggcaatgtttgttgagtgaaaacctttccctgggggttggcctttgtgtggcttctccaactccagccttagagcaatgctagatcctctaaaatcccataagattagtgggagactataggctaaaaagggggataaagccaagtagatgcattactaattaattcagcagacatctagtgaatactttcagtgccaagcactgtgctaagtgatgggaccacagaggtgattcgggcatattcccaatctcaagaaattcactgtggaatagagaaatgaagttatctaagctgcttgcgtttccctcattctctggccgatatctaacctagtatctgacacatagtcaatgtttaataaacagttactgaacaaataaatgaataaatgagcaagtgagggaacaaatgctatggagggtacacataaggctgtgtcagagtatggggaagaaaagagtgctgggaatatcctttcatcatctctcatttactgaggcatatgctggttgttggggattcagagagaaggggcgcttgtcccctgttcttgaagatcctgcagcccaggggacagaaaaaatcaatgtttacaagacagtgtgagaattactgagcagagatatgctgagaactgtgataagacagcatggtggggggatgcatggaagagaaaccaatgaattaattgattgtccaatcagtgtcctctgtaatgacatctctatgttctctgccctttcctggtttttctgtgggagctccaagaaaatactaattcatttggtcaaggagatcctaatcaatatgggggaggaccactcatgaaacactaagtgaagagtcaaaatattggacagtggttccatgctaaatcatgacacagaaagtcacagaagggagagctcaggttcctagtgggcctaagtggtcaggaaaggcttcctgcaggagaggcattctgaaaggcaggctctggggctacagatcttcgacagtcttcagtgccgggctggggaccttttatacttttttttttgagagagcctcgctctgttgccaggctggagtgcagtgacatgatctcagctcactgcaacctccgcctcccgggttcaagcgattctcctgcctcagcctcccaagtagttgggactacaggtgtgtgccaccacgcccggctaatttttgtatttttagcagagatggggtttcaccacgtttgccaggatggtctcgatctcttgacctcatgatccgcccgcctcagcctcccaaagtgctgggattacaggtgtgagccactgcacccggcctttttatacttttatagtttactccacaggcagcaaagaatcatggaagagtagtgagctggggaggggtatgttcaaatatggattttacaaaaattactttgggcataatatagagaatgggggagggagatggggaatgcaatataggatataggggaacaacctgggggctttgtcatagaactagtgaaagattatgacagcctcagcctcatccttcaattgagataacctggcttccagtaataggaaggtcattccaaacagtttctttcccttggctcatggccaagttaaggtttcttgggggttccagtccatttaacaaatatttattgcactaggcaggaatggagctagacactgaggatagaactgtgaacaaaacaacattgcctgtcttcaaggaacttccattctaatagtcatctctatggctgcaggtggctcccagggagagaggaaagctggttcaaagttgcctttcaggatggcagaactgggagatactcttagcagtcagtccacacatccccccacctacagccccatggctaataagccatgtgtttcttccattttatcccatttaatcccgatccccagcagagcctaatgaggcagatgttggtgcccattatgcaatgataatgagggggcaaggactccctgggataccactgacaatgacttcccttagagggtactaaggcagctatgggaagatgcttttgaggatcaggtggggagtgtgcagggaggcccagtctcaggaagacggggcagtccctcagtgcctgtgttggtccctaggactcctggggagggctgcaccactcaccaaagcaacactgagagccacagaatgctaatcagactcagacatcaggatctcagacaataactgcgatactgaaaatacacaaaataaccaggcagcctttgtaattaacttccgctcccttccagcagtcatttggagttaatggtttcttaattcagtgctcatttggtgactttaatttccaattaattttgccgattttcctccgaggtgctcatggtgtgatagaaaattcctatatggtgaaatccccaccacagggacctggagtgggtggggaagaaaggggctagggtcaagctgccaccagaagaccagactcctgcctgagtgtcaggaatcagcatctcctgggttcaggaggtccttggggagttcaggggtccatgagagactcctcccctaagagggggctggtgagagctgataaagtggtgcaggggttgaaggtacccctgaatttttctagctctggagagttttgagtcatagtggatggggcaggagaggaagcccagctctcctggaagcatcagggaaggggtcaggaccaagcacagtgccctcccttccatcaagcagaggcatttaagaggtcttggtccagatcccctttgctgggccaatgccctcattgcccagctgctgcagatgtcagctgctatcatctcacagcctcccccttctctagagttgcctttggccagtgagattcacctcttctggaaagttacattacccatggctcgggacatcctgtacacaaggactgagtggtatagacagaaggctgcatcccttctccttaatctccctcccttttgcctcaaggtgagtctgccactgtgatgagctagtgttccagagtggtgcagccagacccagatgaggccacatccttgcttaagtccttccctccctttctgctgccagaactccctcagtaaatcccatgcacctgaatctctgtcttgggcttagcttctggggaacccaaatgacaccaatagtttatatattaaactcttgtcctcctcttgcagtgtgccagaggctgttctaagtcctttactcaaagaaatccatgtcatcctcatagcaaccctacaagctaagcattgttagtgtccctattttgaaataagaaaacagacagcaaaagattaaggaattttcccaggggcagcatagactgtaagtgcagaacaggaacttgaacccggggactctagttccagactctgtgcccttaaccattatgctgcccaagatggaaccactgacctccagcaacttccctaaaggcatggatgatgtaattcaagagcctgagccactaaagtgtgagggagagcttttctccaggtcctttttcagaaggactgaggaacaggggggtctggaatcctggagctctggccccatgataaccaagcactctttttttgagacagagtctcactctgtcgcccaggctggaatgaagtggtgcaatctcagctcactgcaacctccgcccccagggttcaagcaattctcctgcctcagcctcttgagtagttgggattataggtgcctgccaccatggccagctaattttgtattttttgatttttttagtagagatggggttttgccatgttggccaggctggtctcaaactcctgacttcaggtgatccacttgcctcagcctcccacagtgctacgattacaggcgtgagccactgcaccgggcctagagcactcttttaggcaaactttcccctctggggatgctcctgaagatcaatagcatcgtgcaacagacaagtgctggtgagtgaaagtcagacatcagattctagtgctcactgtgtctctgactctctttgtgacttgggatgagtcattttccaccggtgggccctcgcttctccagctctactatgtgaatgagagttagtgacaaagacttgaagagccccagctataatgttttggctttatgaagtggagacactttatgaagtggtccttcctaggggatcccccattagaggatgagaacagatgtccatggaaggcagaggagctactttccatgacctgtgggcatcaatggctctgttcccaaaggattgaggaggggatccacagggccacagaagaacgtaagtcacagtgactgctcagtggccatatatggaacattcattcatcagcaagcacttatagggtgcctacctcatgccagggaccctgcacatgtaactcatgtttccttaagctagggaacaatgaggtacaatcataacaattgccatcaattcattgaccctttccctacttaccattgaaggaccaaccccatgtaaagtcaccccacttccacacacacagtgatttttggaatttccatgggtatctccattgtacacagggataaatattttctgttattaaatggggggtgtgctgtgtccttgctctcccttcctgagaccctcacagtgatgctcactgtctgtgaagtcataggaggggaccccgctgctgaagccttttatgagaaagccatattccctctgctcccaaagctgccagtccacaagtgccatgaagtgtgatggtttctctgacctttattgctcctcaaaggaagaggagaaccccctcagtctcctgaagcagggctaggccagggggacggcagtgagggagggtgaacaggactggtataaatattgcttcttttcttctcccccatcctgacttcctccttctccaaaccttagggataccatgtccaggggcagcttcctcccacagaccagggaggcagggaggtgcagggcagcattccatctgccttcttcccctctgtgagtcccacctacctcacctgcccccaaatcccaatcctcagaagtgtccacagcacagctgctgtcagatcaaaacctctgctggacagctccgctgaggcccttgttggggaactggagctgtcatggctatgtctgccacaggtcccaatccacagctggtaggagctgcaaagtccagccagccaggactggttttttatttttctaatgaaaaataaaaacagacacctttgcagggaagaagaccaaccttactcttagagccagggcattatgccacaaagtggccttgtgcaaccccagggcttggctgtgtgactggaagagtcagccctgacggaagcttccttgctatgctttcagcttacctccactcttcatcttacccaagcacagctatgaccatgcccctctccggtcaaaagccttcagaggccttcagacatctgctgggtgaaatctgaatgggcttcttggcatcaaagggctgccatactctggttctaagccatcttcactcctatcacagattacagccacacctagaaacccactctttcccatacttgccccttgctgccaatcctcaggacctttgcacaacatttgttctgtgtggagcactccacacttccccatctccacctgtagaaactcactctttccctgggggacctgggattcaaggaggaccatggccatgggggtctgacaccacatctgccaatgctctcctctctaattttctctctcctgtctccctgtgccctcattccctccgccactcctttggcttcattttcctggattccatgaacacaattgaattatagtcattaggttggaagggacgcgagagctccatgttctctcacctccacctagatcagtgattctcaaactttgggagaaatcaaatcagctggatagcttgttgaaacatagattgctggaccccaccctcagaatttctgatttgagcggcctagagtggagtccaagaatgtgtatttctaacaagctatcaggtaatgccaatgctgttggtccaaggagcacactctaggaactgctgacctgggtttgggctcagaaattaaccttgtatctctgtttcccccgaaacaaagggtccaatgccagcacacttactctcttggtttggtacccactgatggttgttgtggctcttttatctatctattttttttttttttttttgacagagtcttgcttttcgcccagcctggagtgcagtggtgcaatcttggctcagtgcaacctccgcctcctgggctcaattgatcctcccatctcagcctgccatgtagctggaaccacaggctgtgtgccaccatgcctgcctaatttttgtattttttgtagagacggggtttctccatgttggccagtctggtctcaaactcctgacctcaagtgatctgcccgccttggcctcccaaagtgctgggattacaggtatgaaccactgctcccgggtggatgtggttcttgataggaaggtagggcttccaggcacctgccactcagagccctggggaaagtcttgggtttcattattacaataaattcactgacaagaacacaaaattctttgcagggaaaataatcatagtgattcataaagaaacatactgtaacaacatcaagagtggtaataatagtaataacatgattgtaatataatgtcatcttccctaatgtgctaaatccagattggtctgagcaatataaaagaattactgacatacacaaatgctcagaaagtctagctcagacgtatttggggctatttaggtgatggcaatggtgatgatgactgtaataacaaaccacatttgtacacagctttagtgtttctaaagcactttttaccagttttattttagctgccactctggaaagtaagcgaggtgggtaaagcttctttggttcatacatgaggctcccatgtgttcctcctttcaggcctcattcaacaaacatgtgttgtgtgcaggttaggtacaggacagggtctgggatagggttgtagacaaaatgcaaattaaatataaattcagggttgggtgcagtcactcacgtgtataatcccagcattttgggaggccaaggtgggaggagggttggagttcaagatcagcctgggcaacatagcaagacccccatctctacgaagagaaattttattttcattgatttttagttttttctggcacttagttctgcttcacacaaagaaattttaaaaaataaataaactcaatgcagattcaaatatccattaaaatgaaatttgaatttcagagaaacaacaaatcattttgtagtataaccatgtcagaaatattgcatgggacatacttaaactaaaattgtctgttgttcttctgaaattcacatttaagtgggtgtgctgtgtttttatttgctaagtgtgtggtaccctactggggaaggaaggaggggataaaaagaataagaaatgtttcttgccctcagaacaatctcacagtctggttggacatcacagagctcaaatgattccaacccatgtagtcagtggtctggtagcagcgtttctcaacacgatgcgcacaggtggcacctggggatcttgtgaaactgcatactctgattccgcaggtctggggtggagcctgagagtctgcatttcctacaagtacccaggtggggttgacgatgctagtccctgaccacactctgaatagggacagtgtagcaaggagcaaagaggctgtgggggcttagaggagttgctcagcccacctttgggggtcagggaaaagcttcttggagaaggtgataggtaactggtgggtcttggctggtaaacacttggggagggaggtggagaaagtgtcccaggaggaggaagcacgatttttggagtctcagaggtgtgagaaactactgcaaatctgggaagggtgtgggtgagtgtggatggaggctagatttggggttgcaagcagtgctggagtctgggcatcagaaattcatcagacagatggggtccttgtcatcacagaccccaccaagcccatcaagtggcagagccagggccatggatagaccagcaccatccagtgtggccggggatgaattggaaccaatcactggagtgggggagcccagggagggagccatgtactctgcctgggagttggagaaggtgtcctcctgcgcagcagggtatttggggacagggtcttggaggtgaaagggacttttttttttttcaagggctgagaggaagagaggtgaatgtcttacaagaggggccaaaatggagatgaaaaagtttgctatgtttcggaagagtggcttccttgaggacagcaaccatgtcgagtccttcttctctggattcccggtgctcagcatgaggctttgtcagcatggggcagaaggctagatcagctggcaaggtagcccagagcctctactccaagccctcgttcattttgctttatctctccacaccatggtcagaacatcagtggcggaggaacttgtcatactggcagacttggattcacggctggggttctggaatctgtagtagttaaacggtcttggagtacttcagagttagcagagctggggtagtcactctcataaggcttgttctcatcttcttagggtttatcacagcacgcaggacagattgctagtgttcttctgcgtccgttctctccctcttccttggctaaatagattgcctgcattatagatgggtacgtggcatctcagaacaaaatctacatttcctagcttccctcggtgtggtcatggaaccaggttctggccagtagggtgtggtaggtgtcacttgagaatcagtctgggtgtagcacaggaagaaaatactattctaggtattccagacagaaagagatttaatagagggatctggttgcttacaaattccttggcaggactggaagcatgaaggttgtgggatgttgttagcgtttccagtcacatcacaggagctacaaaccagaggtcaggaagctccgggaaactgctgccaatgtcatagccacccccagctgcaatgaggccagacagtggactggaggatcccaggggccagaggctgcaggccaggtgcttctgccgcctaaggcagaacagcttcagccatctttctcccttgcaaatagcatgtgagtaaagctcattggctggaactagtgacatccagaatcctggtggcaggagtctgacaaacacagtactgaggcttccaggctctgtaatacagtgaaagcatagcaggcggggagggggagcaggctgaatgctacctggtgatattcactatcactccttcttgccagcgggggtaggatgcagtggcaaggacaacttcctaggatggcagagaatcatggtagcagtcacagaaatgccacccaggctggacctttgcatagataagaaataaacttctaccttgttgaagtcaccgagcagctgagcccatgtcctgtcacaccgctattaagtgtaaaatgaggtctgagaagtgttaatactctagcgtgcatcgtgttgatgttactgtagtttcaattgaacctgcccatcaggagtgcagcaataaaaactcattggcagacaaagcaatattcagggctgtgtgtagctgttgccaaatgagagccattgagtctatgctgagggaagctggagagagctcagaggatacaggggtgttggaagccttcctggaggaggcattgctggagatggagaggagaaaagctctccagtggaggccatttttctcttctctctccagagctgtatcagccagggagctgccccaccctgcctccaaccttggcctctcctggtcaaggctgtgaaaggccaggaggagggtggcagggtgcctgcggttaaccccgggagcagactcttaagctggggcaggatagagaccagaaggatggcctgggagatggggaggaaaggagaggttcagcattgctccagagggagaggcccgtgactctgagacagttctcagctgtatctacaagactctgaggacaaagatggggacagacacattcaaggaatggcctcaaggtcatgaagtggtgcctgattctgccttgccccctgtctcgtctgccttgcagctcctccccaggaagaaacactattcacccttcatacagggggcctcaagtaggcctgtgacctggggaacaagggccgtcctatgaacccatgacaggcacagggctagggatgcacccaaccagctattctctcttcacccatttctgtgagaagtaagtgattaggatgtggggatagacccaaactggccagggtcagggccgagtttcaatttatgaccaaggtttagactgttcaggatgagagagtggtccagggaaggatcagagattagacagccacagggaccaacctgtggccacagctttgtctgtgccagaaccatggttcagtctagtaccggagtctgttttttttttttttttttttgagacagtatttcactttgtcacccaggctggagtacagtagcatgatcatgactcactgcagcctccacttcccaaggtgcaagcaatcctccctcctcagcctcctgagtagctgggaccacaggcatgtgccaccatgcccagctgatttttaaaaattttttgtagtgatgggtctcactatgtggcccaggctgaaggattcacttttcatggggaaagagtgtttaacacagtggatgaattcaatttcattagttcccttggtaataaaccaaaatgaaaggctattataagtgtgatttattcccttatatcatagttaaccttcatttcacttccgggggccctctttactcttccccaaaacttgtggtttagaccttctgacactttggtagaagaggatatacagacacagaggaggaaaacgagctgcctgaattctcatgcaacttcagaaagggctagagccaggcgagaagccagttgagcaggtgcccagcacagggcagcctggtggactcacagcttcctgcagtgttttggagacaagccccaggtcaccctgaaacccatgggcaggcagtggacaggcaggccgacagccggctggaggagttggcagcagggaagtcccggatcagagccttgggccacagccaacgctgtctagttggggcagaggatcggggtggcgatttattcagcctgctctacagacagccccagggcaggagccagcaattttccagtcctgagtgatggagccgggaaccactgagtggcctggaagggcagggacccccccaggtcctcgtgggcatgctcagctgctgaaggaaatatgaagtgatggtaagtgacaaaattgaaaatgtaattaagacagatggaactaactggcggggatgataaaagccattccccaggctctgggatttaaagtgaggtcacaggatgaccctgtcctggccacacatctggcaaagaggaggcgagggaatgagcttgaggacaggagccaagctctgtggaggacactgagcaaactgggcttttgccgcactgaaagagctaggtcagatacaggatgaacttcctggagaggagggtggttaaacattggcataagtgagacatcttctccttttcccaaggacatatatatccctcctgcgcagacttggacacaggaacctgggcaacctgaccttgccaagatctgtgggaatgtgaaatagctccattaccaaatgagaaggctgcacaggtggaggtgggtggcatttgggaagagaacaaagggaagtgggctcaatgtgtagcaagccccagacagcttcctgctggccagagctgggagagtaggagtcagccaggcaccatgcaggtgggtatcacagaggcagcagcactgaaggagaagaaagtgtcccttcgagacctcctcacgaagagttgcaccaggagtgagggggcatggtggccactccctgaatccacagaagcagcagccaggcagcctgaccccaggttctgcaaggccctgatggagggaaaccaagggcccacaggagagcctgtgtagaccctcacagggggtaggatggctgggatctgtggcaagattcatgcaagaatcagggagctcagcaccgacatccggggcagccttgctttgccaaccacaatggagagagccagtttagcttcaccatgatggattgcactggccagctttatcagcccccattctttcaatatcctgtgccagttccccatgacaggcaatgggtgggccaagaaagtggcttctttatattcagcgagctcccagattggcgggaaagaagaaactcaggctcccattcaaggcggtcattcactccccatttgttaagcacctgctctgtgctaaacaatagcagggcagaggctcactgtgatgcttaaagcaatactttaagaagtttacagtttttgtatgaattaaaatatacgaagcagtcagatatgaaggaaatacttaggtattcattcaagatgatgtgtggctcacatggtaagggcataggagctgagggaaggaagaatttggtgcaggctggagaagtcagtgcaggattcttagaggaggcagagtttgagcctagcctttgcaggatgaagaagagtagcttaaaagattaaagaggagcatgcatcttgggtgggtttaatgcacaagtaaatatgtagaggtgagaaagagtattcaggaagaattttctgaactttaggatagaactaaggttgggctggaaaatagatccttgggtgatcccagcagatccaaggccactctggggtcaaacatttctctatgagaagagcttgtgcccggggatgacttactgtccccaagtggacagaaccatcagcaggaggtcagtcccagatctgaatggccaagggcttaggcttcccccgactcttgggtctgtggaacagctgtcctaaaccccacctccccaagccacagaaaatgaagccagattggaataaaggatgcccttctgctatgctgatggcgagggatcaatgtcattctgcacccttcccccaccacggccaagaggtggcaagacgcgtgcaatgggcaaggagacctgtgctccatgtactgtccttccaccaggagctggaccacgggctcctctggctctgaggctgatcgtgtggtccttccttgccatggaaaaagcaatggagacaggttggtcttgccatctgcggaccatctttcattataggacatgtctttgttatggatcctgagcatagaacaggccagcattatctgagagatgggagagatgctccgtcacttcaagcacactatccatctatctgtcatgggcccagcatttatgcctgcagccaggacactggaatagcacatcaggatttatggggggcattaagtcataatttatgtcactttctctcccttttcaagacagtctttctgaaacatctctgtctccctggctcaccattcctaatgacccaagatgtgtgtttcttcccgcctacctgcagcctgcttttgggggtgctttctctgttacctccccaatcccatgggtcagcctcttgctcttagcaagtccctgcccctgacctgggagaaaggatctccagaagtgtaaactagctgataaggaggagacaggcccctatcctggtttgctgttggatcccctgaggatatgggagttccagaggcgccccaaatccctcacccgtgatggctgtaggggagcaaacagctattccaagtcccaggtgtgtagccatggagaaatcactttcttcactcgggtctttcaccttctcctccacaaacaaaggggctcacagatgacctgtacaacttctcccccctctaaaatggaggaaccacatgtcctagacaccttcgctcattcagagctaagcctggcaaagggcaggcattctactgttccagagacaagtcagagccaactacggaggctgggctgtgaagtgaatgctcctagtcaccctcacgctggagggatcccagtgggagctgttcctttgcagggggtgctggggtgccactgctggctttacctcccaccttttcctcggctctcttatttcattcctttcccttccttcctcctttcctcatcctctctttcccctctctcttctttctcatctgacttatgtctgcctggaactttgccaccctgctttaccaccaactgcttacttcaaaccacattttgccggaccagaaatagtgccagcattgaccccgacctgagccaagatttgaatcgaaagccccagtccttgaactctgactgttatcggctgatttgtgtcctctcaaattcacatgtgaagccctaacccccggtacctcgaatgtgactgtattcggagataggatctttaaagaggtcattaacgtggactgaggctattagggtcggccttaatctagtctgactggtgtccttataagaggaaatttggactctcagagacacaacagggctgagcacccacagagaaaaggccctgaaaagaggcagcaagagggcggccatctgtgagccaaggagagagacagaggaaaccacccctgccgtcgctttgatctcagatttcagcctccatttcagttgtttgaggccccagtgtgtggtactttgttatggcagcccaggcaaactcatccattgacactgaatgaccctggtatctgtctcagtaagatatccctttgggcaggcagcaatggtggagaatcattcttgatccggagcattgaacattgaatgttctcagaaactgaagcactttcactccgatttcctcagtctgcttggcactattctgaggttgtagctggttctgtccgaagccatgagctgcaggggccctttcagaggcagtggtcatgtgataaaatcgtatgatgtatgtctcgacataggaaaaaactgtgtggctccaaacactggtgttaataaaacagtttacatggttgtgaccaagtagagactcttttgatcagatatatacatcatatatatatatgtatgtgtgtgtataatatatattatatacttacacatattagaatttttaaaaatttttaaaaatctgaaatatattcacatggttcaaaagtaaaaagcataaaaggtatatagtgaaaagttttctttcactcctggctaagattcacccagttcccaccaccctctgacagaaactcctattaatctcttgtgaagccttctagagatttttaaaaaatttattcttgagacacggactcactccattgtccaggctggggtgcagtgacaccatcatggctcattgcagcctcgacctccctgggctcaagtgaccctcccaactcagcctcctgagtagctgggactacaggcgtgtgccaccatgcctggctaatttttacttttttaaagagatggggctgggcgcggtggctcatgcctgtaatcccagcactttgggaggccgaggcgggtggatcacctgaggtcaggtgtttgagaccagcctgaccaacatggtgaaaccccatctctactaaaaatacaaaattagctgggcatggtggcacatgcctgtaatcccagctacttgggaggctgaggcaggagaatcgcttgaacccgggaggcagaggttccagtgagctgagatcgcaccattgcactccagcctgggcaacaagagtgagactctgtctcgaaaaaaaaaaaaaagagaaagaaaaaagagaggtggagtctcgctatgatgcccaggctggtctcaagctcctaggctcatgcaatcttactgcctctacctctcaatgtgctgggattataggtgtgagctaccacatctggcctagagtttctgtataactgtataagcaaaaccaaatatttcttcatacttccccctatttttcacaaaagttagtatcctatacacactattttgctcctttcttttttcacctaatgaaatatcctgaagacttgtttatttcttaataagctccctcattcattgttcacagctgcgtagtattccattggaggatttacctacaattcaaaatcctcctacctcctgttgcagaaatgcataacataggaagttagactcactcaagtaccattgtccagaggaagccactggtaacaagatgatgcatttttatctgactttttaggaatagtcattatggtttttcacagaaaatttaaagtaacagtttctaattcctcgtaactttttaatgatgaggtttaaaaatttttcttatttaaggctcaggatgcattttaaatttataatttatttctatatttaatcctgtcatcaatcatttattcttataatggttttcaagtactatgtgtagaggtttaatattatcacttctatatttattttaacacatataattaaacatataattaaatgtatattatatgtaaaaaaatcttcctgcatccaaatacattttgaggttaaggagagcatatcttcactagaggatgtctgagataaatgatcagtatgactcactgcaggggatctcagacttcggcttgcataagaattgactagggatgcataagacaccccccagccccaccacaggattctgacctcagtagctctgagatcagaccagtcagctgcactggagcaagttgattctgttgcaggcatctacagccctctctctgaggagccctggtcaatgggaaaggaagttaaactacatcctgcactgaaaatattaaggttgttgcaattaatcattaaacttagctctcaggtttctggcagctcagaccaaagtagaaccaaaaggatgtagtgttcttctccctgccagaacaaaaggccagttcttcaggagacataaatgttttcctgacattaaattctaagcagcatttatcatgggggtcattatttgagataccctaagctacacaatgggcagcatcttcctcaacagccccatggaaaacatagacacagtcgccactgttcctctgcagaagtcatggcccatccctaaacccagctcaggacaaaattctgcaggaagctcagccaatgtgagccagaggcattgagaagactcaggctacctcagagtaaaagtataggcctcttgtgacaccgtcaggaaatctgaatggggatgctcaatgtgaccgagagaacaccaaggcacaccccatacctatggcttctgaactcaagggaagacagggtctctgtccctgaccatgcccagtgtgaagaaggaggcctctcaccttaccttaagaagctcctggaacaatgtggcaggaggaaaaggaggatagacagctgtttccccattctcccacctaaagctttgagtattttctgaaccttcagcaattggggccactctctcattaagcatacagttcaggaactggaacacggtaaatattcatgaagagagaggggcagtaaccagtgtgttccccatcctgctgttcctaggatatcttgaaaacctctagtgttctatggattccaagggacaggtggaagtatatatgcctaatatcctaaacaaggtcctcaaccccagccactgtgtgcttaaacttaggcaagccaagacattgtaaagcccgttcttcctctctctcttaggctctccctcattccaaactggagaatgaccttggactcctgattgccaacagtatgttcaggaagctatgtcactgaggctagagctaagttgggatagatgactgcatgcctctggggtgcattcagctgatgaaatgaggcctgtgagccaggacagatgcaagaaattattgttcctctaagatggatgagaccttggcaatgatggtggagactgctggttatacaccaaaatccatcctccccttcttccataatgatagagttgtagctagccacgtggctgctcagctagggactatgcttcccagccccccttgcaactaagtatggtcatgggaccaggttctcaacaacagagtgagcacattatatgccatttccaggcctgcctcacaaaaccttgggaatgtgttctactgtgctcgcttcccatgagtccaaactcagataggcctgggccccagctgcaaccaagcagataagtgcaatgccctagagcagtggttcttcatctttaatgtgcatcagaatcgcctggagaaattcttagctcatggatggctgggccccagcccaagaatctctgattcaatatctctgtgggtgagagctaagaatttccatttctagtgtgctccaaggtgatgctgatgctgtcggtccagggaccacactttgagtagcaagtccctgagttacaacagagggatgagatgaaaatcacctccatccctgaatgaccacatggagcacagcctttgtacacccagaatgttcatcttggattgatgtatcagactgtcttttttaaagcaactgagttcttgctgggtctctatggttcagagctcaactttacactaatgaatacagcagtcatctagcccacttgtttaaatacagaaggggatgctggggtccaggaggaaaaggacctgcccaaggcggcaaacgaaaatgagaacaccaagctccagctcccaaatgggagcctgagccccgtgtgtagatgtgggagcactacagtcccttttactcggtgtgagaggtagaataataccccccattccccggccaaatgtccatattctaatccctgaatcctgtgaataggttaaatgatgtggcacagagaaaatgagattgcagactgaatttaggttgcccatcagccgactttttaaaatagagaggttataaagtttggcccaatgtaatcataagggtccctaaaggtgggagaaggaggcagaagaacagtccatgtcagagtgacacaatgttagaaagactcagttggccactggaggctttgccaaggaatgtagcagcctctagaagccagaggtgtcaaggaaacagagtcttccctggagcctcctgcagggaacacagccccaccagcaccttgatttcagctctgtgagccctcaccagacttctgatgtcagaactgtaagaatattaatttgtgctgtcttaaaccaccaaatttgtggtaatttgttatggcagctacagaaaactcctgtgtgaggaaactgttccctgtgtgaggcaggtctggcccttaggctgggggccttttcttcctccacctcccccacagcacctggctcagggctgggtcccaagggatgggggagagagaggacacacaataaagcatgtggatagggacataggtccttttccccaaaaccaaagggaaggaatgtgcttgtatcactctttgggatgcaccctgatatgatctggctctgtgtccccacccaaatctcatcttgaatggtaatctgaattgtaatctccacgtgttgggggaaggaactcatgggaggtgattagatcatggaggcagtctccccatgctgttctcatgatagtgagtgagttctcatgagatctgatggttttataaggggcttttccccgctttgctctgcacttctctctcctgcagcaatgtgaaggaggacatgtttgccatccccttctgccatgattgtaagtttcctgaggcctctccagccctgcagaactatgagttgattaaacctctttcttttataaattatccagtctcaggtatgtccttatagcagtgtgagaatggaccaatacacaccttatctcttataactaaaccctcactctgtccaagattgaacttaatttagggcccagcctgagtcttcactccagtaaacattttggaaaaatatgttgacccctcagggggaagcttagggtgtgggtggcacaaattggccctgctcccatagtccagctcatcaggtcttatcaaggccactggggactgggggagaggcagaggctgctggtgacagggcaggctcccaggcaaggggggaagtggggaatgagagtcctgggggaaagaggggaaagggtgaggatgggttccaggctcccactggaggcctcagtctttggaaatcttcagaaatggcaggctgtgggggcagcttgtaagcccagaaagggcatttgtcctctgggatggaagcatcacttttgaccaggtcctctgtaggtctggaggacctaagaggtggtctgaggacactgctgagtgaggggttgtgcagttgaagaagcaaatgtctaccagtgtgagggactgattcaaaatcttccctgggcctcccagctaccccgtttcccaaaaggagcccgtcacctcactggcactcctctcacagagctgccctgatcccacagtgagctgcaagccctccccaggtgcttttacccaggaaggcctccctgactcccagcctgccttgatctccatgctctgaccccttcagccctgccttgctgcatctccctgctccctgggccacacccctgtctgtccactctaacaggagcatcctgagaacaaagccctgtttcttcctgaaaataggcacttacattcaagctggaagacctggaggtaaaggacagtggctgaggatgctgctgcaggtggcatttgctggtaaactataaaggcaagttaggggctcaggaacccagagccaagtgcaggagcagaaattaggaatcctgggatggagactcagccttgactctgtctcactgtgcgaccttaggcaagtgtttttacctcacctgcagagccttactttccttatctataaaataagaatattcattcatacaagttcaaccatggggatgatttttggggtggggccttaaaaatgtaaggaattctgattcagctttcaaattaggaatagacagagggagcgaagcctgcacacctggttggatttcccatccattctgggctagaatgagggaaattatgccaaataagggaaatgtgaattaaacccaataatcctacactaaaataaagttctgaggcttaaagaggctggaatgttgtggccaagaggagagaacattagaaatgtgtgatctatccatctggccaaacagctctggggggaagaactgcatggaatggctcctgagagcaggccaggcattgttcagatcggaaagaacctagcctgtcaatcatttacaatttggtgtgaattctgtggctggtctatccctccccaaggactaacctactagctggaaccctccaggcaaatgcaagattccgtctcctagtaaaagactcttgaaactaccaccttaactatgaaactaccactttaactgctctttcagcttgactcaaacacctctggattccaggatgctggaatagtccatcatgcccttccaaccagggtaagcagagaatgcccctatgctggtgaggcagtgagttccccaccccctggggagttcaagcctaggaatagccttctggagcttgcactgacaacatgcaggctccctcacatttttgaaaggctgagattctaagattctgtgtgagggacaaacagacagggactgtaaagccctattcccctttccccaaaggtgggtgtcccacaggcccccctggactccctgaaccctttgtatgaggtgacattgtgggagaacaccaggctataggcccagcccctgaagcttactctccaggccctctggaaaaggaaccgctaagcagcccccacccaggtagctggtctacacagccttccccagccctgcccagtcacaagcctgagaatgagtccaggtgcagaagaaggctcagcctgggtatgcctctgccccatgccaaaactctcaaactgcaggtggcacatttttcttcctttggaaccagaaggaactggcagcttctctaccattctggcactgttcggatgaggattcatgccagaaagggctggggtagaaggaagaagatgagaagggcaggaaactaggaaggaattaacatttagagagcttctcctctgtgctcagaactgtgggggcactttgcaagcatttgttcattctttcaattacgaattcattcacagattacttctacagacacatagtgaacatccacatgttaggcctggtcctttgaggacctgcctttgaggaatccacaggataacaaatgctatgaagtttacttcatttatttattttacaaaatccgggagagacatattatttttcccacattacagatgaagaaagggaagatcagagaggttaagcaactggcctaaagttacaccattttatgtggcaaaggtgagaagcagaacttggttttcaattctgttattaccatcccttcctactgtgtgtctgtctttatctttaaaatgggagtgcagctccttctttgcaaggtgttgatgaagattagatacagcacatgttaaccactgcatgacatgggtactcaataagcagttcatgatgcagtgtctcttgtggctccaagccctctattctctcacttcctcacatggtttttggagacatgttgctatagagctggacttaggagttggggaagcaaggaagcaattaagggcttgagaaagcctgggtcctgtgggaggcagtatatttatcagtctgcctgataattgagcaccagctgtgtatcctcgggatctgagaaggagatggaagacccagaagatacaacccctaccttgtgggaattctcagcatggtaggggaggcaagattgacaaataaaaacaacataggagagaggcccggctgtgtgctcacagtataagtgctatagggacccaaagtgggcatggactatcaggaagcttcctggaaaagggcaaatttgagctgggcctccacatgttctgaatatgtgaagagcaggcagctgataagaggctcataagcaggccactgggttccccgtttttaattttgaaataagtgtagacttcaagaagttgcacaaatagtacaaagagtcctcaagtacccatcaccaatcttcccctagtgacatgtgggaatgtggggatagctgcagcacaatattaaaaccaggagattgactttgcataatatgattaactaatctatagatcttactttgctgttaccagttttttgcaggcactcttttttgtatgtgtatatgtatagttctagaagtttatcacatccatattgccaccactacaatcaaggcatagaatgactgatcaccacataggagttccctctagagcacatttttttgtttgtttgttttttgaaacagggtcttgctctgctgcccaggctggagtgcagtagcacagtcacaacttgcttcagcctcaaccttctggactcaagcgatcctcccacctcagcctcccaagtagctgggactagagactaccaccatgcccagttaatgtttgtattttttgtagagacagagttttgccatgtttcccaggctggtctcgaactcttgggctcaagcaatccacctgcctcggcctctcaaagtgctggaattacaggtgtgagccaccaccccacattgaatttaaattgcccacattatgccctgcacaggcactaaggatgtgtgcctgctcatcactctaggaaagcctacctatcccatcttgctctgcacaaagaggcctttccagggaaagcaagttggtgactgagtgtccatggagagatcttcctcggttgcctgaagccccctgcacaaaccctctgtgaagaggctcaccttatcacgttcctgcagaagaagaaactgaaaccctgaagacctggtcctcccaaggtgagtcttgaacaagctccttgaggttcagcaccacggacagatccagggcacaggggaagacaaagagtgttcataaagacaagagagagggctgggtgcttctctgggtcacctcatagtctggagatagagaaaccctaagtgagcatatgacccactgcccccctcccccaacaaacaagggcgcagggcaaggaagaggggtgcatttcaggagagagatccctgcttgcctgactcttccccattattcaaagcttatcctcaatctcctctgttctgagaatctctccttgactttcccaccttgctggctcccttctctgaattaatttaccccaaaagctggcagcaccatccaagacagccgggagcacatcatgtgcttttctctgcctgctcccacatatgaagccgcacccccagccagaatgtgaaggcctggaggaaagaccaacttgtccttcacttctctcttccattttctcccttttttcttcccacccaatgtagctccacacagggttaggaactcagggtctttctgggggacttgttagccaaggggtggctctgtccttatttgattcaccttccagaatcccaccttggacatcttttctgcctggcactattggggcagggagcagagggagcatattcaaacctcagtttgccttccagaacttctcagccaagcttccttccccttttcccataaactgtaaggcccttgccccttgggaatcctcattcacggtatttttcctggaattatctgtgcatcctggagttagcctcaccaagcctggagaacaccatccccggccacctccccactggcagcattatcatgggtgccgtgctgcaccacccatatgcccccttcagaactaaagggcttactctcccagctgccaggaaaacgattttttgacgcttctcatttctcagcccctctgggaattgtctcagctgaagaaagcatccatgcctaaggtaacacccccttcccagggcagtccacatccaatgacagggtattagggcccagctccctcaccccactctgaagggtcctcccaacctcagagttcctatggaatcattggaggctctcatgggaactgcattgctgcccaacttctccctctgcccaatcctgcttcctcccctcccctacaggcattggtcctgagaccccttcctgatgctttctgcatactagttttctcagagtatgcttccaggggaacccaacctctgacatctctaaagtcttggccctgtgggatgagggttctactagccaccaggctggctactcagatgaggcccaacaaggctgagtggagcagccctgtttattaatttcccacaactcttcagaaagactctgttcactccacattctatgacagtcttcagccttgctcttagaagcagccctgccaccccgaggtcctctgggtcttctggcatagtgaaacaaactctgaaggcaggcagatcagcctccagtgcctccaggtactaggtaggtacccttgggcaagttccctcatctccccgagccactgttcccagatctggaagcagaaatgataatgaaatgataatgaagacatcatagaagtcatacaacacaagtaaaaatgtttacaaagcacagttcctgacatataaatatgtgctcaacaaatataaattcccttcccttcttttgagtctgagggcattttgtaacaaattgccaattaatatttttaatattgaaatatgacattttaatagtattgagtatcacaagtgtaatataaatctatagaaaacgttgcaaatttttcatgtgatggatcagggaggcaggaaggtggtcattcaactgaattctccctgtatactggtcttcttcttcacatcattggaaaattcttggcatctaaagaggattcctcacagtgtaaagactatcaggtgttttctttgtatcctaaagggaaatggagcccaagcaggccacctctatacctggctggagcagagaatgtgtccccataagaaagcagaatcagcccttcttcctaagcaataggtaaatggattggagaggaggtggtaccttaaattatggctgctttggccacacaactgggtgctagcatctggaagagaggatgtgagaagacaatcagcctgttaagagagttttatgaaagtataagttgtccctaaaataacaacgctaagtatccaactctgacaatgatctcttcccaaaatgcaatgatcatccactccctgaagcatcttcctgctccctcagacttacttcccccaaatccttcttcccctctccccaggcaagctggagaagccctgaccaccccagaacaggtgctgctccctcactgtggcatctgtggcctgggtgtgtagagtgggagctggagggggcttggggagcccagggagggaagccacaccccgggcacacattttactccagctgggccttttctgacaaccttggaccagcacacagctacacccacacacaagcactgggctcagagagtgctgaattcagccccaattaaagggccatctcagggcaggctgccggcaccagcagctgctattttgggactcagtgaaggcagtatcttctctgttgctctctcctccatctcggttttatttttctcctctctctcccttctccatttccgttctctctcttggattttctacctgagtatgcatttcttttcacctctcagctcctctgtctctccagctgcccccatctctgtggctggatgtcactctagatctctcttatcaaatcaacttgacacatacttattccccgctccactgtaccagaccctggctgggctctggagaagaagcgatctgcaggtccctgactttgaagagccctgaagtgtggtctgcctttctctgcttctctctgcccatttctgcatcttgacctgccctgctcaccctgcccaggaacccaaggattgcttctaaagtccaaagagaggattcacgttccagccgtcctatctgctggtccacttgcagtttctgtacccccgggttctgtgccccaggttcccagtcctggctttagaggctggggacttctctcttcctcctccaggcttccagtttcagcaggaaaagaagggctggcatttccagggtgaatctgtggcagcaacggctctagaatgtcccagaggcccacggccaggcctccccaccatcctggccccaaggagacctggccctgtgcctgcagcgtagaaccatttggtctcccttgtatggtgattttcactgtaatttggtctccaggtctgtctcttgagattggccataagccaagatagctactctccaggagagccctgaaggggggaaagttaggtttgggtgtgtgagacacaaagaagaaatgaaagtaaaatgcagaaggacaagaaatttattactctgaggtcccacataggttaggggtgtcaatggtgtccaaaggaagtccaaaagtgacagggagttcaacttggggcagggggaagagagagaaagaggggacctgtgggactttgcctttcttaaagccttagcgttatcatttgggctttcccacaggggttgttgattggctggttcagagaaaagatacttgaaggggggactcatttacatgactctggtgttgaccattaggtttcatcatggtcagaagctgtgggatcagcggtattgggtcagtgggatgaggaacaagcaggctatattgcaaacaactacatggggaagggaagtgttttgggctttaaataatttatattaaaccttaaaatggatgctgagacatcaactacattaaaacaaatttatgacactgggtcagaccagcaggccgtgctccttgtcagtcgagagattcaggattcatagaccaaagcctcttctctgtcttctccttctcattccagaggagcccactccactatctcctgccccagcccctgcagccctggtacactatcctgtactcatgggaccaagctctcccaccatggtacctgctggctgggtttaacctgactgtgctctttgacactgagtgtggagtaggggctgataataggacctgcctgcaaactctccgaggtccttcccctcaatggattcccttcttaggtttccccctgtactggaaatagggggtacatggtaacgtcttatgggtattattgaattaataaatttaaaaacttagccagacacatgagtattttcagatgtattgtcttattcaattcatagaccagtcttattaatctcattttagagttgcaagaacagaagcccaaagaggttacccaaagtcaaatcaccagggctagggtaggaagccaggccccctgatgccccagtcagggcttgctctgaaacacagctcttgcctgtaaataaaagaaggggaaaaaaacacttctacacagcacagttcttcctcagagagttcttcatctgagatcccagggcctcaatgtccttagcagctgcttgagagatagaaccaactcttcaggagagacagtacaaggcacccgcacactgagccagactcaacctggctgggacctcggcagagcagagaagccctggctctgggccagttgggcacagctggtaacaagttctcagtcaatgggagcccaggggcgagaggaagctttagggaggaaggaatgttctttgaagtggtgtcaaccagaggctcagaggtgaaaacgtcaaaaactcccaggtggccggcaggactgagacccccatctcccagcaggaaacaggaggctggcttggcggggccacctttgaagctccccaggggacggacatgccactcagggcctccctggtgaacaatcatgcccctaaggcctatggcagaagcggcctctgaagccggctttggggctggggaaagtactgcctgtctttggtggctttttcaagctcgccctgctctttttcagcagtaccacatcagggtgtgccagacgaagaggaaggaggtggtggagcccaggtgtgccaggctgccctggcccagagttgccgtgcggagtcaaggaccccaagcctgttgggaccttgacctctagggacccctggctctaggctggcctgccccatatctccctgacttctaaccagtagactcccagagccagccattagactccaggggacccccaaaccccgaaccctgggccttgagtgccatatcctgcaggtcaccaaggcctgaagagttggaatcccttctctaatccactctctcttcttcatttccagcacctctgctggattctggccttcctcatctcccctggactgttgttgcccacgatctggcttctgttctgccctagccacccagagccggctctgacatgcagatcaggccctgcagtctcacattcttgcttctgctcatccttcacccgacacccagggctccatgacttggctcctatccacctctccagcttcctcccacctctgcctccaaggtgccctcctgagctcagctgcaggcagccacggccgctcctcagacatgtccacctgttctcaccattgtacctgtgccatgctgtccccagctacgacagaatcctcccactctagcctacaggcactggtctatcttaactttttactcaacttctagacttcattccagcttcaccttctcagaaagcctttcctggaggctgggctgggcctgtgcctcccttgggctgtctctgtgccctatgtgcctgatctcactacttgccatgctggactgtcactgctggcaggtgtgtctcctacaggaaactgggcttcacggagggcaggggtcatttccaagtcacccatgtggctccacaacccagcatgtagggtgataaatagacaaccctgtaccagttcccaccatctggttgaggcagacatacacacacatgcacacacacacacacacacacacacacaaactactgagctctcacaggattgggtagtgtaagctcaactgagggcagagtcagcaaggagggttcccttgagaaggcaggatttgagctgggttcctttgagctaggttccagaggcatgctctgcacctatctggggatgtgagtgcagacacccgagccaaagctgggtggccaacgactggtggattgcattgcattgatggcccagtgcttcctgctccctgtgtcctggccctctgcggtgtgcttttgtattgtcctcccactatgaacagaggttacgtcactacctcacccttgagttgacccagccatgtgacttcttttggccaatgggatactagcagacatgctgcaaacggaagtttgaaatgagctttcacattggagcctgccgtcttgtgtctgtgcttttggctagcttaggtcagccaatagccagctgacctccagagtgagtgaccccatctgagaactgaagaatcacccagcagaacccagactaaatttctgacccacaggataataagttaaatgaatattatgttaagccactgaattttggggactttgttatacaacaacagtgactgaggccaaggtgaccagccttttgaagggcaggctcatccacaatggttcccacgatgggctggccatctgaacaggaccatcactccttcagcatttccactgccccctctgcctcagccaccttgggctctacgagacctcacacatgtcctgtgtctttacacaacctgttccttcctcctggaagacccatcctcatcttgtcctctgaatcctgttcactctttaagaccagctcataccctgaaacctttgtaggttcacagcctctctgccaccatcaatcttttgggaatgaagtaaggtataagtgagtaaaatccctccccttctgtctcctgtcttcctgtatccccctttgctctgctggtagctttattgcagcacatcccctttcatagttaccaacccatgccgtggctcctgaacactaagtagggaggaaggcccaactgagagagtggctctcacgtaatcctgggtctccccaagcctcagcactagccgggtacccaaaagtatcctgggagggggcaatgaataaagatgaacaaactttccatctactgattttagaacaatgagacatggtactatgtaaaaaacccacattgaaattcaaagacctgttttcagtccctaccttgccctgcaacatttgccaggggcttgcccccctccgagcctcagtttcccatctgtataatgaggggctgtgctgactcatttcccaccccccccgccccccccacccccgtcagggctgagcatctgtggagtgtgctcaggtatccggtcctccggttgccagctctggcctggttcctcactggcctgggttgtgtgacaaagcttcccacctgccagcagcctggccagtcctttggatagtggtggctaatgagctggcctgggttcttttgactgccagcatcttccactttctgaacctgccagtgggataaggaggccttggtgttgggagacatctcttctgaaagctctgctggtcaaggctgggtccctgcctgtctgattggggaggcctggccagtcttcaggaaattcacacacacacacacacacacacacacacacacacacatcatccaaggctctctcctggaagcttctgatgggctcctaggaaggaatgctgactggctgtgtcttcctcccttggcatcccctagagtcaggtaagaagaggacagagaaagggaaaatgggccagtgcaaaattaaccacacagagaaagacttttccactccagctcactgaaaaccaggatgaaagatctcagaagctggaatccagccaggttcacacctagggagcaaagcttcctggggtacagtgcaggaagggaggctagatctgaactagagcttctcctccagccagtattatcactgcttactcaaggaggtgggaaagctccaaagatgctcacctcatgcatctccctggcataccaggaagaagcctggggcagaagtccatggtgtctctgtggccctagggtagggctctactgcagccctagggtagagagctaggccactggggcttccagattgcacccatcacagacagtgagcggctgacgcgatgcctctctggctctacctcctccctcgtctacccctctttccagcagataaacttgaaggaagcagggagaggctgtttgtggatgcagagtggctgctcactcactgctctgttctcacactatctcctcgaaccccacccctgtgaatgctagaggcaaagactaagaggctgaaagtccggagccttggcttctagtctgggtgttttcccttgatatctttgtgaccttggaaggtacagtgcttcttttggacccctggatatttcttctgcaggtaagaggtaataactcccactgtcaaatggccgcaggatggaaaccttctgaaaccatcaagttctttatacagatgttttcattattgagtccagagaggtggtccccaatgtgcttgaggcctcactgtcccctctttgctggcctctttgcagcctaggctttgagaaacatggccaggacctggcctctcctccccgcctcatgttccccggccagctgccccagtggtccctgcacaggttcagcacctgctctgagcccatcctggagcagggctgtcaggggagggaccttccctccagctctcttcctgggtacagaaccacccagagaagagcgacaggctagagcaggacagagtgtgagcaggagctgttgtgtggagagtagatgctcagagaagggagagggtggcacagaggagtaaagttcctctccaatctgtctccaaatgcttgtatcttctacagtctatactacccatggatttcaggtggagagaaagacatctttctgacagtgagagttgcctgggagtggtggaaggaagcatcctgtcgatgaggcttttttgctgagtgtgtgggggcttgtgcacacagaaatactatttatagctaccttttaaaatttaataggcaatttattaaggatacacatataaaaacatagctttttagaaggattaagctccacttaccaatcttattgttctatgcataaatgcaataaaataagaacaagaccttcactttttcttcaattaaagtttgattaactcaggttgaaaaaactactcctttaaacaatcagtgccttttacaactcaattaaatttgcttaaacaatttcagctacatttaaacatttaatatatttgattttcctacgtaacttaaatatctaatggaataagcaaaatctttttatcacgtacttgaaaatccattgtaaatacaataaattaaatttataaaaatactgcctgggtgtggtggctcatgcctgtaatcccagcattttgggaggccaaggtgggcagatcacttgaggtcaggagttcaagaacaacctggtcaacatggtgaaactccatctctactaaaaatacaaaaattagccaggcatggtggtggatgcctgtaatccccgctactcgggaggctgaggcaggagaatcacttgaacctgggaggcagaggctgcagtgagctgagatcataccactgtactcccgcctaggcaacagagtgagtgagattccgtctcaaaaaaaaaaaaaaaaagaaagaaagaaaataaataaataaataaatttataaatagaataacttttacattctcttaaatattgcaatactgtttccaaaatttgttacattctcccatacctttcaactaaaaattacatgtctacaggcttctgattacagctaagatggagtaagcaaatttcatcctctctctcccactgcttacaaataaaatccctggaatgaatgcatgcaacactgtttaagaatactgaaaaaaaaataatagcaggtggatttgcaggaaataaatgctcaaagaatgatcaatatgaccgtgagttttctggtattttccctccaatatctcctgacttggatgctagagggcccaaatgccactgcacagtgggcacaaacaaaaaagctccaagaggaactcttccttctagccacaggactgggaacagggaccctgcaggtcagagagtgaccccaattgttctctcttttactctcctgggtatgtcccaaggaaagccccaatcatgaaactatactcctgtaatgttggtagtgcaggatctaaaaccatgaggaaaatccttctctctggtcagaggaattgggaaagggaacccctatgaaggtgtgggggaaattctgttgatttttctttctttctttgtctttttgcttcacccaggaggtggaccccaggcaggggaaatatgcaacagttaggggagggtaaaactccagcgttgcagcacaaagacccggaaaagggcctctgggcgccagagagtgtaagggaaatcgcggtgtgctaaagaaaagacttccttaaatccgtgggtgaagtcctggactcttccttgagcagggcatgtgtagaactgatccaaagcaggtcaggacttgtggtctgaactagatagggttgatcatataatattcaaaatgccccaaattactccatacacaaagaaccaggaaaatctcaattactttcaaaggaaaagataattaactgatgccggccctgagataatccagatgatggagttatcacacaaaaactttaaagcagatattatcactatagttcataaagtaagaaaaaatgatcttgaaatgaatggaaggatagaagctgtcaaaaaagaacctgaaaatcattttaaaaagaacaaaatggacattttgttgctagaaaatacaataactgaaattttaaaaatcacctcagggcttcaattgcaaaacaaagatgacagaaaaaagaatcaataaacttgaaaataaatcaatagaaattatctaatctgaacaacatagaaaaaaagattgaaaagaaagaatagagtttcagggacttgtgagacaatatcaaaatgtctaatattcatgtcattggagttcaatagaaagagaagaaaaggcttgcttggtgcagaaaaaaaacttgaagaaatcatggctgaaaacgtcccaaatttggtaaaaagacataaatgtattgattcatggatctcagtatattcagaaacccccaaaacaataaattcaaagacaacctcacccaaagacatcttaaacagctgaaaaccaaggataaagaaaaaagttaaaagcagccagaggaaagcaatacaatacatatagaggaagaacaattaaattgcctacagatttgtcatcagaaaccatcaaagccagaagacaatggaaaaaattctctaaaatgctggaagagctgtcaacccagaattccatacccagttaaaaaacaaaacaaaacaaacaaacaaacaaaaacccaaaacctttttaaaaggcaaagtaaagatatttttatatgaagaaaaactaagaaaatttattgctggcatgccagctgcaaaagaaacgctacaggaaattcttcaggagaaagacaaatgataccaatatttgggagatttttccagatgtctttctcttactcattttgagttgctcctgtagccactgctgctgctactctcttgaagaaggccacactcccactcaaaacttggaacttaaggagtaaaggaagatgacaaaattataaaactaggtaaatataataaattattttctccttaagtactttaaaatatgtactatagaaagagaagaaaaggcttgcttggtgcggaaaaaaaactggaagaaatcatggctgaaaacgtcccaaatttggtaaaaagacgtaaatgtattgattcatggatctcagtatattcagaaatccccaaaacaataaattcaaagacaacctcacccaaagacatcttaaacagctgaaaactgtttaagctgaaagcaaaagttataacattgtataatgaggttttcaatgtctatagatgtatataacgagtacagcatgaaggagggaaaaggacctatatggctgcaaggtttctatatttcacttgaagcggtaaaatagtaactctagatagaccatgaagaattaggtatttgtattataatccctagaataaccacttaaaaaatacaaaaagatatagtaaaaaaggcaacagagaaagaaaaatggaatgctaaaacaatattcaaataatccaaaggaagacagaaaaggggaaacaaagaaataaaagatttgggacaaaccaaaaccaaacaataaaatggtagacctaaatccaaccatatcaacgaatgtattaagtataaatggtttaaacatatcaattaaaagacagagatagtcagattagatttttttaaaataagaccaactctatgctatatataagaaactcacattaaatatgatatagataggttaaaaattaaatgatttttaaaactaccatgaaactttttttagaaagctggaatggctatattaatttaaagcaaactagacttctaaagaaggaaatttatcagagattaagaggaatattacacaatgaaaaaaggattaattcatctagaagttgtcacaatcctcaatgtatatgtatccaacaatagagcttcaaaacacatgaagcaaaaaattgagagaagtaaaagtagaaataaacaaacccagttatacttggagactttaacaaaactcatctttcactaactgatggaaaagtagacagaaaatcagtgaggacgtagaagacctgaacaacactaccaatgaacttgatctaattgatatttgtagaacactccacccccaacagcagaatgcacattcttttcaagttgctccaatatagaccatattctataggtcataaaacaaaccttaacaaacttaaaagaattgaaatcatacagagtatgttctctgattgtaatgaagtcaaatgaaatgaacgaaagagagatatctggaaaatctctcaaatactggaaattaagccacacataaaaaattcatgggctaaagaaaggtgaggttgaggagctgggatgctagcctgggaagtttgcccatgctcttaaccagtaggccacatggcctctcaaggtttttcggagccttgaatgcccagctaaggactttgaaatttgcacttattcaatggataagcatttaaggattttcacgtataagacaaagcactatttgcaaacagatggagttgggtatagcttgtgaaggggcaggagaaggggcaagacaaatctgttctgccccaccagggaggcaaagtgaaattaaagatttggatttttcaagattttttaaagaagacatttttgaaacagagcccatccctcctttttcacagaggttatttccatagtccttttgggttgtacatatgttacatgagctggcagctctagagggaggagcctatctctaccatcagacaggggctttcagacaaaggccatgtaaccctgcaataatgggggtttcccaagagataattagcttgtggctctagacaagttgcttaacctccctatgcctcagtttctcatctgtatgatggggatgatatcagttcctactgactgttccctggccttgggctaagctgcctgggaaaaaggctagaaaggagtttgaactcctggcttctggtagctgcagtgggaccctagctggaaggtaggtgggaaggtgtctctctagtttgcagtaaggcttggaggaaggtctcagcatgacaagaagtgggactcctacctccagggaccccaagtcggagcagggtagggcatattaaatatcctctgcagagactttgatcaacagccatgacagggagggtttctgttctctttgaagcagcaaaaagatcaatcctccttcttatctcagcctctttgcacagtggcatcacgtgctcctgcaaccactgaggctgctactctctcaaagacgggaacagaggaggcaaagcccaacccagccctgtctcctccccgccgtctccctgcctccctgtacccctccatcccagggataaacagaatctgccactttctagccttcatttggcccagccccggaaggaaagaggaggaaaacaaaagaatacctatgcaccaggaaataagaccttccagggctccttcatcaaactagctaacctgggcactcctcttttcctcaaaatctggcttttaaaacatcgccttttgctgccatctaaagataaccaggataggaggcaggagactggattctagttacaggtattcctttgatttgctgtgtgactttaagtaagctgctgcccctctctggagcttaatttctcacctacgaagcaaagttgctgcatatgtttttcaggactcaatttaaaactctgtagtcaagaccaggctgtggccagggccagatttccatgtgtgttcaggttgtagaattgtctttctcagatcctctcacaaaggaattgcccccataaccttgacctcactgactccttcctatcttggccaaatgtttttctacacaatctattagtggaaagagctgcttggctagtggagcagcatcctgagtctgcaggctctgcccatgaggggcaggaacaattcccatcagtgctgcctccagcttggtcaaggactgaagacagcagaggagagggtttgcagggtcactctgcctttgaaaggctgggagaagaagagaatagggcacggggcaggatagggaggagttgaggtgggaataaggggtcgtgggagaaatgtcctggacctcctgcctctgggtgttgtgtgtttatgaccataccagcctggtgagtttgggtaggggtcaggggtttaccccatgcgagtatagcgcctccccatttcattgggtgaatgaaagtttcagacccagaggaagtaagatcctccacctgtctcctgccccctagaggaggtcccaaagacaaagggcaaaggccgcaagagtcctgctcctccaagccaacccagtgagctgatgctgcttccgggcatcaggctttggagagctcagtaataagcttcctgtatctggtctccaggatactgacaggtctactttctggccagatccaggccccagtcagagtctcccagggtgtagaggatggaatagctccagaaaagggaaaaaatgaggaatgaagtgagaaagaagtaattccagtctccctgcttctgcccaacactggaacgcaccaggccagatctgaacctcttctctgcctctaggactgagggtgtcagtgtagatctccatcctcctgcttttcctcccccagccccagcttcgtctgtctcttccatcactccaggcccctggggtctcctgctctgccctcatgaaccctgacccctaataagtccccagggtcagccctttgcccactgcccagccccctcggtggcccccagcttgggatctctccagggagaagggaatcatctgtgaattgctgccatgactggcaaggcccaggggtgccattcctggcatgctgcccaggcatttggacctacagggtaggtgtatttgtgtgtgtgcacaaatgttcacacttcagagagcaagttttccatagaagtgaggtgcccagattgatttcatgctgttttgggggaaacgtgtaagtgtgggcatgttgcagcatgatatagatgtgtttgtatgcacattacgcggggctatttgtgtttctgtggatctgaatatgttggaaagtgaatattgaagcatgtggtcctacattttgtgggggcttgtgtactcctgaatttcaggggtttcgtgtatagtttgcagagtgatatgtgtgcccatgggcaatgtgtgctaggtacctgtgagctcttgagtatctttgccactttccctttgcctggaggaacttcttgctggctcctgcctccctgcctcctctacattggagggagagctgggcccttggccaaatagcccatctgaggtcaagagtcagcagcaaacttagtgcccctgtggtccttgctgtctgacccatgtagcaaccgcaggcaagtgggggtgggggatgctgattgcagctggagaatcccaggagcaagcatcttgaggagttcaaggtcagccttcttgtgctctgaaacaaatgataacacaaaaaactgctgtttactgaatgcttgagtatactagatactagatactgtgaaaagcactttgcagacattatttaaaccacacaataattttacaaagcacccccttttacagataaggaaaatgagtctgggaaactaaatgacttaacctgggtcaaataacaagtaagttataagactaggatctgaacccaagtctgtttgactctaaaactcatgattctctctccctattctggtctacagattatgctagaaagaggggagagtggaggagctcctcttctccaaaacccacacttaccaaacagatctgtttggcttgttagaggtgagccttcatttcacagaaggacctcaactttatacccatagatttaagatctggaactccctgatggagagaatggaaaggagaggtgggcggaggaaaataaccagagaaggcctcctggagctgttggagagaaacatcgcaagctttggtgggggagggagttggatttacagaccttggtctgcccctggtgtcctggagcctagttgcttggtgtgtgaggttcccatggctcactcctgtggcttccctgggaagactgctgtgtggtcaccctcaggatgaggacgctggggaagcaactcatcaaggtgagacggtcagaggcaaccctgcacatgcacagctactctagtgcccactgggagactctgctcattctcttcactcccagatttaagttgcagggaaaatgcattattttttcattaaacatttattttggaatggatagccttcagagatgtaattagccatgttatttctctccattagcagtccctggcatttgctggagtttcttgtcctttttcctctccatttcactctttccatcatctttataatctaggttgcaatacttccccacccccacctccaaccagcaccacatagtctgtttttagactgaataactattttaaaacctggagagggagttatagcaaactcccccccctccccactgggctgtaggattacagtcccctgagccagctaggagctccacgatgcccaccactgccaacaggaagggggaggcagctccacgtgacactgtgacggcctggctagtggcaaagctaggcagagctaggaaggttgttggctccccatgttctggctggatgatcccaggtaagttacttaacctttctgagcttctgttgacttcatagtgttcaaggctggcactcacttaggtaaagcacttcaccggaggtatatagcaagtgcccagtaaaaggcagctgtggtggggaggtccacaggcaagagggagacttggggactaaatgaacaggagacatgggtagcaggaaaggcatagcctgggcttggtgagtccgagctacctgctttggtggtgacccaggagcctgggctgggggacaggtgacaggtagaaccatgaggaagacccctcacggagcaggactgggtggaaagagtagtcaggagctctgcctcagctgcccatggctgagtgtccctcttttgtccagagttgctcctatgggttatttctggaatgcaagagagctacctaggaggtgggctccccaagaccttagagatggcccaaagtgcagtaactccttagccctccaactaggttaggggatttctagggtgactgggctggttattgctctggggaatccaactaccttggtgctcagaagggagctgtctccaccactccccgtccctgctatcctcacgctagtgacacatgacgtgcagccatctccagcattgtcagaaatgccatgctccatggagttgagggcagaaagcctgaagccaaaaatctaaacttaccctggtcctccacaaagaggggtaaagagaaaagtgcagctttggcatggaagatccttggcattttgcaatgaaataaaatcagaatgcgtgtgatttctatcaagatctagagtgccgcagactgagacagtcatgggtaggtatcctttgaaggggttgatacttgttaacagggatacagttgcatggcatttcacaaagttgtgtcttgttgcattgacatgaagggaactggagtgaacctgctttttaatactggccttacctgcttttatagtaatcctggtcccctaggtccccagagacatgcagagaagtggaaattggctcagagggtctttgaacttgtacatggatgtcactacaagcctcatggaagcaggcagcattttgatgtgagtctagttcacagaagtaaattttcatagtgatttttgtggacaagtcctaggcattagtaataatactggcgatgctgaagataataataactaccacacattgggtgcctcctgcgctccagggccatgcttcaattaccttcagttctgtaaagcattaccatcctcatggcacatgtggagatgccgagactcgggcagggtagagaagattcgcactgtgtagaggacggcaaacagcacaacaatgcccgccaccaggagcagcagaaccaggatgtcagcccactccatggtttataggtgtcgccacgaaagacacgactcacacaggcactagatggaacaacactttactcacacagagaagagacagagtaagatcagctgcaatcatgggttcagtcccgcatggccaggggtctcctgctacagcagacacaaggtgacggtctgcacacacccctcttgtgcagcagcgggtggaccctgtttcctccccacctggaacagatataacagtggggttggccaggtgcctgccacatgacgcacaagcttaagcagaacaaagagtacacgctgagtctgaaacaggaaaaagatattcccacgtaaggcgataagcccagcacaagctatgagagctccttatctgttggtaaggaagtgtttttggctcaaggccacttgtatggggctgagcagaggttaaaaaaccacatgcatgagactgcctttctcaacctaggtcatatcattggtgtgcagcagagccaggatttgaaccgggtctttttggcaccaaagcctatgagctttctcattgatgagaggtcttccccaggccactccaagtctcctctccctcctcatgccagccacatcagctaatggacagccagattcagcagagaaaaatgaactgagtgggtttctccctccttggacttctttaatgcaaacacctaaaataatattttccctgaagaatcctcacgtatagaagtttaaagcagaaagctggattcccatcagagatgagaaaatgcataacagaaaagcaatatatgggaaaccaaggcacttgggcaattatgtaaataaatggacatggtaaggatcattcagccctggaaaaaaatggacacatgtaattccctttcagaatctgaaaaaagaagaaagagggatggaataaaagccctttttgcttccgttacagagtcctgcagttctgtttgaatattaagcctccatgtggttgctatggggcttttgtaatatgactaaactgtattggctcatttggggaagggttatcacctacaattcacagataggatgccagaggttaaaagaagttcagtagttgatctatgttcaccatgttcgttttagaagccaggttgaattgagccctcagatgtttccaattcccgacctgatcctcatcttctcaaggaacaattgcagtgaatcctcagttgcctacgtggttaatgtggaagaacagagacatagataatcctaaatgatgtctatgtctcttgctctaaacatttgctttggaaacttcttgcagaccttagaatgaagccaccctaatgtgcaaggggccccatccttactccacaccttccctactcaacgttgcccacctcccactccatgaagacctaggggcagtagatcaaagggaagaggctcttaactctctcctaggttgagctagggtagtgggtagaggagagaggccgataataaggcattttgatttaaaaggccttctgcagtgccgcaggcaagcagaacagaaacagtaaatgagacaatgaattgtgtccgtggaagactccatatggacagtgattcattatgttaataaggaggtgaaagccagaggttgactgtattctgatttcatgtctggggaatctgtagctcagaagcggggagcatccaaatttgaggtcagagtccaaattccaacacccagctcctgattccaatttggttggtcgaattactatcatctcctaatgactaaggatgctttagagccagatgggacctgagtagaagtgcaagcaatgcttaaggtggagaagagtgatgctggagccaagcagagccaactccttgggtccatgcaacaaatattgagcacctaccaagtgccaagtgatggcagaactggcattgggagagggaaccacagaggaatctgatgttgaccctggcctaaaggaactcagggtaggaggtgatatggggcaggcacaaatctctgtcatacatacagagagggaagtgagatgaggtctaagacagcttcatttattctcccattcaattaaatcattaactcagctactcaggcacgatcgtaagtgctccaaataaaaagctaaacaaaactgatctccaccccagaagctaccattccaatgctgaagctaagtcaccccaggaggcatatcaaaacacattccccagccccccaggccccagcactgacatactgattctgaatctttataactggtacccaagacatctgaagcctggtttctagttattctccaactttgggcactggtctggtggaatagggagggagtccagctaagagagtccagaggaagagtcagagatagagagcaaggcttcatggcccacctctccctggaagccctccttgaccagcacagcccacactgatccccatgtcctctgaatccaacctccactgcgtgttctgcagttttgcatttttctgtttgttgttgttttttgtttttctttctttcttttcttttctttcctttttttttttttttccaaaactagcaggtttaatccctcttctcctgcttgtgtctcatctctaaaggtgggtgttcccgtgttccaggtcattgtgatgagagttccaggggacttgtgacacactgctggccggctctgttcaagtgtgggaggtcaggagcagccagttcctcctgggaatgcaacccatctccgaaaaggattaagcatcactagggctccaagtgagttctgatcagaggctgttcggaagacagcaggggccatgaccaccctctctcctgaaaacagcctctctgccagacagtcagcctccttcatcctggtgcgtgttctttgtcagctctgagtgcctccctccccagcctctggttggcactgggaccattttcccctgctgggtaggaaaagctagaaccctgagctaacatagaaggtggagcaagggcggttgtaccttactcttaccatcagcccaaggacaggactgagacatccaagccccctttcaccttctttccaagccagcaaaaccttctccacatatgtgctattctaactttattgagttgtaggtttgcaggtgcgaacctgaagatgctgatagattttcatcggtgctttttgccaacaattttggtatactgccaccaggtggcagtaatgcttttgttagtaggtagttctaaacccagtttacaagatacagctatttgttagaagtcggcttcagtcataaaaattttccacacggtattttttcaaaatcataactaattacaataactttagccaatcttaagtctcattaatcatagtgattaagagagtgatacataaaaatgcaaaatggacactcctctccctgagttttaaatgttactgctttatggcaaattatcaccaggccttgctttaaattttctttatatctttctcatttctctgagcttagagaaggctaataaaataaactgtcacatagcatttattatgtacgatgaatgttctaaatgctttatttatagtcattcattctcatcacaactctatgaagtgaataatgctgttgtcttccttttataaatgagaacatggagccacagagactttgtcacttgcctacagtcacacagcttgttaagtggcagaagttgtatttcgacccagacaggtggggtgcaaaactcagtattctcaaagtgtggcatccaaacctgcagcattagcaccaactgggaacttgtaagaatgcagactcttgggccccagatcttctgaaccaataaactggagacgaagcccagagatctgtgttttttgtaactcatccctccagggcactgtgatgcacaattagctttgtgaaccactgttttaaaccattttcttcatcacggtgctgtactgatgatacaccctccacacctgggttggtaataattgctgaagtgggaaccccttgttacggttgggagtctatcttgtcctcaggtgaactggagtagaaaagagaacctgtccaggtgcagtggctcacgcctgtaatcccagcactttgggaggccgaagcgggcagatcacctgaggtcgcgagttcaagaccagcctggccaatatggcaaaaccctgtctctactaaaaaatacaaaaaattagccaggcgtggtagtgagtccctgtaatcccagctacttaagagactgaggcaggagaatcacttgaaccagggaggtggaggttgcagtgagctgagattgcgccactgcactccagcctgggcgacagagtgagactccatcaaaaaaaaaaaaaaagaagaagaagaagaagaaagaaggaaggaaggagggaaggagggaagaagggaaggaaggaagggagggagggagggagggagggaagcttaagcaaagtcaatgaccttccctgggctttattggaggttctgtggctatgagtattcagagaaacttggcattaaaaccctcataaaaagtttttcttgtcctccaaaggctttctttttttactgaaaatatgggagaaaacccctaacccaatgatgcagtggggagaggagatttatgcctgaagccaaggcctctagcagcaggaaacttttagagggactgagccacttagggctcccacttctggtccccttccccaggggaagaatggccaaggcttcctcaggtttgctgatgtagaactttaacctgcctagatacaccctgaaggtgggagatttccatagctgctctatctagcagtacgcttcccaggacactaggaaaggcaccactgcagagctggagggtatccagccccctcgcaaactgcagacttcccctcccggattaccaggtcattatacccagtgtatggaaaagggtgttattaggttggttgagcaaagaacagaggaatatgggaagatgaaggttgatttgagaagccactgtgttgacaatctccgtcacattaaaggagcccagatacacattctctgatttctagcataggcaggtaggtggtgtgcatgtagagagagggcttctaagtgacatttccccctttgccttctgcgggtcaacagccttcttgttctggtccttggcttgctagcaagtgtctgagatagtcttgtgggtggcctatagtttgctgaagtttggagagatacagggaactggtgggtgtagagaaatggagtttcctagaaggaagaatcagtgactttttttgtgggttttttttttttttttttttttttttttttttttttttttttttttgagacggagtcttgctctgtcacccaggctggagtgcagtggtgcgatctcagctcactgcaagctccgcctcctgggttcacgtcattctcctgcctcagcctcccaagtagctgggaccacaggtgcccactacaacacccgggtaatttttgtttttttttttttgtattttttttagtagagaaggggtttcaccatgttggtcaggatggtctcgatctcttgacctcgtgatccacccgcctcggcctcccaaagtgctgggattacaggcgtgagccaccgcgcccggccgaagcagtgactttttataaacaaattcaaccacggcaaagtaggcagatggccaattgttacaggtagaggtttagaaatgcaaattctctgaatactcaacagatgtcttcttgtgatgtttctaattatttctgccttattgcgttgatgctgtatcttttgttacggtgtgcggtgcatattactttaatttcaatattacctctccattgtgtttgactttttttcgtatctttgttcgtcatttattttttaatcattgtagggcatttgattttaaggtatttcttttgttcacagcttgtgtaagatacatattttttatttgagtggaaaatccttgccttttaattccttcccactgcccctcccacccccagcatggcattagggttaagcctctgactgttgcatcaaacagcttagggttcaaactccagctctgatactttctgtatctaatctcagatatgctaattaaccctcctgtggtctcagttccctgatctgtaaaacagtacaagaactttaccacttcatagatatttgcgaagattaaatgggttgatatatgtaaagtgcttagaacagtgtctggcacatcatcaattgctttttaatgtttacagctaataagagaatgaaatgcatttattttcataattaattgctttgggtttctatcatttttatgctttatacttttattaattccttgttgtttcctatattgcttgcttttattttttaaagtgagttggaagatgtcctgttcctataaattcctaatttttaaagtaaaaaataaagcaatttcttttgactccatcctaatatctaataaagaaatagaatctgcaattaaaaactttcccacaaagaaaactttagcccagatggcttcactggttctaccaaatattttaaaaagaaataataccaattctatacaaacacttccagaaaactaaaaaaaaaaaaaaaaaaaaaaaaaaaaaaaaaaaagaaatccctactcattttatgaggccaacattaccctgataccaaaattagagatcttacaagaaaagaaactcacaggcaaatgattcttgtgaacatggatgcaaaaattctaaataaaattttagcaaatagaatacaacaatgtataaaaagcatagtatatcatcaccaagtggggcttatcccaggaatgtgaggcttacttaccattcaaaagtactcaatataatttaccatactaacaaactcaaaaaaagaaaaccatatgaccatttcaacagatgcagaacattatttgacaaaatccaacatccattcctaattaaaaactctcagcatgctagaactggaagggactgtcttcaacctgataaaaggcatctgtagaaagcctagagttcacatcatactgaactgtgaaagcctgaatgctgctcctctaagatgaggaacaaagcaagaatgtcttctctcaccacgtttattcaacattgcacttgagttctagccagtgcagtaaaacaagaaaaaataaataaaaggtattcatacttgaaaggaagaagttaaactgcctttactcacagatgaacatgctcatctatgtcagagttggcaaattttttctgcaaaggtcacaatagaatttttggctttatgtccacgcagtctctgttgcaactactcaactctgccatcatagcatgaaaacagccacagacaaaaatgagtgggtgtggctgtatcctaataaaactttatttagaaaaacagattggaggccacatttgatccatggatcataatttgctgacccctggtctatgtcaaaaatcccatggaatccacaagaaagccactacgactactaagtgagttttactaggttgcaggaatacaagattgatatatagaagtacattgtatttctattagaaatttaaattttaaaatgatactttttacagtagcatctgaaatatgaaatacttatggataaacttgacaaaatatatgaatgacctagacactgaaaactacaagacactgctgagagaaattttaaaagacctacataaacagagaaatatattgtgttcacaggtcagaggactcaataatgtcatcaattctcccaaactggcttacagattcaatacagtctccaccaaaatcacagctgcctttattatagaaatggacaaattgactaaaatccttatggaaatgcatttctaaagttaaagcatttccttttatagttaaggatcccgggacacagcccagctttgcctgttcccttctgcttcctgccacattgcatgctgagtgttgcagtttctgaatgagtgtaggttgggagaacatgatgacaatcagaggggcagaaagcttgctctgatgagtggcagtgtctatgcaggtggggaacacatcagggcagaccctgcttcccagggttaggcccacaccgagatttgtaacttcttggcccatgtgtcctattttggttcagatgacagggcatacatgagttattaaaaatgtgtttctcaatccatttccatcaaatatacagttagtagaaattatcccaatttggagcctgtaggctcttatttttagttaacaatgctgctttgccttcatttatttatttatctatttatttgagaaggagccttgctctgtcacccaggctggagtgcagtgccatgatcttggctcactgcaatctccgcctcccaggttcaagcgattcttctgcttcagcctcctgagtagctgggattacaggcaccccgccaccacacccagctaatttttgttttttgtttttttttagtagatatggggttttatcatgttggccaggctggtctcgaactcctgacctcaagtgatctgccagcttgggccttccaaagtgctgggattacaggcgtgagccaccatgcctggcctgttttgccttctaatactttactactcatgtggtttgtggactagcagcatcacctgttactcaggagcttgttagaaatgcatcatcttgggccccaccccaaaccctctgaatcaactctgcacctgcagaagatccttaagtgatttgtacgccaatttaattttgagtcacatattcagatgtatactaatgggaagttgggagtgtgtatatttacatgtctactcagctctgtccatcagcacatctttatgtctgcaatgtggcatttcaagatattcttctctccagcagaagagagtatcccaggaagaaaggaatcttctcttattccaacaggaaccctcactcctgttgttgttgttgttgttgttgttgttgttagagatattattattattatgtgctctgttgcccaggctggagtgcagtggtgagatctcggctgactgcaacctctgcctaccgggttcacgtagttctcctgcctcagcctccagagtagctgggattaccggcatgcgccaccatgcctagctaatttttgtatttttagtagagacagggtttcaccatgttgccccaggctggtctcgaactgacctcaagtgatccacctgccttggcctcccaaagtgctgggattacaagcatgagccactgcacctgaccctagttattattttataagcattttgaattactttgcatgcagtgcactcacctctctccaacacatacacacacacatgttcacatacacatagcacacagatatataccacacacacacacacacacacacacccttatcaaaagcagagactatctctcataatgaaccattctacatttccaggaaaggtaaagtggagctcataactgtgtctaattaatgcttattttatattttcctgtgatcaaagcagtgtacattattatagaaaattttaaaaatacaagaaaggccaggtgcggtgactaacgcctgtagtcccagcactttgggaggctgaggcaggtggatcacctgaggccaagagatcaagaccatcctggccgacatggtgaaaccccctctctactaaaaatacaaaaattagttgggtgtggtggcgcgtgcctatagtcccagctactcaggaagctgaagcaggagaatcgcttgaacctgggaggcagaggttgcagtgagccgagatccaccactgcactccagcctggcgacagagtgagactccgtctcgaaaaataaaaaatacaagaaaaaggataaaaagtacttatttcctatcactcagagataatcactgctgtttttagtgggggagaggaacttttttgtattttctcagtctttttctaacaactttatagtagtcaatgcattatatattagagtttatgtggggtattattataatatataacggacacaatacataggtattactatgagggccatagttgtactatatagtacatagagaaaatgctagatatacaattctgtattctgcttttttctgttaacatttgtattttttctgattattattcattccttgtaaacaacacttatatgcctcaaaatattccattaagcacataaaccacagtttacttaactacccccttattgcagaacatttagagtgcttgcatttttcatgttggtgagtaatgtgcatgaaaattattgtgcatacaggattttttctatatattttcagtaatgtcctcaagatagatttccgaagtaagtcaggctgtgcgctttgatacatattgcaaagtccagaacatattatttaaaatcacacttaaaagccgaagccttctaacataaggcagaactggttgctgcttttgccaggtgaagagaaaaccacccattgacaagacagaatgggacagcttctttgatgagagtggccacttggccaaatcacgggacttcatttgtgttaacatcctggaaagggtgggtccccaagctacccttggccttgccctggaactgggagcatggatgggcagggggcaggtgtggcgttggatgaagcccttttggtaggcatcgatagagcccatgacctccacctcccacccccaccccagggtctgcaccccttcgtgaggactgaagcctggaaattcctcacgggctacttctcatggcagagttcccaggatgagcggctcacggtggacagcatgaggaggtagaacactccagaccctgctgggacaggaggggggcctgcaggtggcaggtgctgcctccccagcctgcagactatcttctgcccccatgcaacttcttattccgagaggaaccccatgcctcctgacccaggcacagcacacaggaggtgcggccagttcgtgccagtgccttctctccctgagctccatttaccagcccatcaactgccaggcatgggcttggtcccagccactcctcttacccctgggccccaagtcccatccttccttatggcctatgcattcttcctctgaagcagcccttgaacagagtctgccaccctcttccctgggtgccaccccaactccacctcctccctgccccccatggctgagctgcctcccgggtctagtctccccactccctgcctgtgcccactgtttcctcccggtgcccaggggaaggtacaaaacccagtatgggctgcctgtgtccttagatgaaacactcccagtggtgtaactggtaacgtttcaaatagcacatcttctcttccaaaaacttcctgatcctagctccacatcgcccactatcccagagcctgacattccaaccacactgacagcctcactgactcctcatctgcccactcctgccccagcacagaccacgtttgcactcccctctgtccttggttcaccctttctcctccctccacaatggctttctatcatctgcctatcagtagcccacccttccttcaaggcccagatcccacagtatacctactccaagcagccctcccagatctcccaagggagccagggatgaggcactttgtttcagtagataacacaccatctttgaacttggaccgtcttggatttggaaaccgggttcaaatttcagcactctgatttacaccctgggtaaacttgcccatgaacttcagtgctgaagtctcagtctcctcctctataaaatgcaggtaacaatctatttcacagagtggttgtgggggctcaatcagataatacaggtaaggcaccttgcacaggggaggaatcagtagcttttatgattttgatgggaatcctccctccctgaagccggaggcccttgacttgcacttccatgaccctgggcacttggtcccacagtagtgagaacggagcctgtgtcttccctcccaggttgaatgcaaacaagggcagaggctgcagccagtttgcctttgtcttgggccctctcctgaccttgcctgtccatgggagggctccgtacacactggctgagtcagactgactccactgctgaaaatcttcccatcagaggaacggactcctttggattgtggctgcatgactatgtagcctgggctggactcacctgtctgggagcctgaagcaggggctaggcccagccccaagggagcatccagacagaatgtggaaaagattcacgtgtcggggccagccagagtgacccggggtgggacgggggtgtgagggctgggctagggagctcagagaggttcaggagctctgacaagagcccacctgtgttcatttcctgaggctgccttagcaagtaccacaaactgggtggcttccgacaacagaaacctgtcttctcgcagttctggagccagaagcccaaaatcaaggtgttggctccttccaaaggctctagggtagaacccttccttacctcccagcttgtgtggctcccggtgttcctcagctggtggctgcctcactccattccctgtccccatggtggtgagaccttctgctttctgtgtgttataagaacacatgtcattggatttggggtccacctggaaagtcttacggatctcgtccggagatccttgacttagtcacatctacaaagactcttttcccccacatggttacattcacaggtcctaggggttaggacatggatatgtctttttggaggccaccatgcggccagcaataccaactaatcatattctaataatgaggacaaaacaccgcctcactcagcacttccaattctgaggcacaggtgccagtattatgcccattctacagatggggaaactgaggcttagagatggaaagtcgtgtccccaagacttgcccccagtggcagacaccccgttattaagatgtagagccaggattcaggtgcagcgtttggagtacagagcccaagaagttaaactgtctctgttctgcagtccaggtgcatgttggaggacagttagggtggcacaggttgagatgagggacagcatcacaggtagggtgcatggctgggtgagggtgctgccctggatctgcctggggcctggtagctgcagctgctcattcaccacttatcagaaggggaaaagccaccttgttcagcctcagttctgttctcacaggaagaactacaaggccttatgccaaatgtatgagaagattcagccccttctggaaaacctgcaccggaacttcacagagactcgcaataacattggtgagcaaagtggggtggagagggctgggcagagggagggcttgaagccaaccctgcccccttctcagccacttccagggagggatggctccaggatcctgggagttgctttgacttgtgcctggagtttcgccagctgaaccttggttaatccaccccaccagtctctcctgggtggccctagatgccccataccatgttttcctgggtgcatgatgttcctgctgcctggtcttcctctctcctttctttggctttgaatgaggttggatttgaactggacagagaggaagggtgggggaggacattcctggccgagggtacggcctcgttagagggttggaggtgggaagaaacacagacagctcaaggtgtggtgaggaactgagcctggcaggggctgatgtacctttcacagctccctctccctccaggatgtcctagggcctgcccattggggtaggggaagaaattcacccatagacctgctggatgtgatctggtgccacctacttgccccttgcttccaacctagcacgtgacattcagaaaatctatgacaaagatcccctgggcaacgtcctcatcgacaagaagaggctagagaagatcctgctcctgagttacgtctgcaacacgcaggcaggtgagcctcagcctccccttgtcaatgccctcccaggacctggcccaacctaagccaagggtccaggctctcccacccagcccctcctccccaaccccctcttcgccacagagtaccagcagggcttccatgagatgatgatgctcttccagctgatggtggagcacgaccacgagaccttctggcttttccagttcttcctgcagaaaacggtgagggcaaggcctgagctcagggacgcccctccccaaccccccactactccccaaacaactctttgaggatgggcaggcattggccaccccagccattccttccaggcttctgggtctcagaggagcctgggagggtgacgctaaacccagtggttcaaagtagtggtggtggggaggcactgaagtggagaagggggatggagcaaagctctgggtccacctctcaacaaaccttgaaagagcatggctggccaggcccagggaaggtgccctctcctggcattttcttccccaagcacggttctcctccctcctcgctgcttcttcctcaatggctccctgtggcctccagaataaaatccaataaccttagccagtcattcagggctgttcccttcacataacctgaattccaggcacaccaggggactcaatagtccccaggggctccctcactgtccaagttgaggggttttgaaggtgcagctccctggaacacctccctggaaagcctttcctcatgatctgcgagaggctgcccagaaccctccctcatccctccctccaccccaccatccctgcacatgtgcttgctgcccttcccttgtcccagttggctctgccccaacactattgtgtgagggaagaactgggcaactgggctcactagactgtgagccacagttgagaatctctactacacacacatacacacacacacacacacacacacactacacagccacccagaggcgtacaacatatacagacaaacttgcatacacagatcacagtcacatagatatgtatgcacacactcacacacacacactcagactcatagagacatgggcccagcgcacagacagacacacagagcctccagaagtgaagctgggggaagcagagttgactcttccggtgccttgaagccaagggggactcagtctgtctcccaccatcgtgtgcaggaacacagctgtgtcatcaacattggcgtggccaagaacctagacatgctcagcaccctgatcaccttcctggaccccgtgtttgctgagcacctaagtgagtggttcccacctcctgccacctcacgcaccccccaggcatgggaagggggctgggacccaactgtcagtccctaatcatgggggggctggagagcagcagaatcatttgattgcttctccaggccctgggaagagggttatctggatggggttggagcctggacagttgaaagttgactctaaaccatctcccagggcagctggaaaaggggcggcaggctttttgtatttcccaagtgttttgcaggctctgtagtttggcctcatctgcatgtgtttgctgcatcatatgtgttttcccctgaccacagcctcaccttctctccccacagaagggaagggtgcaggggctgtgcagtccctcttcccctggttctgcttctgcttccagcgtgccttcaagtccttcgatgatgtctggaggctctgggaggtgaggtgtccagctagggatcatcaggctgggctccacccatcaggcagagtggaagctgcaagtcttccttgcctccccctttcttcctggcttggatggagttcagtatctcggggttttgttaggtcagcaaccctgctcccaccttgctggaggaagctggagcatcactttgtccatatgttcatttaacacaaaggccccactgactgtgccttctgctagcagttgacacaggagggccctatggcctgtgcagtgggagcctgggcctgcagctccacttccccgctgccctgcccaggtggcctccccacgctttcacttccccagctgtccccccaaccctggccttccccttccccagagtgctgctcctgtggaactctctcacagaaggtgggtccctaaggacacctgtagtcctgtgaccacaatcctcagggccatcagcagatgaaccctctgaggaatgccacccccacccatcaatgccctgcccatggccaccgctgcctgcagtgtccagcccaaccatccacctggcatgtagggccccacagatctattcccacctgcctcttggctggctggtctccatgcccaagtccatgaccacacccaggcctttggtgacatccttgggtcatttaattcccatcaacccttgcttgccaaaaccccactcaaattcgacagtttcctagtgtcttcccacccctcattgcctccctccccttcctctatctaatgaattccctgaagcctctatctctgaaacccccaggagacagcacaatgcctagaaccaggagtacctgtgagcacatgcctgagtgagtggatgagtgagtgagtgaatgaaggaatgattgaatgagcaagtcagcagcaaggcccaggaatggctgactccaggcacgtggttggtgggtacctcaccatcctcagggcatctgcagtctcagaccacagggcccagactgagacgtcctgacccacaggttctgctgacggggaagccctgcaggaacttccaggtgctggtggcctacagcatgctgcagatggtgcgggagcaggtgctgcaggaaagcatgggcggggatgacatcctcctggtgagagcaccctcgggcaagctaccacccctgctcctggaggccctgacaccccaccccaccccagctgaaagaccggggttcatggggtgctgggcaccagtgccaccttttccccccagacagaaagggcaatgagatctaaggtacggattaccgtgccaagggcttttaatagagcttgtttaagcctcaccacaagcttgacacagggaggctataaccatcatcatcacccctagttaacacatgaggaaatggaggccttgaacactccctaactattaagctctaccatctcgcagttaaccctgtggccctaggatattgctgaaacagaaggacctagagttttccaccattttaaaaaagctactgaagtctttgttggaagaaacaaatcttaggtgacaccctaattataaaccaagtcctccttcaaagcccctaagacacttggtggagccccaggactcctagagcctaacatgaaagctaacatttaccattgccccaaaatatcaaattttaggcattgagccaagcaggctggggagaggtcaggtggtccccagcgactgctgtgagcagcatccttcttccctgggtgctgcaggcagctgcatgtgcccaagagtgctgggagatgtttgccccagccccacccacaactgctcccacactcccatgcaggcctgcaacaacctcatcgaccttgatgctgatgagctgatctctgccgcctgcgtggtttatgctgagctcatccagaaggatgtaagttgccccaatgatgtgtcctcctcctcctcttcctcctcctcctcttcctcctcctcctcctcttcctcctcctcctcctcctcctcttcttcctcctcctcctcttcttcctcctcctcttcttcttcctcctcctcttcttcctcctcctcttcctcctcctcctcttcctcctcgtactcctcctcttcttccttctcctcctcctcttcttcctcctcctcctcctcctcatcagagcctatcctgatctcccaaacgcagcccatggcaggtgcattcaacttcagagacacagactgtgccacgttctctaccactgacccatgcatgttgctcctcatggtcttctcgttgtttgcacatgtagctccttcctccctgagcaggctgtactacttgagagcagggccctcatcccccattccctgtgtccatcccagtgggtctgggcacccagaggctcaggagaatgtcgctgcttagaagaaccgaagaatgaaagggacagaccaatgtctgtgcacctcccacctgcctcctccctaggttcctcagacattaaaggatttcttcctctgaggacaccaaagcccgcagtggactgatgccttcgatgggcaggatgaaggccaggggcactggagtgagggagtagataaaacagctgcaatataaacagtcctctggaataatggtttgtggtggatgctatgtctttgaccttaggggctgggacgcacatgagggctgagacagggtcgtacgataggaagagaggctggctggctgagagacacattctgagactagggagggtgcttgctggaagagactgggtcagtggctcctccttgatggagggttttccaaggctgcggtggatccatatctggatacaaatggttagagtagaaccagctctgaaaggcttccagacccctgtggaggacaaaactgagcacatttaataaggattagttcatctggacttaggtcctgagaggaaggctggtcctggggctctgcccccacccccactgctcccctgagtcctgtcacatcaatcacacaattaagtcattttttccagagatttcctgctagtctgtggaaggggctggcctggaagaactatctgatgagcaggcaattcccttcctggtttcaaagcctccctcataattgtgccttcatttatcagcctgcaaatgtgtcctcaagctacattttattttccagtcttgatcaatctttcttgagaatgcactctttgcccttggccaggcagtcagttgctctgtgaggaaaaggtgcatcacacctgctcccccaggctgtgccacagccctgagcccctgtccagcctgccccatgctctagctggcccctctgagggaagacatgtagatgggccagaaaggctgaaactgcagaagggttggggctggctgggtgcccccagagctgctcagcaacacacatacatacacacatacacacacacacgaatgcacacacatacacactgccctgcccagtgactacaagttttcaggagggctgacattacacatgggcaggagggatcccttgcttttgctgtgaactggtccttagaggtaaggcatggccatccctctcactcttcagccaactgtccctccctctgctcccatcctggcactcttagtgaccatcactccaaagccattatgtccccaatgagtgcttggtctccttcccctcaggcgacagtctcccatccaggaccagctctgagtctcttagctgctgtatctttgctggaaggttgagggggaatgctgaagaatgagggcctgtccccccagcaacaccttctctgcatggctaaagagctcatgtttgctgggcagggaggcacatgggtcaattcatatactacacttctcctttgcttttatgttcctaaggcagtttatttaaataagtgttcccgcatgaaagacagttctccaaggatgaaactgtgtttgcattttgccagagaggcagagaacaagagtaaaagacatcttgctgagctagttttggccttgggaagagaacaatcaatagaaacatcagatgaacattttctaatgcttcttttagactggtgacttcagatggccgattatttttggttgggacctacacacaatgccaaacatctatttcaaaacaaacatttaagaactcatcttctagaccacttgctgtcaaatctgttgttaaaagcactggagcccctttattacacagtccttcccaggagcccagcggatgaagtttgggtgcagatcccagagccctctcccccgaccacccctctcaagcccccctccttgaacctcacatcatttcctgtgttatctgcaaggagcctcttgtctactagggtgcatatttgaaaacctgttaggtcttaaggacgaggtggattcaatcttgacaccaaattgatccagattcagataaatcccaggtgatggagtgatgaaagtaacaatcttggaagagtggagcttctctcagctcatctgcagtactcccagcccagcagactgtagattaggatcttcccaccatgctgctatgcaggtccttaaaaataacactgggctgtataattcattcatttattcccccttctctggctcacttagtttatcatttatacagcccagtgttgtttttctctagtagggtccattctggagatagaactacaggaagcattgaaatcctagagcctaagtttgtgttatgacagtctagtttatttcagcatgcatttattcagtactgtcttagaccatttggactgctctaatgatggcagtggcagcccatctggagcagccactgccatgatgccagctgcagtgggggaggcgcagtgagggctgcatgctccatggagccagtgggagccagaaacaggcaggagccccgcccccttccaagttggaggggtgggagccccaccctccctggcacagctgcagccaccctgccatggctgtggacccaggcatctctgcactcttgggggcccttgaaacccccatgccctcacaggctcagaactgcctgctcccactgcctggcctctccccactcctggtgcccactctgatttcggagcaaagctgtggctgagaccaggtgctgtcacaacccggccaggtgtgctcacacctggggcagcacttacacaccagccccatgccttcttggcccccctctggactttgggcaccgacaagcatggaagagaggctgagggggtgggtgctaaggatggctcggcatgggccttcaggcacccctcatcatgaacagcctgggcaccgtggatggcaggttaatgacagcaggaggcaggcagatcctgggtggaaaggggcagatcctggtgaaccccaccttcaggccagggacagtctgaggactaggggccaggctgccagttccacagactggagtgacaacctatggggctttttctgggtctgcccatggccacccatggacaaatcagcatgcacttcctcccctctgaagcccataaaaatccccagactcagccagcctcaggcagactaccggatgacctgtctgtggagaggagctactcagggcgggtctcctccgagctgttctgttgctcaataaagcaactctttgccttgctcaccctccacttgtccacatacctcattcttcctggatgtgggacaaaacttgagacccaccgaatggcagggttgaaagagctataacacaaagagggctgaaacccaccccttgcttgccatgttgcaggtgacaggaaggagagaagagaggagagaagagctatagccttttggggatcccagacctaggagctccccaagccagggctgtgacatcgtctttggggctctgtggttcttggtgtctccaagcttccatgcaccgctgcgttcccttgtgccagccatggatgctgtttgtggtactcctggtccagctgcagccagcacccataccagcatctggagctgcccctcccaccacagctggcatgcttggctgtctgtgtgcagtggccagaccccacactcattcgttcacacacacttcaacactccatgtctggctctcccttggcaagtgtgggctccaggccaatagtgcgagccgaatgcctgccaggctgagtgggcaaacaagcccagtaggcccgagcaaaactcaggcaaaggcgtcactgtccacacaggtttcaagctggaaaggaatacctcaagaattccatgacaataacacaataatgtcagtgatgatggcggtgatggtgatggtgatgtcggcgacgtcagtgatggtggtagtaatgtcagtgatggtggtgaagctaattatatggcggtgttggtggcagaggtgtgatgtcatttatgatggtggaggtggtagtgatggtgacatcagtggcagaggtgatatagaatctggtggtggtaatgatgtcatcactggtggtggtgatgatagtgctgacttttcattctgccaacaaaaactgactgtctctaatggtactccttaaatagtgccagaggaaaagatgagattcaaggaagggactgaaggggattgcagtggggagggctctgatattgatgatggtgttggtggtgagggcaatcatggtggagatgaaaacagtgactaattcattctgaaaaaactagtgcccagcacacttccaatgagcaaggcctagacataatatctttaaatgaatcaccgtggccatgagcataaagaaaatggaagcagccaggccccatccaagctttccaaaacttggtcctgagccagatatgaaagcttggattggattggctgcatttcttccaagctctcaccctcacctctctttcactcttcttctaagcctcttccctggagaattcattcatttattccttcttctctggctacattgaatgaccccaaggccactttttgttcctggagttaggataatagctctctacccactaacaactgcacagaggcaccgtggataaaactccaagttctctgggccccagggtctgtgttacccccctcagagaggaagaaagaaggtgggcttttgcacctaccctcaggcttgccagcagaaccgagtcctggcctgaagccaccagacctttggtcagtggggaggaagggatactccctcctttcaggaggaagaacatagctactaggaagggcctccactgcccaggacccaaccccaaaggacagctggtgggctggagcttcaggaggtcacgaacaagggcacgtgacccctaccctcacaattatacagaagctgtactaattgggtaattaatatgttccacgccttgtgctaagcactcgcatgctttatctaacagaatcagaattctgattctgatttcaccctcatgactgaattcaaactcagaaacaggtgcagtcattaccctctcattaccagcgaggaacctgaggcactgggttacacagctagtgatttgccaagtccggatgtgaatgctgatgggcgaaccccagggccccactgttatgccatggtattggctcttgggcagcttccgttttcacctctttccctgcccacagcctcacttggcgtctgccatcctcccgcagcccacactgagtctcctgtctggtcctctgcagagcaggccctcatctcacaggccaccccacccttggcagctgaagccccaccgatgggccgagatggtccagggctggatgacaggggtggtgtgtgcaggaagctctgtcctacttccctcgtccctctctatgccttcgattaccccagtaagtgtgggagggcccagatgcagccatgtttactgcatcttgttttgaaacaaagctctgaacattccttgtgcattccttctccaggatggggagtgggctgggggtctggggttgcaggaagtcagtctgcaggggtgagtgtggggacccaagatggggctggcaggtcccgcatggaagcagcagcagcaaagcctgggcagctggggtgggccaagtgttgtgaggggagaggcgcgcagctctgggagacagggtggaggagggctgtgcaggagtagcctctctttcctatccctgcccctgccgacctttctctggaccagcccccatggcagagaccccctggatggaacaagaccaaggcagagaggagggaatttccagttggtgccaagtgccatcagccacactgctcaagagggaaaaggacttatttctgggacctcaaacaaaagcactagctccactgtcctgccagaccctggtgctcgctgagcttgtagtggggaagagattcacaaccagaaatgaaggaggctggtggcaggcacgggagggcggagtcacaagcaatagcatttagtctgggtgcacattagaatcaccaagggagctttttaaaaataaccaattcccagggcccaccaattaaaccagcatatctaggggtggggccagggcactggtctttttcaaaagctcccaggtggttctaaagtacggtcaggaatgagaacacctgagttcagaacaggagtttaatgaagggggattagtgatcagctggtttgactccttccttccacttagagggagttcaaggaagtcctcacagtgagtgattacggaccagagaggacaggagtgactgtgcagggcactgtccaggagcagagcttgtctccgcagtcgatctcctgttactctccttcctggaccacaccaatggctgccctctttccaggagctctggaatagacctccctaccctcccatcttagagcccttcagctgactgactctagaattaagcattccaagttctattctgagccggcacataaaagaatttctttagggagttagtaagagccaaagtctcaaaagtctgaccctcacctgcagtgatatgcaaattgtacccgaacaccggtagtgcagcattcagaggctgggagcaaataggatgcaaatgtatgcaatcattatgcaaacaagggcagcccagattaatggcctcaatctttcaactagacagcagctgtctctttacgtacgggcatggctgacatagaggactgaattgtctcctgtcagaagcatcctgaggaagggtcagctctcaggtcaagaggagggattgttcggacacctggcttgccgatgctctgctctgagaaatctgcgcaaagatgtctgtcagccaggcaggatattcttctctgcccgggctcctcactcaagtcccaggaacaatgctaggcactgaactttgtggggagagtagtggtgatagggatgatggaggtggtggaggtcatgggagaggtaatggtggaagtgatagagttggaaatagttgagaagacggcagaggtggaggtgagggtgatgaagttcctggtaatgatagtgacatgaacaacagagataatggcgacaacagaggtgaaaatgggcttggaggagatgagagccatggcggtagtgaggacaaatataatggaggtactggtagtggcagcagtggtgacagcgatagtggaggtgatactggatgtgattctgcagatgaagtggagatgacagaggtcatgttagtggcagtcatagtggagaggatggcaatgccgaggtgaggggtggaagtcatggcgaggaggaaaatagtgacgctgccatcacaaaggatagaaatgatgacaatggcaggtcgtggtggtaatggtgaagatcaaggtggcggctcaagtgctagaggccatggtagagtggtgggggcaatgaaggtcattgtagtgaccagtatgagatgagggtaacggagcagtggcggagaagatgaagatgatggtggggggagttggtgacaatgagttctcaaaactcctagctcaataggaaagggggctagagaacgtggcggaacaaaggcacaaggaggggcggtaaacttgaataagagatacaaggtctgttgtgttggggagaggaagcgtgaggcccccaaccacaggcctaaagaaggctcagaggcaacaccagacttctctctccttggcagactcggtatgcactccagtttaactcagtaagtggggtaggcctgaagtctgccagtgatcagtgggatggcctgagattggggaaatcccagcccccattagtcctcagtttccccctctgaaatggaggacaacatgaagtcccagtgcatgccccatggctgactagtggtgcatgtgtagtggaatggggctgccatatgtgtgtggggtaggggtgatgtcaagatgtcaagaaatagcccatgataactgggctggggagatattgacaaacgtcttctcagggcaactcaaagcaatggcctcttgtcacttccatcccatggcttggatcctctccatttctccatcatccccacctcatcttggtcgccgcactgaaggtcaccagagctgtttccctgaatgtcctcacacctctctttccctcctagaaggccagaccctaagtgggctgcagtgtgaattggttagtccttggactctggaatcgggccccaggtaatagttgtgtgaccgtggacaatatacttaacctctttgagcctctgttttctcacctagaaattagaaataacaatacctgccttacaggttgtaatatggctatgtctatgatgcatttagcccagcaaacttcgactcaaagaaatggtagctgttggaaagccacagaagtagtcaggttcagaattaacagttactctgtaacccaagaagctgtagccacaggagagaggacctctgcaggatctgtggcttcccacagccacaaggtgcagcctccagggtgagccacctcctctttcctgtggagcctgcacttgcgtgtgccagcctacagagggcgctcctcctcctccacaagcccaggactccatggggaggcctggctgccccagggaccaggcaccctgcccaggttgcaagagtcctgggcaatccctgtgctctggggcagaggtgttgccgagagggaggaagcctaactggctggcccagagctgctttgggtctgaaagggggacagggagaactctgttgttcatggctctcagaggccctacgccttgtactctagctgcaaatttgatggggaaggagcctgggaccaggggagcctcgggtttccccggaagcatttcccagcagccctaggaccctgtgagcaggtgcagtgggacccacgcgccgcctctactcctcctttcctggctgggaatccttcctgccccccagcacacacacacattctcagtgtagttccgtgtgattcactgtgagtggtcatcatcatggcccgcatcatggcctgaggagagcagggacctcagctgagtcatctccccgaatggtaatgagggcagtctggagaggatctgtccttcagcctcctccctgggttctcggtctccaacccctcaccatgcgcaggctcacccagggagctgctgcttcaccagcagggaactgctctgcctcaccaggcccgtgtggcacagggtgcagctgtgcaagccatgccctctggccacagggcaggtcattaggccagcactcatcccctgccacggtcagggctgtgtggggctggaatcagaggcctcctccgtttcctcaacctgattcctaaacattacctgtttcactgtgaaaaaccatccacggacctctcctgtggttttctacgcccaagaccagcagtgttcagtagaaacagaatgtgagtgaaccacaatgtattttaaaattttaatagccacatttaagaagaaaaagaaaacaggtgaaaaaaatgtgtttagcccaatatattcataatatattcataatatattgtttcaatgtgggctgggcacggtggctcatgtctgtaatcccagcactttgggaggctgaggtgggcggatcacttgaggtcaggtgttcaagaccagcctggccaacatgatgaaaccctgtctgtactaaaaacacaaaaattagccaggcgtggtggcatgtgcctgtaattccagccagttgggaggctgaggcaggagaatcacttgaacccgggaggtggaggttgcagtgagccaagattgcaccactgccctccagcctgggtgacagagtgagactccatctcaaaaaaaaaaaaaaaaaatatatatatatatatatatatacacacacactcatatatatacacacatatatatagtttcaatatggacccaatataaaataattaataaaaattttaccttttttggcacaatgtcttcaaaatctggcatatattttacacctttaacacattgtaattgggaacagcagcatttcaaatgctcagaagcgcgtgtggctagcagctcccatattagacttcactagcaattgttagctcctggtaccatctttacaggcaggtgagtctcctaggagcctgaagtagccgtggccgagaggtctgatgagcttcagtttctctacctgagagcccagcccttgagaacctcctgggaagcgggtgagccttgctccatggcccctggctcacagctggatgcaccctcaattcctgacctgagggctcccgctcacaggaagctgccatctggtgcagtccctctagaggacagaagaaggttcaggaggcgccctcctcaaatccagtcctccgggtcattcaaggccccaggctgcactcccagagctccttgccctgggccatgctcccacttgatgccagggctgtgcttccgctctgtgtgaggggaacctgaaaggaaagttaacatttagatagtggaaaggagagagtaaggaaggagatccaggaaggcaacagtctggccaagggtctggaggtgggaggtggcgggacaggagatgacagggagcccaggcggaatcagaggagagaaaagaggaacagccgtcgcccttggagaggggtgtgtgtatgaacgctaaatgccgagcctggacagaatggagccatagaagtctctgagccagggaaggaattcagtgagatcaggatttgaggcacattagtctgggggctgtacagaaaggactgggaagggaaagatgaatgggaaagtaagtggggtaattaaaaacataggcaggaacgcagagcacttggaccttctgtggttggccccagggagctcagcctgggatgcgggcctctgtgccagaagtctgcacaggggactgggccaagggctttgaggtgggcagcccaggagtcctggggccccgccccctctgcctgtctccaggagaaactggacagctcccacagagggacttgcagaatcagtggtttctggcgatgtgactgtgagttgggtgtgggtttgcttctccctcctatacatccatcaccacccgttctctgccctgaatgccagggtctgagggctgagctgccagccctgggctcctgcaaagccaacatataattccgggccactgagaacccaggcaagacttttgtgagaatgaaacaagacaggcccctctgcgcagacacagcctcttggcagatggtgccttcgtgctaagcaaaaagtgcccggcgcgggctgggtttcaatccccaccacacccttggctgaggcctggcacacgaaccatgtaaccatgcacggcagtcctgcataattcccagtgctgggggaaatggtatgaaaggggtgagtcatacttgaaaaccacaaggcaccagagaagagaccttcatatgagaccccctacctgtcctgctttctccttctcccctggaccaggggcccagagctactgggggactgggcaaagggaggtacagcaagagcaaactcgctggatccagggagtcatagcagcagagtctcaggcccaggcacaaagcctgcatacatctctctcctggagccaagtgagaacagtcctaggagagaggcaggacagagactagagtcttgtttttaaaaaaactgaggccaaaagaagttcagtggtctattcaagatgatgcagctaataagtaagggtggacaatgagaggcaaagtcacagggtagcgaagaggcatcaggcagacctaggaagagtcccagctctgactctgagcattcattgaagttcttcaagtatcagtctgctcatctgtaaaatgcggctaatagctacggttattcctaggattaaagacagcagtgtatgtaaaacacttaatgacaattatagaaactgggactcaaagcccaatttcttgcccagggagagatgtggatgcattgcagaattcctcaatagatcaggaagtccaggatgttagaaagttgtcgaactaccaggcccacagagcaaagaaagaagattcagagagatgcaccttccacagctctggggatgcgtagctgtgcctccgaggcctgcttcgggaccaaggtgagcatggccgagggctcaaagttgagtccctctccatgaactgctcttggccaaaaggagctgccccatttaaagccacatcccctgcacagggaagcctcatccaatgattgtgtaagtccctgggccaggctctcttgcctcaatctggggtaactctgcaggccaccacagccctggagcttcccagggaatcacctgcaactgcccacctctgctcttctctccccacaggtgaggggcatgcccccaagagcactcctcatgcaaatgcccatgtgcacatcttcatcagagtctgcttcccaggtgtattgtttccatggctgctgtaacgaattaccacaaacttggtggcttaacgtaatgcacattcattctcttacagttctggaggccaggagtctggaatcagtttcactgggtttgagtcatggtgtcatcagggctggttccttctggagactctaggggaggatctgtttcctcaccttttctagcctctgggtgctgcctgcattcctgggctagtggccgctttctcatgttactccaaccttgcttccattgtcacatctcctacttcctcccctgaccttcacccaaataatccaggataatcttcccatctcaagatccctttttttttgtttgtttttttgaggtgggtctcactctgtcacccagtctggagtatagaggcaccaccatggctcactgcagccttgacctcccaagctcaagcaattctcccacctcagcctcctgagtagctgggaccacaggcatacaccacctcacccagctaattgtttttatttttttgtagagatggggactcactttgttgcccaggctggtctcgaactcctggcttcatgcaatcctcctgccttggcctcccaaagttctggaaattacagacacgagccaccgcgcctggccaagatccctaacttaattacatctgcaaagtcacttttgccattcacaggttctggaaattaggatggggatattttgggggactattatttagcctaccacaccgaagaacctaaccaaagaaagcagctgcctgcctgccgtggccctcctcattgccttccaagcatcctcttgttgacacctccccagcaagggcagtctcactccatcacaggacggtaggaggggtctggctatggaaggcctgtctctggagtcagtgagccctatcggcctgagggtgtgtgatacccagctataaggaaggcttaagcaagctggaagcctttgaaatccagaaatacctgtcccctcttttctctgcctctcagcctatgtcacatttcaagacttggctgctgcaagaagccttccccagagcagacagaacagctccctcttctccagcctccaccatgctcgatggtggcaccactggtgcccaccccacagcccactgcatgcatctgtcattgcatgcctgcctctcccctcgactgtgcagtaggtctttctcattttcccatccgctccatgcttagcatggggtctgctcccctggagagcagagaccttctctgcttccaatcaatcaaataaatgcttgtagaactgggtcatgccgagccaatccacaattcccaaggaggaagacagaagtgtgaggtgtcagctgagtgccctggtggctcagtctgaatcagtgcaggctgggatgccctggggaggcccccctctacatttccatcaatccgggtcgggtctggcagctggtggggtgacatgctgctgctcccgcaggtctgcctgcttgtctccctggctcagagcaactccataaccagacccaagctcacctgttcaccagtcccagcgaccgtgcaacagttttcccattgtccatacttttcagagtagtccatagtctctgtgtgtccttctctcttattctccctgtaactcgctcccctttatcccaccaaaactgccctcctgaaaatcacaaccacctctgtgctgcccagtccacaggacaccactcagtccttaccataacaggctgctgccgcctcctgtcctggcacccatgcctccggcttctgcatctcttcatgagagaactatctggccttggaccaaaactggcccacatggaatatcagggggattcacaccccaggagcagcccttgaaggaagggcggggagctggtggatacacaccccagatttcccacccctcaatgggacaagtctgagacctgttctgtacactcagagggtccacagggggctgaacctcagtgttccacagcagtagctgctgggtaactcttatctacctttttctcttccctgtctcacttccctactccctcacatgctgcctgggatcatcttccaaacaaacaactacacccaaatccttgtcagaaggcctgtttagtgggggcagggaaccaacctaaggcaacatattcaatcatggtactctcctcaatgccaataagaaaagaccaggccccttcactcagtattcaagacctcagtgatcctgccctcggtctgcctctttgacaccaactcttaccttttccagcctcaaatgtatattctgggctgggcacggtggctcttgcctgtaatcccagcactttgggaggccgaggggcttgaggtgaggagttcgagactggcctggccaacatggtgaaaccccttctctactaaaaataaaaaaagttagctgggtgtggtggtgtatgcctgtagtcctagctacacaagaggctgaagcaggagaatcacttgaacctgggaggtggaggttgcagtgagctgagatcacgccactgcactccagcctgggcaacagagcgagactccgtctcaaaaaaatatatatatatatactctggcaacacaaaatttctcatctgctttgtgacttagcccaggcatttcatctaggaagtcttccttctaagtctagaggtcagtgagtccttgggcttcctgccccatcctaaggtgagcacttctatgagtcagccacaaggaagaactaaccaggttggagtgggctgttggcccaaagtcgagctctataaggctacagtgggctgctctgtagccagccatgtgtgcactctccccagcccccgcaggcatgcaggaagccccttcttgcctagtggtgtgctgaagtcagcttgcactggctcaaaagaatgaaacttgtgcacctcttccaattctgcattcagtggcattatgcgggttgtctgaaatcggctatggcaagagtatttacaccacagaaattggcaattgctacaaatcaggggtttcattttcttcaaagagtgaccatggcctcccctcccgccatgtgccataatcctgagtatgtctatgggttcatagtacaggtcccaggtctgaggcagggcagaatcagcttgggggaaggggtgttgactggcagcatggtgccaagatagatgtggagccaggggtcagagtgcagctgggtgaagtggaaaccaaaggagggacgagaggagctcatgggactgggggacaaaggccagggatgtgtgtgtagaaaagagagagactccaaaagaaatggagagagacagcaaggaagagacacggagagaagagtaagagagacatggagacacagacaaaacaaaacacacagatggagggaggaagacagagtgagacagcaaatagagacagaggcagaaacagagagcgagagacagcttgagactgggaagaaatgacagagtggaggaagccaagggcaaaaatagaagaatttagcgacaaaaacacaaactggagagtgacaaacaaagaccgtagcagcagagggggcccaggagggtgcagcccaggcctagctggggcccacggtgcatgaggcagcttgcaagagaggctcagggcccacttaggacaaggcctcccacgccctctagccccagccatcatgtgaatacctccttaggtgtccatcaactacttgaagatgtgaatgtttgattgcttctccaatttaggcattaaatccctcagtaattcaataatgcattgtccaattactcacatgacacgcaactttaaattaggaaaaaatatttagacaattcaattgctaaatgatctgattgtttctgaaattccctcataatgctcccttgagttattctcccttcttaaatcaacctgagaaagggatgtgccgactcagcagtctgtttcttggctctacctggctgaattcagtacaacctttagattagagtccccggattcaggcactttaccttgtccagtggtgtgctgaagtcagcttgctggaaaaaaaagaaattttcacaccttttcttaattctgcattcagtgacatcatgttgatagcttgaaattggctgtggtgggagtatttacaccatggaaattggcaactgctacaaaccagggcattttttttctttaaagagccaccactgcctttattcacctcccattctcccaccaatctgtggcccccaggtgggataaaaccctgagcagatttgtgggtttacagcatttgctccagggcccagctgggagcctccctaaaggggcagagcagaatcagttggcttggaggtttgggagagtcaactgagcagcataggaccaagctgggaattccagggcccttccctggcctctgtcccagggatcattgtgcctccccatcaagacagcacagtctggaacaaagagctcctgcctgaacattgggagaactcaggtatcactcggtgtcggtcaaggaaacccaggctctcagcaagggactggctcctggtcaccagcagggtggatgggatgggcatgtctgctgggcttcagtttcatgtcccgtttttctaagctgctcacactcaagagtcccagaaagtttgttgtgctacttctaaatagagaaaagttttgtctccataaatttatactctccactgccttcccaggaagctgagttctggtcacaggtgaccctttgtgctgccatcttgaaggagctgggtaggcaaattagggacaggaggggctagggaagtgggagacgtatgtgggaggaggtcggggagaggctggagagaactatggaagaaggatttcatgtgtctccgtggggtatgagaccatcttctgaatcttcccacccaaattgtcagtatactcaaccttgctccctgatgtctttgagtgaatggaatctggagtggagagggtggtggcagtttggaaagaaggatgagggaccagccccactggttacatgtggagaggacaaggtacacggaggaggaaggcaggcctggcagagctcagatatctgtgggaggaggaggcaggttcttgcctctctcttcctctgggaagcagcttgtttgggaaatccaagcccaagtccatccagggcaagtgcctcgattttcccttgagaggaagaaaagggctttcctgacccaggaggaggagaagactgaggtcaagtcaatcaaagggacaaagctaacccctatgccatcaagaatgtatgtgcagtgctgagtactattttttggatctgagttgtgctgagtgttggtttacagagctccagaacccccaagtgtagaatgactcattcaccgatgtcatgtgtgtagagaagagatctgcaagcctggaagattcacctcttcaggctcttgttctctgtcccaccagcctagtaatatgggcaggtcttaactttataaagaggccccaccaaccacaattccatgcaaagcttgctgcagagacccaactctgagggtaaggaccccaggccagacagcagacaactgggcatctctctttctctctcatttcctcctcctccttctcctcctcttcctcttcttcctcttcctcctcctgctcctcctcctctttttttcccccagtctgagccctcactccccaccagctaactagcccagagcaagcagctaaatatagttccttattctttgactcgtagaaatcagccacaaactgtctgtcaacatgaatttctcagctcagttgttctagccatgagcagctgctgctcctgatacttcaccgggctgctctcaagttcatctttggtggggtctgcatggaaggaaaacacaaatttgagagggcagctttagaaagtgtgaaacgggcatagactttgaaattggagagacaggaaccaaatcttagcttgaccacttcctagctgtgtgatcctctgctggctcaattattgagctcttacttagattctgggagatgctctaagatctttccaataaattctcatttttgctcaggctaatgtgagttgggcttctgtcacttgcaagctgaataagaacttgcttctcaaccccttgggtcctctgctgatggcctcttccatccatcctcactcacatgttccattcccacattttgtaatctcttacccctaaaaagttccaaagctgttttctttctcttttacttttaagaaagatttttttcaagtgtaacacacttactgtatagtctcaatttgttggggtatagacgtgaaattgttttctaacttccctgagcctcactgtcttcatctgtacaatgggactactattgcctggctcacaggactgctagtacggtcaaccaggagcctagatggaaagcttctagcccaggcctgtaacagtgggagggctgggtagctgtccattcctctccctatgtggaaagttattctttacctatcaaacagtagaacagaggctagaattataatgcctgcccccagaaagtggctttattgagatgtacaaaatattctacattaatttttatttcattctcacatttattgagatgaacaaaatcagtgttatggattgttatagacacagtatctgtccctgtgccctgaccctgactgtggggctgtcaaatgtgcttcctggggaaccagatacaccagacacaccacacacacacataaacacacacaggaacacatgaagccaagcaaattcagagacaatttgatgagtgtaacacacacacaggagggtatatgcacatttgtgagtgcactgcaggcccatggctggatgaagcatgggaaatgggggaatccacagggcgcacgtagcccgccagtcctggctctcagcgctctccttctgggccaggcctgggccatgcttgtgttgagaggctttggcgccctctgctgactgcggtcctccctgcagccctctccaacctagccagagcaggtgcagcaggcccagggaagccaggcgtctaggaagggggaaaaccagaagggaagagactgaaaggaggtaaagaatggagggagaagagaaccagagcctatactgtccccaaagccaccaggatggaggacccagctatgcagccactcactgaccacagcagctgcttacagacaggagcatcacctcccaggtgctcatgatgactgtctagagaccctgtggtggcacagctggtggtgtgaagggcacaggccccagaaagttcctcaggctctggctgtgatgccttgtaagtccatgtggcagaaccatcaaccagaccagtgaacttttccacctcctctgggaatgcccagggccagaccttcaatcctgcaggctagggagcttgatgatggcaaacatggacttgggaaccagactgacctaggcagagtgcctgcactgcctctcactagctgtgtgaccttgggctcctaacctctccctgtctctgcatcctcgtctgcaaagtgaggggagtaagacagctgcagtcaggatgaaataaaaatccatgtaaaggccaggcgcagtggctcacacctgtaatcccagcactttgggaggccaaggcaggcagatcacttgaggtcagcagttcgagaccagcgtggacaacatggtgaaaccctgtctctactaaaaatacaaaacttagctgggtgtggtggcacgcacctgtagtcccagctactccagaggctgaggcaggagaattgcttgaacctgggaggtgaggttgcagtgagccaagatcataccactgcactccagcctgggcgacacagcgagactccatctcaaaaaaaaatccacatagagtgcagcccagggcctgaggcaaagtgcataataaatgctagctactagcattactgttgtggtggttgttgcccttgccacgggcttcacgagagatgaaggacagagtttcatcagggcctctgcagctggcatgactcctgggaagtggagggaaggtgggatcatcagaatctcatgtttgcgtaaggccatgatgtcaggctgttagattcctgttaggaacacctgtcccaattgtctgaccttctttcttctagggtggcatagccctgttcctctgcaggactcatcacagccagggaggcccctcttctggtgttttcagactcaaggacaccgagactcacttctttctcatgacataacctccaagttacaacactcagaagctgtcagtggtcatattttctgtcttagacaaaaccagtcttctgggaaaagaacaaatgaggctgatctgcagcaagaagcaaaaacaagaacctggtggggctgctgtggcttgcaaatccctggttccagatgtctctaaggcccacccacatccccgcccctctgctggctcaattattgggctgtttcttagattctgtgagatgctccaagatcctccaataaatcctcatttttgctcaggctagtgtgagttgggcttctgtcacttgcaagccagagaacaaggactagcttctcgaccccctgggtcctctactgaaagtctcttccatctatcctcactacccacatgttcccatcccacatttttgcaatcctctacccctaaaaagttccaaagctgttttcttcctcatttaaggactttttttcaagtgtagcacattttttgtagggcctcaatttgttaggatgtagacgtgaaattgttaataatctcccctccaacacacacacacagtcaactgtgctctattgaaatccctttcctactgggtggtagggatcttaatgacatcgtggctgcgtcccacaactccgccgtcactttcatctactagaactgtctcatttcgttaatcaagacttcctgtttgtctctcctgccattcccacttctgcccagatgagagtggtgactggccctcccccaccaacaaggccacaatggaggggagcatccagctccagatccgcctccctatcacttttctagtctctcagtgactgcggggccaggagagggacttggaagcaactctcacatgtcctctcctaggtggattgtcactgcttctctggctactccactccctcctctctgccctggtgactgtctcgtggacagcctgtgcattctctcaagccctagagagacgccctcatgggtgggacaccagcttgtccacttgagcccagccacctcacacagctctctctctccactccaccatctgtcttgtattgccctcttccccaactcaggcagctcagaggtatacaagggggttcacagactaagcagatgcccccctgggggatggtatgcttgtctctccttacaagaaattatcttatgttatcagggaggaaaggcacccaccccacccatcatctcccgtgaagaggggagcaagcagcctctaccacaaacactgccctccccacatggcaaccgaccattccatcccctgctcctcttccagtcactgtgggaggtggtggtggttgatgagagaagagccatcagccctgcgggagggagatggtactagctgctgaccacccactgacaaccctctgaatgcagaaggcagggtccccagtgccttttgtactcagctttgggtgttagctgcaattccagaacaggaggaagagtcccacacaatatcctgttatgctggtgcagaactctcctccctcccagatcccagctgaattgatcaaaagactaggaaagaagagaacgcctgttggcctggactgaaagccagagaaggtacattctcgtgccaggaaagctggggattgctgtaaagtgtgcaagatacagattaaaggaagacctcaagggctgattcacaactccaattcttgagaaagcaaaactatactatgagaagtagatgaggtcctggcagaatgtactgaccctaaattagggcagatggtgggacacggggcttgcagggcatctttggaaagccctttccatactatcaactgccttgggaaggagctgactgggaggtgggctggggtgggggtatgtggttgccatgtcaagtaggtaactgagctgggtggggtgggaggagttcctccctcaatcaggttctctctaataccgtgttcctcctttcctgttagtgggggcagaagtcttatcatagctatgttgaatacctacaggaacagccaggaaaccctggacgctgggcaaatagacctggcccttggtgcagaggaggcaaggttacctgctggacctggccccagccaactcccacacagttgtcccagctagatccctgagctggtaatggcccttggacgctctacctggagtggggaaagaacggaacacttgcacacaaacacacacacaaacctgcagccagctcaactactggctggtgcctctggtgacaagtggggagacatgtcacagacagtttgtgttcatagccaactggtgatgtgaaattgcattaaccagtcctaaaatatgacaggacaattggagcaacatccagacgaagggtgacctaaagagaatccatttccttctccttgtttgggggaaaatagtaagattttataaaacactcacttttagctcggtgcggtggtgcctgcctgtaaatccagctgcttgggaggctgaggccagaggatcacttggggtcaagagtccgaggccagcccaggcaatatggtgggacccagtctctaaataaataaattaaaaaaaaataaaattaaaaaaagtttaaaacactcatctttaaagtaggagtacagagaaaagcaaacacacacccccacacacaaacccacatgcacacacatatacttggaaatacacagagcctttgaaaagactctgcatgaggcaagaagagaacgtggccctaaaagggcagagaaaagtaattcctttgaaaagatttatcacataaacataaataacttgcagaccacatctgttctgtacgcaattcatttaattaaagtgcgcactctaagaaatgagagttgaaaaataagatggaaagaatgaaatgagaaggctgctgactgagaggcaggtggaaatcaaaaacaaaccagaggagagaaggaaagactgcaaagaaactaaaaatgcagtagaattttaatttccatcaagatggtaaagaacagaattggaactacagaaaatggaatctgtaaatgtgaaggacagataggagaagttctctgagactgcagaggaaaagcacaacaggataaaaaacagagagacaacatgataggtatccgggcttacagaagacactaaacaaatgaaataaaagcaagaatcacaggagaaagatgtccctgagctgatgagaagcctgggcttatacatttaaaagattcctccttaagtcaaattaataaaaataaatgaacacttagaaatgccatgtagaattttcaaattgcaagggtaaagaaagaattctatcagcacccatgcagagagaaatatggagaaatatctgcaacattcatttttgttgttgttgttgctgagaccgggtctcactttgtggcccaggctggagtgcagtggtgcgatcacagctcactgcagcctcaacctcctgggctcaagtgatcctcctgcctcagcctcccaagtagcttgggactacagccatgtatcactatgcccaggtaatttttttgatttttgtagatatgggggtctcaccatgttgcctaggctggtcttgaaatcctgggctcaggtgatcttcacaccttggtctcccgaagtactggggttacaggtgtgagccacgacacccagcccaacatttcttaaagtgtataattggaagagagagtccatggaattttgttaactatttgtactgaggaaaaaagtttctgtcataaaataagcttgggaaatgctgaattaaacaaaacaagataaaaccctatgctgaggctttctcagggcttttaacgtattcatgcatgttattaaactggcaatattagcaagcccagttttccaaacttatttgactatgaaatcctttgccatagactatgtggtaagactggtgttcaatagaacacactttgggaaccactcttttacagaattttgagagatcagttgtgaccttacattttaacaatttgcctggtgcaatcatgcatgaagacaacagaaaaagactttcccacatgccagaacttaggacacatgccatgtatggctctacttttcacggggaaaaaggtactcagagatgcactctttccaagccagcaagagtcaaagtaagtaaaataatagtaagtgaaaaagcaagtcctgggctgcaattctcaactttggcccatataaagtctctaaattaaaaaaaaaaaatccaggctgggcaacatggcaaaatcccatctctacaaaaaataaaaaataaaacattagccaggcatggtggcataagcctgtagtcccagctactcaggaggtgggcagattgattgagccagggaggtcaaggctgcagtgaccttgacctgcactccagcctgggcaacagagtaagaccctgtctcaaaaaaaaaaaaaaaaaatcaacacagagaaattgtataaaagctctggaagtgaatattaaaaacatgttaaacacatggttatgcacgtatcagtcaggaagcagaaatcacaccagagccacttccttccctgcccagccctgagccccacaaactgcattcatcacccaggctcccttgtcctccagctccttgctgagtctgacaatggagggtatgggcaggagtgtggaaggcaggaggtgagaagagctggtgtatctcatctgtgccctgcctcttttcgtgccctctctctggcggggactttgttcctccacaagctcagctcttgcctgcacctcttctccaaggttccagctctccctgggctctggtcacactggttcctcccattgtccctgaagccctaaggacagtaacaccataatgtctagtctctgggtacctcaccatccttaccatgccttttttgttcacttaaccttatccacatttccttttctttgagacagagtctcactctgtcacccaggctggagtgcagcggcacaatcttggctcactgcaacctctgcctcttgggttcaagtgattttcctgcctcagcctcccgagtagctgggactacaggcatgtgccaccacacctggctaatttttgtatttttagtagagacagggtttctccatgttggccaggatggtctcgaactcctgacctcaagttttccacccacctcggcctcccaaagtgctggaattacaggcgtgagccaccgcacccagtccccttatccacatttctataaaaagtcccttcattaaagtctctttagttaaaccatcttgggtgagtgtttttttgccaggaccttaactcaaacgcttctcaattctttttgtaaagccagaataaccctgatactaaaacctgacaagtggcacaaagaaagacagaatgaatgagtcatacacctgcctcatttatacaaatgtagagtcctaatgaaaatttaatcagataagtccaatgtatgtcaacaatgtattaaaagaatacaccatgagcaaacattcctggaatgcatggataattctatattagaatggcagtgaactgatttaccacagcaataggtcaaaggagaaaaagatcattttacatactgaatagatgtttggtaaattgcgacatccattcctgattttctttttaaaagctcaagtaaacgggaaatcaaagtacacttatctcacatgataaaaaataataaatctcaaaccaacagccaaaaccaaaagcgtaaaatacaagtagcattccaccaaatctgagaacaagacaaagagttctaatatcttgttatttaacattattctaaagatcctagctaatgaaattagatagaaaaaataaaaaagagggaaacaaattataattatttgcaaatatgattgtcttcccataaaaaactgagaaaatacaaaattatcaaaatagaagaatttagtaaagtggctagttataaaataactttttcttttcttttcttttttttgagacaaggtcttgctctgtcacccaggctggagtgcaatgggggtgatcttggctcactataatctctgcctcctgggctcaagcgatccttccacctcagcctcccaagtagctaggactactggtgctcacgccatcatgcccagctaatttttgtattcttagtagagacagggttttgccacattgcccaggctgttcttgaactcctgagctcaggcaatccacccacctcggccttccaaagtgctgggattacaggtgtgagccactgcacccagcctaaaataaattttcatttcctaataaactgttagaaaacatgatgcaaaaaaggggggctatattagttatctctgctatgtaacaaattaccccaaaaccgagtgacttaaaacaacacatttattatttcaagtttctgtgggtcaggaatccaggtgtggtttagccaagtcttctggctcaaagtctcttacaagggtaaaagtaaggggtcagccaaggctctggtgtcatctgaaggctcaactggggaaggatttgcttctaagttccctcacatggctgctggcagcatgtggttcctcaccagttgttggactgtgggcctcagctcctggcttgctgttggccagccaccaccctcggttctctgccacatgggttttccataaggtggctcacaacacagcagctggtttcatgagcacaggaaagcaagagggttagagagacaaaattacagcaaaacagaaattcgcctcttataacctaatctcagaagtaacaacccatcattttttgccatattctatttatgagaagcaagtcactagatccagcccacacacaaaggaaagggattctccaagggggtgactatcagaaggtaaggatcattgggagccatttcagaagctgcctgccacagatgtcattgctttattttatgaaaataagcaccaaacacactacattcatctataaaataaagcttccctaaagacctataataaaaaagaccttaataatagaaagatatgccacgttcccggacagaagcactcaatggtgcaaagaagttgattatcactaaattaatctacaaaactaatccaattgcaatgtccagtgggatttgtctgctagtttatctcggcagaaaaaaaaagtttagaatttatcttaaagaatatatgaattgccacaaagaacacctcaaaagaaaaaaatgggccaggcgtggtgagtcacgcctgtaatcccagcactttgggaggtcgaggcaggtgaatcacttgaagccaggagttcaagaccagcctggtcaacatggtgaaaccctgtctctactaaaaatacaagaattagctgggtgtggtggcatgcatctgtagtcccagctactcgggaggttgaggtgggagaatcacttgaaccagggaggcagaggttgcaatgagccgagatagtgctactatactccagcctgggtgacagagtgaaaccctgtctcaaaaaaataataaaaataataaaacaaaacaatgggacttgtattctcagtcattaacccttattaaaaagttacaatcattaaaatagggcaacaaataccaatgtaagaacgatgtgataggccaacggaacagaacggtaaacccagtcaaacacacaaaaatatttagtgtatgataaaatggcctttcagatcattggaaaatgattaatttatttataattcatttggggatagttggttaatttgctttaaagttatgttcttacctctcaccacacatgaagacaaaatgaagagtttaatataaaaagtgaaatcataaaatctcagaagaacatttaattgaaaatttatatgttcctggtgaaggcagcggttatgcaacaataaagtccaagaccataaagaaaagattaataatctgacagcttaaaaatgaagcatcaagaaagtattttaaaaattgatggaaatgacaaattagttgcataatatgtgacaaagagtgatatatgaaaaggtgctaaatatacatcttataaaccaatactaaaaagatgaacattacaatagaaaatagtcaaagaatatgaacagaaaatttaccattcattcactcaacaaatatttatcgagcacctcttctgtgccagacaagtttacacatgggacacagcagtgaacaagacaaaggacaaaggtccctgccccaaggagcttacattctattggagaggggcaaacaataaacaagtaaattatgaagtattttagacggtgataagtactactggcaaaaaagaaaaagaagggttaagtaaggcgatcaggagtgaggcatggggagctcaggggctggggaggtctcatcaggaaggagacatttgagcaaagctttgaacagattcaggtagttgaccacacagagcaggggaaattgccatggtgcggcggaggggcaggagaaggccaagttggctagaacagaaagagcaagggaccaagtggtgaggaccctggaggccttgaacaggactttggcttttaacctgagaaccattgcagagctttaaggagaagagtgaaattttgacttatgtctcaaaaaggatcattctggctaccatcttgagagcagacttttggggtacaaaggtaggagcaaatagaccatttaggaggtcagcaaacacatggcaacatgttcactctcacgggtaaccaaaaaaatgcaactaaaaaaatgtattcacctgtttttaacctatccaatttttaatgttcttttagaaaacagtactcagtatcagtaagggtgaattaccttcgggcaggtaaatgggaaccacctttctgggaccagctgggtattctgtgccaaagcctcaaaaacactcaaaccctttcaccagaaatccaacttctaataaattaatctaaaggtctaataatcgccagtacttattgagtgcttgtatgcaccaggctctgaactaaacgcgctccatattacccccatttaaattcttaccattattcctgtcttacagaaagaaaaaaggcatggtgagtcacacagttcacaaatgagggctagaaccaaacccaggcactgtgacctgctacacaggagaggcagatatgaagatttcttcaagggtgcttattacagcatcatttataatagcaaataaagtacccaaaaaaatcaacaaaggaggtgattcattcagttatgatttgtccacataagtcagtcattaaaaatctggttaaagaaaactcgtttccgatccagccaggtgctgagacaggcagaactttccagagcttctccttggaagctgccagctgctgtgatgtcctatttcttgatccaggtggtaatccagaggtgtgctcacgttgggatcattcatcaagtggtacacctaggatttgtggacttttgtgtgtgtgtatgctatactcatgtttttaaaagttatttttggccgggcacggtggctcacgcctgtaagcccagcactttgggaggccgaggtgggcagatcatgaggtcaggagatcaagaccatcctggctaacatggtgaaatcctgtctcacctaaaaaaatacaaaaaaattagccgtgcgtgatggcaggtgcctgtagtcccagctacttgggaggctgaggcaggagaatggcatgaacctgggaggcggagcttgcagtgagccgagatcgcaccactgcactccagcctgggagacagagcgagactccgtctcaaaaaaaaaaaaaagttattttaaaaaatttaagttgccaggtgtttctcctcctacagggacacaagaaggctgtggagcaggattcttgggccagggatgaggccctagttatgtagacccaaggctggtagccaccacttgctccacgtggaaatggctctcaagattctgtggtctgagaaagcctggtccttcccatactgcaggaaggaaatgctatgcaggaagcggctggcctcctgggcagatagaaatgaaggtactccccgaccccacaccctaccttcccattccaaccagtgggttgacatttccacctctaagtgaaactggcaatctgactgcaggcccaggatccaggtccagtcctgagggagacaaggtcctaacaggggagggactcaccgctccggaacagagagggtatcttgcggagtgggggacaaagtcttgacctcctcttcatccaggcaggcaggagctcctgtgatcaatatgaatattgaaacggcagttaccttgaaacaaggaaatgttcatcaactgttattacacaaacaaagcagcttgtaaaatgacataggcactatgatcctaattgtttttttaaatgagtgggggggtggagcctaaaacaatggtttttctctaggttacagaatgaattactttttcttttttactctgtattctaaatttcctataattgacctatttcttttgtaatctgagattaaaaattgtattacaaaaaaacttaagggagagattgctgatatctcatctttcatcaccctgtggccctttcctttccagaacccagctgggcaaaactagtctccactggccccaagggcctgctccttctgttacaggaaagggttcccgatccaggccccaagagaggcttcttagatctcacacaagaaagaatatggggcaagtccacagagtaaagtgaaagcaagtttattaagaaagtgaaggaataaatgaatggcgactccataagcagaacagccccaatggctgctggttagctgtcatctatgattatcttttgattgtatattaaagaagggatggattattcatgagttttctgggcaagaggtagggagttcccagaactgagagttccccttccttttagctcacatagggtaacttccggatgttgccacagcatttgtaaactgtcatgcactggtgggagtgtcttttagcatgctaatgtgatatgatagtgtacaatggggagtgaggacaaccagaggtcatgatcatcaccatcttggtttgggctggcttttttttttttgagacaagagtttcactcttgttgcccaggctggagtacaatgacgtgatctcggctcactgcaacctctgcctcctgggttcaagtgattctcctgcctcagcctcccgagtagctgggattacaggtgcgcaccaccacgcctggctaattttttgtatttctagtagagacagggttttaccatggccaggctggtcttgaactcctgagctctggtgatctgcccgtctcggcctcccacagtgctgggattataggtatgagccaccatgcccagccatctggctttttttttttttaattgcattctgttttatcagtggagtgcttgtgacctgtatcttgggcctcctgtctcatcctgtgactaccaaggcctagcctcctgggaatgcagcccagtaagtctcaggctcattttacccagtccccattcaagatggagcccctctggttggaatacctctgtcacttccatcaccacatccagtctcaccccacaccacctccccttctccagctccactaccaacccccaccagggggaaatgagtaaactgcatgagctctgagaaagcagaaaaaaagccacctcatgaaggtgaaccaaggactgagtcgctgacagacagagatggatgggtaaatgggcagacagacagacagacatggagactgaaatagaaatgcctcccaaaggtcacagagagtcagtgccacgtcttcacctccacccaggactatcacttatacacccccaccagcctgggcacccactggaaacttggcaggtctggctgctctctgtgatgactgcagtcagcacagggcctggtattccacagatacccagggaacatgctgagtgagtgagtgagtggatgaatgaaggaatcgttcattggtagaagcatcagcagatagagatgacaggagggagtgtgaaagagagttgaggaagaacagaaacagatggagacagatggaggctgcaagtcacagacttggccacagatagaaaatgaacgaataaggtggagggaggttactgcagaaaatttaaaagctatagaaagccggtcgtggtcatgtgcacctgtagtcccagaggctgaggcaggaggatggcttgagcccaggagttcaaggctgctgtgaatccactgcactccagcctggggaacatagcaagactatgcttttttaaaaaaaacaaaaacaaacaaagaaaaagctagagaaacccagagagatcccagtgaaagttaaatttacagacaaaaagaaaaggagagagagagcacaagccctcccttaacttgtcaggatgttagcagagagaaccaggggttcctgccttagtttccctcctagatttgcaggtctctgctggactgtgtcccaagggcctggcgccctgcttggttttgtcagttctctccctcgggcaggggacagtttcctcttacccccacagcatgccagctcagggccctcccacccagaaggccccagacaactatgcagaatccccccgccaaggcaggtccctgggagaagatctctctccccagctggtcctcattcctgcaatgacaatcggctcctgtctccactggctctgggctcagggcccccgggttggataggggttggggctggaagtggaggtagagacaggagcctgcttgccccagactctggggaggggtgaaagtcagagaggggagaagctctaaggggctgaggcggcttcccgcctccacagagcccaacctgaatgcccagagtactgtatcagcttggttatttccaaatcccctgggagccgtaggggaggggacccagagagctgggaggaaaaccgactgggaagtagccagagccacagaattctcctgggtcctagagaagggtgggttccttccacccccaaccccattagtccctcgaaaaggctctgacctcacctcccccacttccggagtggagttccagccctgaagaaacacttccaaacccatggctctggccccctcctcaggccccctcctcggctacctcggccctggggactgggtcccccaccccaccgttgcgccagatgtggctgcaggggaggggtaggcacggggcccagctggcagtggtcactcggtggtcctctccctgcagagtcagcactttctgtgccagctcgcccagcctcctcactcagcacttcctccagcccgctttccagaggcagcagctgcctgggttgggtcttggattcccagtgctgccccaaacccatctacagcgcagcctggaagatggagggtttgggtgctctggggccttccctcttggcatccccactatcacagaaaattccgacccaccatgggcctcctagtacgtccctctgcaaagcaagggaggaatcccacagctcctgacccctctctgctccccagacccgctgctggtcaggcctgctgcttcctggttcccccatggactttccagaactcagccttccatgacagggtcacaggaccctggctgctccgtgggagccccggcaacacagagctgagcacgtggcaggggcttaataaagtcatgcgcaatcaacaggctctttcatccttctatcaccacccctccgagggtcccttgacaccggttcctagtgccaggaactggcaacaagcttcaagcacatgcctgggtcttaaaaatgtgggtgtgaatcccagcctgcagggacaggcggagagagaagctgcccttcaccccagacagctctggctcagctcagccttcgagtccacgccctcatttgaccccagctctgcaccctccataacctgcccaggtctcttttaggaccccaccctgcaggtttcaacctaaggatgccaggacacctccagccaccaaggcaaggccttgcccagcatgaggagaggtgatggaaggcaggctcccctgggctcacagaactgctgggcctgtcagccactgcaggagacctaaacccaagtagaatgaggtcagaaggagggagtagagaggaagggagaggacagctctggtggaggggccacctctggcccccctgcacaaggttcaccctgagcaaggaaagatgctgaagacagataaaaacaggaaagacagaggaagtgggagtgggggtcaaccccaagagataaatccctcccttctctcacaagtcaagaggaaagaaggaaaatagtggccacatgtctggctctgtgctggggacttttcataatcctctcattccatcctctcaaatatgccacaagaaaggtatgattacccccaggtcacagacgggactctgaagctctgagagcttaaaaagcttccccggggagtggctgggccaggccaggtccctagctcaagtcatggtgtggacccccaggtctccatctcagcagggatggctggcaggagcgcagtcctggccaggggagtctgtgcagaggcccaggctatgttcagagcagagtttattcaaatagagcctaacaggaaacttggctcctctgactcactctgattcgaccttattaagaaaaaaagagagaggagcaggagccagcatcgggtaaggtttcacgccaagagctggctctgaggcccgctgagtggaatggcatgtgccctgatccccccacatccaaagccttgaggcagcccctgccctgctgtccgagtcaaggcgaggggtcctgccttcacgttagggcaactgagttcccttcctcacagccatcctctgtcctccctccactcctcttcccttccctccctgcctaggggtaccctgaggcctgtttccatttctccccctcctctgctgcagcagctgcccatctggctggcgggagggccctacaggaccccagggattccaagcagctgaggccaacactgcagggggcaagcaggagggagggaaggcttaaccctccaggtcccggccctcagtaagccctgcctcagcatcttgcttggtgtcagtcacaccagtggctctttggaggaatcttgtctggagtctgagatggaaaccccatgctggggagctgaggtgtcagcgttgacaagttgctggccaggaggtattggaagccccctacctctgggctggattctgggcatttaaagggtagagacatgctggagtccaagcctcagtcctgaagaacagtgcaatgggtgaacaaatgctgcctggcaaggatggggttgggaggtctatagttcccaaagaatgtccactctagttgcctcctctctaggtgggctccaggcatttccaaaataaagaatatacaggagccaaattaaggacaggtccttcataccttgtttataagcccaagagggcaatttctgcccttcggttcccaggaacacggttggagaaggcagcccaggggaggccagaagagcagtatttggagtgtgatttcttggatgccaaagcgttcaaacttctgggaccccctcctatccctgccattcccagaaggaacagagaatctcccaaagcactctcaggagccatctggcctaatcttccattggtaagccgtggcacctggatcagatagagtaagggactaagccacacagcaacaggaccaggccaggtctccggaacccccttctgttgttcaatgcttactggcttctctgcctcacagtgacccctgtcccatatcaaagacagcccccagtttcattttatccatgtgtacactcaagttattcccaggctatgcagagccaagagatgtaggacagaaaccatacgtgatgtctgggaagttgatctctcccaggatctcacaagtgcttttcagctcagggatacaccccactcttcagactgggaaagtaagcccctgaggtgtgccacgagggaaaaggtgcagctccagtgcctctcttcgcaggcccaagagctgcggtgcacctgggacctggaattagagagtggtccctgttcagcatctccccgaggaggcccaccaacaaagagggtgtgtcttttttttttttttcttcctattgagggtgtgggataatggtggaaggaacatgcaaagagggtgtgtcttaattagcactggctttagggaacaaggaaaagggagaacccgggagtacgggaaggaggctggggcagacaggagtcagaggcccattccagcccaaacgagaagccagtgagcaaggtggagaccagggatgctgtgaccaaagcagagaggaatgggcggggtggtgctgacaccccagccccgttctgcctgccagagccccacttaccaggcccgagtccccagaggtcccctcctactccctgctcgattcccttcctcagaggcaggtctgtggcttggctgggaactccagggactgagggagcactgcagctgtgggaccggcgcatagctaaaagccggcgggccatagggccccgcggaggaggccccagcaggcggaccaggaggccgaagcctcccgacgctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtgagtacggccccggcgcccctccggccgcgcgtacccctggccactggaaactgctccgggccccccgggcccctccttagaacttcctggaggcctccccggagctgctaagcacggagcagcgccccctcccgacttcccccgacccagccaacagcacccccctggcatctcacctcccagcttaacccgcacccaggcatcatcagtgccaggggttggccaggcaggtgtgggctctgatcctggctttggtggagggactagccgagctttgggaggaggctcgccttctgcacttggcttgggtcatctgaggacaaaaggaaggagcccctcatccaccttctccctcatttcaatgagggcatctccttccccccttagagatgttctatgccagctcacagggtgaggcaaggagcatcagaaacctgagtcttcagggccagaaaggccttaagggatgcccctggaggtgtggcaggctgcccattactgggcatgtgtgaggttggcttgagtgcgcaggaggttagaggggagcgtgtgctccaggcaggagtccggacttcctcaggggagtctgcaaggctggggcaagagagaccagtcaggcactggcctgggtgcagaatttcaggggctaccaaaaaacacagtagttgagatgagtaatattgagatgtatttttttaagtcaaaattaatgcaaaaaaaaaaaaaaaaaaaaaaaacctgtgataaaggaaatatccagattttaaatagagtcagtaatagtggtatgccgagccatattggagcctgaggctaactgaaaaatcagcaacacggatcctgtctttatttgatatttggatattttgttcattacagatagttttgcattaatttttattttaaaaactattgtgttaaatattacttatctccgttactgagtttttttggcaccccctaaaattttgcaccccgaggaaaaaaaaaaaaaaacacctcactggcctcattcccctcaccctagtcctggccctggcggagagccccagctgtggacaggactccctctggcttttcagggggtgaacatacgtcctcctcttgggaaggcccaagccctctgcacatgaggacacagtggaaaggcagcttccacacatgctgttagcagacagggctactgtgacaagggctgactggtgggtgtggccagtgctggacggccatcagccattctctgctgtcctagaatccccctccctgctaccctctccatacaggcagcttttgggccaaggttttctactcagtccccaatacttatgcagtccaactctgccttgcctctttcaagctgtcgtcagtttcctctacccataattctctgctccccattgaggttgctgtgcctggcccaccaagtaagggctgactgagccctccagtgcctcagagtataggtgctagtgccccagcctcctcctcagcctctgtcagcagagggatgatgctttgtctccagccaagctgacctcagtgaggggctgctgctcatggggtgcctgtctccctgggtactgctggaggccaagactaggggagaggagcgtctccactgggaacactcactctatcacatccaaggtgtcgcttttgagttgtgtgctgaatcccactttaagaacctgcaggagctcaggaaaaatcagatggcaggtccttctgtggtgtgatgaaggatgcatccacctgctctggtccttaccaggtacttgcagcatccctgcagaagggcgcattatagccatgcatcagctgctctagggccccttggagaataggatgttttacctagagggtgctaaacttttgcagtggcttttcttagaatgcaagacctcagcatgaggctcagcctgatgggccccacctctgggcagagaaaactgagctctcaaatgccacaatattggcagaggcatgcctgggacttggcatctgggcaccaagtcagtgggtcttctagggcctgtctttgggctgttagttcttaaggaagccagttgattgagaggggaatgggacagggcaaggccatgtctgaagtgggggtgcttggtgcttagcagacctctggccactaccctgagccccacagttcattttgggtcaaaaacatttctcccctgaaggtagcatcctaggtgccaagctgagtgtactcacatgcatcaagtccaggcccttccctggggcagtctaccaggaggggcatctcagtgctgtgattaggcaagcattggtggggccaggggctttgtgagcccagaggagggccctccctgtcaggggctagggctcagggagacttccacaggaagcaatgtctaagcattgctgcaagggatggtcatcagcaccatccaggtgccccttcccctaatcattgagggtgtggggtgggagtgtgttttttgctggggaggggattgcaggctagtttagggctcacaaagaggccagagagggagcagtagtctctcccatcattggttcctccctccccaccctgctaggccagaccgtggaaaatcccagcccagggaaggccaagccttgtgcttgagatcagacccccaggcctggtgtgggagcccaaggcggattctccgagactgacttcattcctcctggccacacacccaggggtctgaggctgggcgctggcagcctgtgagtgtgtgtgggcgtggacgtgtcctcacaacaccaagcacatgtgagcaccacccacctccctccatgggtgggtggtttccaagcgcctgtcctgagcccagtttcttcctcgggtacctgtgccctcttccttcctaccctgggcactgagactgcccaaggcttcctgcagtaccattctctccaactctgaaacatgaaactgaaaagaaactagaggaaacagaggcccagagagggtcacatactttgcctggctctcatagcaaatccttgaagagaggcctggagggtggccagccacttcccaggcccagctgggtctcctgcactgtgtcggctccctcgatgtgaccactcctgctattaccaaccaggccctcctctcctgggatcctcgcctcagctcctgcctccctggagtttcagcttgtctgagctgggggtcttagtgccacctaagaagccccacagccccagaagaccaaagctcccctcccaaggccttaccctcgcaccccccgcctgactcaccggctctggcaatcctgtgaaaggaacatggaacaggcagccctgggcatcctcccagggcatcttggatggctgtgctagccttgcctgacgtgtgtcctctatccctgacttcacatggccaatcagaggccaggagagaaccgcagctgcctcctccctggtcccttgctcccagtctctccctcttcagtctgtcctgcatgtggggcagataaacccctgcagtctgaccaggttactcctctgctcaagaagattctgtagctcctcagggcctttaggacaaaatctagtgtctcagcccagcactccagagttagaggcacctccttcctgtcctttcttcctccttttctcaagcctccacagcccccatgggaccatgctgctcgtgggcctagatgttacacctccctagacacatgcaagggtgtttctagggtacctccttctctgtccagcctcctgcacccaagaggccagacctgtctggaccctcagtccctgagagcagccctggctgcctgctaccacctctcctgcctgagcccctagctcacctgggcctgctccaccccacctccacaggctgcctgcccacctctgccctccaggtcactcgccttcccctgcagagtttggagtagatgcagggaaggaccaaagcaggcttcacccaacaagcttccagagttagagcccagaggcagggataataataccaacttggccatttgctgaagaccacttcctgggcttactgacttcaatgtgcagtttcattcatcctcacaacctcctaatgaggtgcagattatggtcctcctggtgtagatgagaaaacaggcctagggaggtggcacagaagggtacagccgagcttgaattcaaactgaacctgtgctctctgcatcacagtgagatgacccaggaggatatcatgttcagcctgcgggcagggtggggcagggcatgagcatggacccctctgccagctttgcctctgtggtcctcacctcccacatctgcatccagaggaagaattatgcttgcatttgctgagtgcgttatacatcatctcctttaattcccaggtcctagccaggtactgttatttgtcccgtgttacagatgtggtgacgagctcacttgctgacttttagtagtggaaccaggatttgagtctgtgtgactctctatcctgagttcttaacaaccatgcatttaaaaaaaaaatttatatattattgcttatcttgtacacctcatttattcactcattcatttggtcattcattcattcaacagatatttgagtgctagattctgggcactggttgtgacagggtgagatgggacagtgagtgtgaaagactttggaagcagagtctctccccagtgtggggttagggtgtagcctggtcatggtcattgcagattccagaacgtttgtgtaacaaacactcatatggtgcatactaagtgccggacactgttcttggagttttgcagttagaatcacttaatccctgtgacaaccctgggattgttatccccattttgcagatgaggaaactgtggccctgagaagttaagcgacttgccctggaggcagaatcacagatcagcatccctccttccttccccgaagttgtctcagattgttccttcagaaagaaaaagagtcttcaggcttagaaagctgtgtcggatcagacaagctgtggaaacggagggttctgggccctcctcctgcctccctgtttctcctttgagagtcatcagtgtctgaacaaacaagtggagtcctaagcagcctcattccaggcagacttcctgtctcctctcttatcagccacttgcaaggcaccttctctctcccctgctctcaaactggaccatccctgcaagaagagacagctcctgttttcaataataagaataagaatatctgatatttattgaacatacactatgctaagcattttatttttctcatttaattcccacaacagccttgtgagataaatagtattatcagctctattttatagatgaggaaactgaggctcggagaaattaaccaactcacccaaggtctcagggttaatgagtggccaagcttagacctaggctgactgtccaatccagtgggccctggcctcactctgttccgtctcttagggacgggtgttttatattctgtgtcacctgtctctgtgttcactgttcccctgaggtgtaaacacctgaaaaaaaccaaatttgggtttttgcctcaagtttgcgggccccacagagttgctggggatggtggcagagcagggttgggagccattagtaccattatgggcaccaggttactgctagacttggcctgggagctctggctttttgtcctctctccttcctcctaacctcaggggtcctcactgcagcatcctctgctctcagaaggtgtacccctctccagtagctccctagtagctcctgagtccattctacctcctttctaagctgggaacacatggaagacttcccaggacagtggctgacatgggcaggagaggaaaggggcagggagggagctggggtccgcccaggcggcccacacctccttccaattgctgtgcccagcattcctgcagaagagcagtcagggttgggatgctggaaagagaggtttagacttgcccctcccctggccctgacctagccgcctcatttccacaggcagctggaccaagggccttctttttgtcgggactcatgatcacagggtgagggttgggtctgggtccctctccctcttgctgatgggcacccagaaaccaggcattgcagtaccacttggaaatggggagaggggtgtcagaatgccaaagcaggaagagacacaggatgggaaagcgaggccccagaggcctttgccatccaaacctcaagagacaacccatccttccccctgcttgtgggccagctggaaccacaggttttccaaacccaacgcaaatctttctgcaaaagaaaggactctgggaatcgattccagaccctgcttgacaatgaagtctgtgctcacacaggcagtgccaccagacgttttatggagtatgggcattggctcacgcacttgccaaggacatacaggtgctaggccctgagctgggcgtggagaatttcaggggcatcccagaaccctccctggcctcactgacgtctcagcctggcagtgagaaaacagacacctggggtggagagtggcccaagtccatgtctgtctttgccagctctcagcacccactgtgcacctgggagacgtgcaccagaagctgagtacaggcaaaagataataccactcacccctgccctcatgggctcttgcctggctgcagaaggcagatatcatctcgtgaggaaatagggcagatatcatctcatgaggaaatagtcatttaacaaatatttattgagcgacttactgtatgctgggcaccgttctagagctgggtattcattcgtgaaaagaaagagacaaaattcttgcccttgtggatcttctattttcatgtataaacataataaatatgtaaaaaaaatagaaggtactaagtgctgtggaaaaatagagataggtaaggaagatcgggagtgtaggagagggacaggttgcaaaggtggtcaggcctcatgaaggtgacacttgagcaaagacttgaggcatatgagtgagccatgcagctgtctgcaggaagagcattccagataggaagacagccagtgcaaggccctgaggcaggagttccctggggttttcaggtgtgctccagtgtggttagaacagagtagagtggaaatggaggtataacaggggacaggtcagagaggtaatggggtccgggccatggggagcttgtcggccattgtaaggggtttgccttttattttctgtgcatcccttttactcagcgtttgagctgagtagaagcatgggtccctgactgctaaacagggcccctgactgctgtgccaggagtggacagtggagagtcagccaggggaaccgacaggaggctgttccagagagtaggaagagtggtagcaatggaggaagccagctttagggtatgttcttgagatagagctgaggggatttcctgctgggttggatatggggtatgaaagaaagagaggtgtcagggatcacacagtggtttatggctggtgtggctggaaggatgcaattgccttgagctgagatgggaaggctgtgggcagcgtaagttttgtaagaaatatgaaaatttcaggtcactgtgcagggcctgagagggcaaggagggaacccctggagtaactgaagcatcaagggaagcttctagaggtggggtagggggcaccaggcagggcctgcaagggcggggagggctcaggggcaggggttgggttcacgctgggaggaaatgtgcattaggtgtgcagagaggcagcagaggcttggcctctgagcagggagctgacctccgcattggttagcattgtctgcctccccctcagcccagcctgcctcctgggcagctggcgcaatcaagcacacacttacaaatcccttctgtgagtcaagcccttctgctgctgtctctccccattggtggggtggacaggtgagtgctgtaaaagggtgcagggtggtggtggaggggtgttcaggactgacagggtgggctttggagctaaagactgtgtgcctctgcataggtagagctggtgtgtgtgtgtgtgtgtgtgtgtgtgtgtgtgtgtgtgtacgcgcatgcacatgcatagctgggaattccaggacaagggcaccatggagtcagggggtaaaaaaggttggggtatgctgccagagacctgcctactgatccttaggattaagagttctggaaggctaggtaaggtcaaaccacagacggctttagctgccactctgagacttctaggcttgattctgtgggcaatggggagccattgaagaccctgggcctggcttgatggctgtcctagctctcaggcttgagctgggttacatcttcattatggggcaaagtggaatctgcagccaccttgcctgcctgctcaccaagcaggtgtggcactgccaggccagtgctgacaagttaatttcctgattatgagataatcatttcctagggaatcgggcagccagctcccgccgtggaggcctctctggctcatctttattcaaggccctgctctgcagagctttctgcttctctgccacctaggggctcctctggagtctggctgcgctagccaaaacatcccgctcagcacatatttcacaagcaactgaccagttcctcctggactttgtttatcctccagccctgggctcaagagattagggctcttttgcattccactttccatcatttgcccctcatgaggaggaggcttggagaggaaagattccagagacaaggtttactgaacccacaaaaaagaggaagccaagagggaaacaggtgaggtgtggacgagcaatgggaaggcagccacagggctctcagcgccaggcagcctccctccaggaaccgctgggcaggagggaacagatttctaatgaagcaggaaggatttaggtcagaaggtgggagaatttcctgactgctaaagtatcgtctgtaggggttgtgagagggctcgggctcttgcccaaggctggggaatgaactgaacagctcctaaaaagtattttaatctccaagtgtttatcgatctatccaacctgtgttcaggggccagctagttcagtctccctcatcatccagatggggaaagtgagcctcagaaaggggactggggagactggacaagacagtgaactcacctctggagcttcccccctgagaaggccccagctgcatcccaccagggaaggggcagatggtctttgtcctccggttcccgagggcgggcacgggagccgtcagcaactccagacccagcattgagcaggaggacagggtgggcttgtcccgagcacacaggccccaagagtcagtgtgacaggttcctcctactgtgctcctgcacactcccacagaggaagctccaggggcagagccaggatatagaacattggttctgtcttctcggctccgtgtcttcactgtcctggaggtttgaagggcatgctatagctaaaaggcttaccccacatcagtggctggctgtctccctgtggaatgaatggccctgggaccgtattccctcgcacgcagctcctccccagccgagcatcctggctttggccatctcaagggtcttcgctgccccgtgactcagcatccctgccatcctggcccaggctctgtgcagcctgcatctgaggaagaatgcccacagaggccggcacagggcctcaggccccgagtcaggtggaggacaattagaagtggaagaatggaggccatgaagcctgaagtggggctgggtcaacccaaggccacacagaaggcctatgacacagtagggcaagaccccaggctcctgtctccctcctgggagcaagaaattgatggtggccagggttttcctgggtagtctgagcaagcccatccacccagtctttgggtggtgagacccgccccagcctacccccaccagtggtgctgggggcttgggagaagactgagcagggctgtaggtgacccagggagctggctgcgtaccttcatcaggcccaggaggggcacgtacggccgttcactgtagcgtgtttgtggagcggggagttagaggtgacctggaggtctaaaacaggaggctggccgggtgcggtcactcacccctgtaatcccagcactttgagaggccaaggcgggtggaacacttgaggtcaggagttcgagaccaggctggccaacatggtgaaaccccatctctactaaaaatacaaaatttagccagagcacacacctgtaatcccagctgctcaggaggctgaggcaggagaattgcttgaacccgggaggtggaggttgcagtgagctaagatggcgccattgcagtccagcctgggcaacagagctagactccgtatctatctatctatctatctatctatctatctatctatctaggtagatagatagaacaggaggccagctagaagggacatagaggatgcacatcgtggaatcctatgtagcagtgacaggcagtgaactagatagaccttaaaagtttacatggactgggctcggtggctcaccccataacctcagcactttgggaggctaaggtgggcagatcacctgaggtcaggagttcgagaccagcctggccaacatggtgaaaccctgtctctactgaaaatacaaaaattagccaggcatggtggcatgcgcctgtggtcctagctacttgggaagctgagatggaaggatcacttgaacccgggaagcggatgttgcagtgagccaagatcgcaccactgccctccagcctgggctgatggtttcccctgtatttggagtaagcaaaaagacctcatttgactgggtgcggtggttcacgcctgcaatcccaggactttgggaggctgaggcaggaggatcacttgagcccaggagatcaaggctgcagttagccatgttcacgccactgcattcctgcctggacaacagagcaagaccctgtctcaaagaaaaaagaaaaggtggaggtggcgtggggagctggatatgtaccttcaccaggtccaggatcttcctttaaaatgcatactttttgaggtgagggctgatcacacagtctgataataactggacttcacccaacattggccactctgcttggagggcctgttgtaccctacaagccaaaaattgcagaccagcctccttactcctacactgatcgtgtccactagcccccaactcaatcaacccttctttatccccttccaacatcacataatcccccagccccaagccctgcagaggggccaagagcccaagcctgcaggcctggctgctgacgaaatgtcccctgggagagctgcccagagaaggagccattgttccttcctggaaaaacataccagctatgggagggggtctgctattccctgggacctcggcaaggatcctgagggtgaggcgggggggcctggcctgaactcctgaggctgctcctttccagcagcttccccgagctgctgcctcttgtgtcacccccatggccatgagggtgtgacagaggtggagctcagagagggagtcacaggaggccctggtgattgttagagatgtagaacaaagaaacttacaaaataatggtaagagtgattccatttaagttctagaaaaggcataactaatctacagtgattagaagcagagcagtggctgcctggggtggcggaggcggggagaggacttacagggaaggggccagagggtgacagaaacaatccacagcttgattgtggtggaagccacacggctttatacatttgttagaacttatcaaactgtacacctaaaatctgtgcatttcactgtgtatagagtacagctcaaaaagtttatttttataaaaagagtgacaggaggagtcctgggagggcaaggagacctaggatctcctcctggggtaccccagctccctgtgtgaccctgtgcagatttatgggcctgagcctcagtttcctccggtgcttccaaagacattatgtgccttggtgtcttgggggcaggacatggaaaacactttgggttgcctagaacagtcattaaagaggctctcctgacagagcctgaggggctttggaccagtcagtcaccctcaaaacaaaagttgctccactgagggcgagtaggactcagggcctgcccatagaatgccatctggagcggaggagacacacacaggttagtatggtgaaatctaagtgtagatcaatacagatggggtggtgagagaggagaattttgtgcagtctgagatatcattgcaatcaggggagacttcccgcaacaagaggcccctgcctgagcctgagattcctcaacagtaagaggaagaagatgatcatctgtagcgagggtcaaggctcagattgtgaccagcagccccaagctgtttgtccttagtctctcttccaattctccacatgcagtactctacaaatgcccctcctccataactctggcacttataaccctactccactcagttttaatcagacttgatgatatcacagcaattcctgtttttttttttttcctttagctgaagagctttagtccatcatcaggggacaaacagaaatgagactgagattcagaattgctgataggcatcagacctccgtctgtgaccaggatcagggctcggtgtgtgaccagcatcgggactcagactgggatcaggaacagggcttggtgtgtgatcagggtcaaggctcagggtgtgcccagggccagggttcagtatgtgaccaaggtcagcgcttaatgtgaccagggtcagaggtcagtctgtgaccaaggtcagggtgcagactgtgatcaggcacagggctcagtgtgtgtacatagtcagggctgggagaggccaggaacagcattggccctcactggccccacctggcctcttcctcccgctcctccaacttccctgggttgcatagccagctcatgaaatagcctagataggaagggtcaggccacaaaagctttgtggagccatctgtgcagtatttcttgaaactgggcctggggtgggggcagcaagctgtctgatgtcaaatgctgggtctcctgagtcttaaggcccagctaccccaccctatacgcagctgagggaaaggcactgggtgatggggaaggggcccatccctctcatcctcacccctcccccagaggcttccagggtccagagagtgagaaccagctcccagctggcttgagggcctatgggtcccttgggaaatgactgcaaacattcctaggggctcaagtaacagggcctaggctggccaagaagtcccccaccagccaggagccacctcatcctcacccacccttgtactccaagcttcctcatcattccaagtaggtgagatcaccctggctgcctggaccaggctcccccatgaggcccaggccccagggagagcaaagctagggtctgggaactcagggtggtgtggggtgggggatatgctggcagacacttctgccgatggcttagaagccagccttcccctccttggcctcatcttccagacctaaaagctgatgagagggtcttggcagcaggaaaggggtgggaaatccctccatgggactcaagtcctcccaccttgcctgctctcacccttcctgaatccctcaagagcagaggacttcaaagaaactaagaggagcttacagcctcatcttatcacttacctgacagaatccctgaggccagagaggagacggaattagaggccccagaaccactcccctttaagtcagtggctgggctgggatagagcccagggccctggagtcccccctgcccacacccactgctgcccgcacccaccccagcccacaccccatcacgaacagaggagatattccctcttcattccaatgcagaatggagtctggacacctaagtttggtttctgcttattcctagtaactcctgctcagactcctgcatgcccagggaggaaggtggaggggcaggaacaggacggacaggccccgggctctggcacatcctggggaacaagggaccacaaggacgggggcagtctccagacttcccctgggcgcttgaccccaggccttgcaggggagagagccagggcctccctcaggttggtggccggaggttgcagacagaggagggtgtggtcaggtctagggtgatgatggcaggaagtggtggcaggtgatggggggcgggggtatggggaggagtggctgcaccaggcagaaaggaatcctgagaaggtcaggctgggtgcccaggctgagaatcctgccctgtcagcagcctgctctggggaagtgttttccttctagcccatcccttcctgcccaccctgactcctgccagcctgcatccacctggctctgcccatgaaccttcagggacacactccaggccagaagcccagggctctcttggtggtttacaaagaatgctgactgcagggatgagaggaacggagggtgtctgggggctgctgtccagaggcctggggagtaaggactcgagggagtgcctctgtcaggaaattacatggttcactcattcctgcctccaggtctttgttcatgctgttttccctgccgtggacaccctttcccgctctctgattctctaaatcctgccccatctcccagatcttgttcatgtccaagcttttccaggaagtcttagcagctcccacaccgcagagctcgagatgtaagctcttgctgcctgacttccctgaccccacacctgggcccaggacctaacacccaaggagaatggcaaagggttttggggtatgagaggatgtttggggtgtgaggaggtctctgggcattagcagtggccaacctgatgctctcaatgtcatgctcttcctccctccccccttctctcccactgcccactccaggtctccctgacttggtcccagaccccaactatgtgcaagcatccacttatgtgcagagagcccacctgtactccctgcgctgtgctgcggaggagaagtgtctggccaggtaaggagctgaggcagaagtgtagagtgttgggatagtccccgggagtcacccagaacccagcctagctgtggctgccagctaggctgtctgcaagctgatgaccctggccaagtgccccagcctcccaggaccctgaccgtttcatcagtgagccttgcctgccccgagggagtcaggaggggaggggagcaagcgggggcccagcatttctgtatactgtacctcactatacaaggaactccacttttactgtggcacttcatctttatatgagccctgaaggcatgggttaccccctcaggaaactgaggagcaatgaaaggaactcaaaccttttggatctgagctgtttaatgagaaggttccttttgggagcccaggcttccagtggtcatacagggacccaaggaagtcctattgggtggatgtacctgcaggatagagcccaggagtatggagccatgtccacagaggacagttgtggctttggctggtccaggctgcctctgcctagtcacagcaggggcagtgagcccgggggacaaagaagtttcagttatatgttgcactggaaagaggggaaggagaccagtttccatgaacctagaaggtgagcacagctggctcgccattattcatgggtgatcctgcctctcgcagtgtttgcttctaatttataagcagttcatattctgctggaacataggtgctttgcggatacctccctgggccaaaataattagttaagattatgttatctgcttcttttgttaatatccctttatgttgaaagcacctatttttcttaattacctgctttttggacatttgaactctctgtttagtttgactttttactatctaggaaactctttagaatctcaacattttctcatttctagaacttctagttcactgccactctaagtagctgatcataaacccttatctgtctgtaacaagataaagagcttgaactagaatgtaactcaactcactccttcattgagaaagtcttgctttaaaaaaagaaaaagtatccgctgaactaagcagagtgattaggaatgttgtcgatgtacattctggtgcaagttcccaatcccatcccagactggcatcagtgtgggaactgcccctggtccagggaccgcaggctgagtaccactcagccagcctgtctgggcagttcttgtcttgtttcagttgtcttggggaagagagcataatggtcctgctggaattcctccagcaatgaggaacttacagcctccatgacagcccttccagtcttaagagaattagtcaaagtcaaactattaacatcactgcctcttcatgaaggatcctgagtgcccggacctgcgctcccagctggggagaggaggcagcctgtcctctgtcctggagggtctcctggtacagctggagagaacagccctcacctgtaccccagtgacagaaccaagacacgagtgggaaaagagccagaaggactggttcacaggccagggctgctggaggtcagaggagggagggatcagcaagggctgaggcctcagaggaggtgggcgtgggagttcagacctggagaatcctgcaaaactggagccctggggcaggagggccctctgagatcatttcaagtatgggccgcaggctggtgccagttcacatgctgcaggcagaacccagagaagaaaagggaccaattccaagtctcaccaccagtttgtggccaagctgggcctagaacctagacccttatggtttcccacggtgtgctgagccgaacagaagggcaggatttaactgaacagagggaaggaggatgttttgtttcaacccagacatagacagattccaagcctcccccagacaaggctgagggcctttcatcctggcagacagtctgagccgcctgttgtccagacattctctcaaagagagcgctaatccctacgactggccaccgctcccctctggccttaggatcggaccttaatgagtgccagggaagagcccctgaggccaacagagttagctgtcagccgtcagctaaagaggggaggggccttcagccaccccttcctgttcctaccacacatgtgtgtgcatgtgtgtgtatgtgtgcatgtgtgtgtgtctcccctcactgcagcccctcgttcctctttccacccttttccttttgtcacaaggcctacctcagttggaaatctggagtcagcaggtgacttgcgagcaggcaattcataccagacccatgttccctgaatggaaaagggcaggttgccagcctgaagccatgcaatcagggagaggtggtctggacccagtgcaagatgtagatggtatcgggctgtgctgcagtcagtgctgttagagctcacaggcaatccggatcctctatgtagagcaatcagggcagacttcctggaggaggggacttttgagttgaccctaggatactgggtgagttttggaattctgggtcaagcaaacagcatgggcaaaagtatgggtcagggaaaaagttcagcctgtttggaaaataggctttgaagcaggaacccagggtgtgtgggggagtggaagggcagatgggactagaaaagtgaagaggctttgaccagaggacttcacgtctgtttttcaggcccacacccaagacatggcatactttggtcaacaattagggctctgtcttgttgtcagagacttatcagaatctcctggataggacttttttttttcttttttttagaaagggggtctcactctgttgcccagactggagtgcagcagcacaattatagctcattgcagcctcaaattcctgggctcaagggatcagtctccaagtagctgggactacaggcataagccaccttacctggctaattttttaattttttaaaaatttctttaattaaattaattttttaaattttaatttctcactatgttgcccaggctggtctcaaactatgggcctcaagtgatcctcctgcctcgacctccaaaaagctctgtaattacaggcatgagccaaagtgcctggcccccgcaatagggctgtttttcagtggcccttcagagattgctatgtgctcctgcacctaggggctgaccccagctgagtcacctgcaggtatcagggacactgccatgcttggtaccgctttagaaagatgctgttggcagctggcggccacatggtggaggccagaaaggaggggacagccaggatttcacggggtcagaagacagaggaagaggcctgagcctccgccacagttcgaggagacagaggagaagatcttcagggacaaggagtggggctgcagaaccagtggccaagggctgggggtggggctgagggggcccatgctgggttctggtgtcactgtgccccaaccccccctcatctcccccgccgtccctgcagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagtgagtggggaggggctgggcccgtcctcttccacttctcctctgggccagggaccttggtgcctgagctcccctcccaccatgagcactctgggagacacagatactggattagagggcccggggaggtgttacctgccaactcttttcactggggcaagtgtttctcagagaagccttagccaaagctaggctggaagatggatatagaaggattggtctcaatcagggatggaaatgtctagaatacagggcattgcccagtgaggccattacaggtgggagcccaaaaaggaagtgaggggtctagagcatgtgctgtcctggagtgacccagctaggtggggagcacagaggggccaccccgcagtactcaggagacaggagaacctagaccagccaggaggctgtgccacagcagggtcacctgagcccatctcaggatggggacaggatgagaggcccagggaagactaggccctcttctttctccttctctcctctgcccctaggcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccaggttgggctggagagatggggtttggggcatgggaggataaggagttggggaggcaaagagcgaggcccgctgaggcccggcaagtgccaaggcttctggccactcagctctgctcacagtgaaggtcttctcaccagtcctcaggctgccacactgccctgcagggactgttccctccctgccccagcccctttcccatgttattccaggtgatctgctcgtggagagaaggaaacatcgcaacagtctggagagcaacacgtcctattggcctgttcacccacccatatccctctttccatcagccaccctaaatatccacaaactgtccatctgtcctgtctctttttatccattctgccatccatctcgtccctcccacctggctattagatatctgtctttcctctggtccatctagccagtggctttaggaaggtgtggacccaccctgagcagttgccctgggccagggtcaggggagaaacccaggggaaggtgggccagaaactcctgaaggtgggcgtggggtggctctgggaaacaagcagcatcacagccgctcctcttgtccctttcccagggcctgagcccaggctgctatgacacctacaatgcggacatcgactgccagtggatcgacataaccgacgtgcagcctgggaactacatcctcaaggtgggcctctgggtctggggctttccctccaacctgatgttcatgtccaatgtccccccgttcctgaaagaagcttcagcctctgggcctgttcccttctccccagctgccgagcagaggcagcatctgaggcatcacttgaggtttaggcttcccagccgaagatttaggtctcaggctgacatagcctctctttccataaagaacccagggaacctttgccccagctgtggtaatgccagaggcagtggtgatactgtctccctaagtgacagaggaccagggagagcaagaaagacttggagagccatgtggtctatcttcctgtcttcggacagggcagactttgtatcatttgggagacagatgagaggccctcagctccttatagggacccctgcaaagccaagggctcctgtgactaagacccttttagcctgaacccctcctgctctaatggacactcactccatcacctcttcccttggttgagggaaaagtagaaaagcatattaacaacacacatccagacttggtacatccgtgtaggccaggttgtcatgggcccacctggggaagccatgtctcagcctcctccacacaggtataaaatgagtagggatcattccaccagttcatctggacccactcagaagcagaaaagcagctcagtaaaggcagagcagtgaagccaggtttgcaggcggaggccttccctgcagaaagtcagcaggtggagagatgcatccggcagcggttctctgcagttccctcctgagtgctcttcagcaggctccaagcttgctcctccagggcctggggttgtccagtatattttttcttttcctcattcatccactcaatcaacatgtaggaagtcccctctgagttctaggcactagacacacaaaccacataagcaatgcagttcacagtccctgccctttgggagtgtaccaggatttgaaagttgcatccctgcatctgttcttagatgttctgcaaataaagctggccctaccctagttaatccaacatttaaaagtgttgtatcccaacagctccttttcagacaaaaagcacagatcatacttgggccatcatctcagtgaatgttgggcacgtggggctccagagcaggggatcagacaggccctcgatcagtcacctagacagggatgcatagggaatgactttgagccttggatttggggagaccaggtgttgaatcctggctcagctcctcattactgcattccctcgggcaggatccaacctctctgaccccaaatgccccatgcggggcccacctggcataggctctagctctagggaaacatccaatcttctgataagggggattagatgatgttttcttggattaccagctgcctcttctttcccctctgtgtctctctagcagtgtgtctctgttctccctctctctgtcacctctctgtctgtctgtctgcctctttaccaccttctctggtgagcagttgaggtgcagcccccctgactagactccctttctccctgtttctcttcttcctcaggtgcacgtgaacccaaagtatattgttttggagtctgacttcaccaacaacgtggtgagatgcaacattcactacacaggtcgctacgtttctgcaacaaactgcaaaattgtccagtaagagtttgcccaccacccttcctggctccgtccctttcctgcctggggagcaggcaaggccacctgagatacctaagatacctgcactttaggtcaccttgatggccgaacgcagctgcagcagggcccatcaaaaagagccttgtccgtgccaaccccaagctgagtgtttacggtggggctcaggccgtagggtgttgatctggggctgcatcctgtggctccctgagatgtcccaagtgaaaaccagcagaaggcagagtcatttgatgcaaggccatgagctctgcagtcccagttccacagcttcctcgctatgtgacattgggttacttccctgagctactttcctcaactataaaataggtatttccacataggctggcaatgaggatctacaggcctgatgtctgcatgttcacagtggcacacagtgaacagcagctgtgatcattagtgtccttttcaagtggactggattaaacagtcacagattagaagtgattctggttcaaaggagccatcttcagtccctaggcccccattgtagaagaagtgcctaaaatctgggcttgggattttggcacatgctgctgggtagggtcctcagtctttctcctgattccccatgtgaagtagtttgcagagggaccccttgcttacaagctcacaaggaaaccccaccacactccagatcgaagcaacccttttccattaaaaaaaaaaaaaaaaattagtcctagagctttcagctttagttcatcaactgggagaaaggtggtagagatcttaaggcccagagaggtatctttccctaaaagtgtgtacttattaatggatggcaggtatgagagattaagcctatgactatggtcagggtgtggtgtatggccagggtcaggattcagtctgtgacaagggttagggctcagtgtgtgacaagggttaggactcaatgtgtgaccaggatcaaggctcagtgtgtgaccaggatcagggttcagtgtatacctagggtcagggcccagtgtgtgaccagggtcagggctcagtctgtgaccagagtcagggcccagtgtgtagccaggctcagggctcagtgtgtgaccaggatcagggctcagtgtgtgaccaggatcagggcttagtgtgtggccagggtcagggctcagtctgtgaccagagccaggctcatttagagacagccctctcacacttggttgctaccatcaacctaactgttcacagcatgctgccaccacatcatgaatattaaaaatgggaacagcagcctccagttcagtgcagagattaggttcctcatgagtagaatgagatcagaattccccagggcacacagcatgtttgaaaggacgaactcctgtcccatcactggcagtttggctctttagcaggcctgggtttccagcacattcctgctcctcagggcctgtcttagccattcaagacccagggtcacctaagtggtagaagccattctagggaaggaggaggaaggaagaagggggtatccaggaaacaaaggaggctgctgggggctcggggaggcagggaatccctcctgctgctgggaaagggggatgggaacagaaacagcatcccacgtgccaggcgcctggagcagccaggagggctgtcggcagggcagatggagaagcagcctgcgcggccctcccagctccccgggggcctgtgggcagcagggggagccaaagcccttccttccaagagctctttacataagtgcttggaaaggccgggccttattagagtgtctcagtctctgtgaccctgaccgcaggcaggcagctgggccagcgtgcacaggaagctggacagagcgttcccagaaaggccacgggactgacgcctgtgggtttccatcgtgtttctggaggaaaaaggaggcttaaaaaaaaaaaagtactgagttagaaaaaacaagaaagtatttccagacagtagcagctctgctaatggcctagaaaacaatctgggactagggcatggggaggggaatgtgctgagactgtgccctgggtgggtgggagtccatcaaacccctccttttggagctgggctgagggggtcggaactttctcttgagggaaatgtaggcccatgcctgccctgccacgagggatctgggctgtgggagggacgccctggctgaggaggccacgggggcctactttgcagcccctcattgacccactgtctttccttcctcagatcctgatctccgggagggacagatggccaatctctccccttccaaagcaggccctgctccccgggcagcctcccgccgaggggcccagcccccaacccacaggcacggaggggcatccctccctgccggcctcagggagcgaacgtggatgaaaaccacagggattccggacgccagaccccattttatacttcacttttctctacagtgttgttttgttgttgttggtttttattttttatactttggccataccacagagctagattgcccaggtctgggctgaataaaacaaggtttttctactctgtggctctgcatgcggcctgctggctggctggccagccacagctagtttgggcctgggggatgtccttaggcatcatccttcccctcgccaaatgtggaaagggcagccaccacccggtcaggaccacagtgaccatgagggcgctgagcccatcgtggaagcctgtggggttgagcccttggccaagcctgtcgcatgggaatgggaccacatccgactaggggagggccctgcagcggggtgggcggcaccagcctgctctccctgctcagcccctgctcctatctgggctcgtgtgcccactgctgccccttctcagccttcagcctcacactcccaccggtccccctcctggccctctcactctcacaccgttcactctccaccagccacccactcccttacaattgcaggctcccgaactcaagtctcctgaaggccaggtgctgtgctagggcacacgcaggagcatcgtagcttctgccctcagggagcgcataaccacagggaacggggagcacgcgttgcccagtgaggcagcacctaggggttctggggagccttcacatgggagagagcctccttccaggcagggaggggagaagaggattcttggcagagagacagcattgagcagagatcatgaggtggggctgcaggccgacagggtgtgagtgggagatggagggaggccccgcagccctgcagcccccgtcccctgccctggctgtggcatcccagaggtcctggacactggaatggaccaggaagaagtgagagggtggtgcctctcctcctcgaggccctgaacaacgagccctcgggatgcctccagacccacctgcttccctgtgggggcaacaccagtgagaaagggaaagagactttgtccaagtaccagggctctgggttccagggccaatcctgctcactgctgtgtgactgtgggcaagtcagacttcatctccgggcctcagtttcctcatgagtaagatgggaatgccctcctgcctggctcccacactgacatggagagttgatgagctactgctgcaggggaggtgccgggggagctacagggtgtcagcacccacccctccagatcttggtgagccccagcccatttgcagaggtcctccaagaaggtgtcccctgcttttggctctgatgcgatccttgcctcagggtccctggtagcaaggaggttttctggtgcagtagagagggagggcttcttggagccatgctatgcatccaggagggttctggcccagtcccctggagcccttgggccactcaccagcccaggcagcagggtggagtgggtgtggctgcagccctccctcggcccttcctctgcaggtctggctgggatttaactctgctgacagggtaggtgccgcagctctgccactctccctctggagctggaccaggacgggtgagaggagtacaggcacatgcctgtcatccagggctgccattctgctgcatcccctgccggtgtgtgcttcccaagatgctgtccttattgcagccccaccccctctccttcctagatactcccaggagtgagcttgggagggggtcagacaaggtcaaccaattccagactgtcaggaggcccgtatgaggtagagacaaaagcccccatttctcaggtcagaaaactgaagcctgtctgagaccacaggcaagttcaaggcagacacagtgctggagctcacgtctctaagccctaggccagggccaaatgccgggtgtgtgcagttttctggggagatctgtaccctcagcagatgagctatggccctgaacacagaattggatggaaggagagagtaagggtggcttttccaaaaagcccacacatcacaaagtgtggggaggtggggagcacacaaggagactcccagacacagtgctcccgcgtgcccatgaacctttggcctgaagttcagattctaggggggctggtggatgtccccaagcctgccatcagagtgaggacacctgggccagtcctcacatgctgggaggactctgagattagatctctggggaggggcttcagatacccctttgccccccaaaaagcagaggaggctttcacccaaaggagaagagagatagagagagaagagagaagacagccgtgacgcgcagggaccagggcagccctcaccgcttcctggctgacctgtcagggccctatcagtgcagcttcacggcactgcccagcagtgacggcccctcgggaaaggagatgcagctgctcccacctcagggggcagggtttcctcaggtattttgactccatgtagaatggcagagtctccctgagaatggggagagaaaaactgtcaagacggcaggggcccagcaggcgctgagctgaggagggcggctgggagaggagtgctctcccagctcggcctcagcctcttgaggtctgtctggctgtcactgcatggaggaacagcctgcttgttccttgttcttgctgtcacctggctcgggcccctccctagatagagctcacctgttgggctcaccccaccaagccaggcccagggaggggtgtgtgaggcccactggaggccaggtcacgtgacgcagggactcaggcccactggtcccttcacccttccgtttgccccttcaaggccagctgaaaccccgatttctcgaagccttccttaaccatcccctctccccttcaactggggtgcactgtgtggcctcattcaggactctcccacccccaccctgccacggacacacaggggcatgggaggaggcacccgagccttgcatgctggacaaaggttacataggtgccatctcagccaggtgcagtggctcacgcctgtaattccagcgctgtgggaggtcgaggcgggcagatcacttggggtcaggagttcgagaccaactggccaacacggcaaaaccccatctctgctaaaaatacaaaaattagccaggcatggtggcacgcgcctgtaatcccagctattcgggaggctgaggcaggagaatcgcttgaacccaggaggcgaaggttgcagtgagccaagattgtgccactgcactccagcctgggcgatagagtaagactctacctcaaaaaaaaaaaaaaaagaaaagcaaaacaacaacaacaaaaaaaccataggtgccatcttcactcctgacccagcacctccttctgggctgcacagaccaagagggtctctgctggtacactgggcactggtgtgcaggaatccacctgggctgtaagggcctcaagtcacctgcccagcatccctccctgtcctcttcttgctcagccccagggctggggagctcactgcttctcgagacatttgctgttagaaacaccttgaggtgaaacagacccccaccccctgccccgcagccttcccttgggctggtcctcggggtctactaagtaaatgactctggtggatgtgactggacagcaggaaggacagagacagcagaggcgacacctggcagggggcacagctgtggccctgactctgtccttcagtgggcctcagtctccctatctgtcctgagggggctgagtgtcttgctagtccttacctggcagagaagaaggggcaggggaagagaagagagggaggggaggaaatgggaggtagaaggaggctgggtagggagtgataggcaaagtccagcctgggggaaggtgggcaagcagcagggggactgcctcagaaggggagcagggagccagcagaggcactgctagggctgcagcctggtgagggctggggcgttatctggcttggaggatgccacagagagaggcctgaagtgggggtactggacctcaaaccagggctggcctgaaacccttggaagggcctgctaatagagacagaggtgccctgggcccttggcagggcggggtgggctctgaaagccagcccagacctgacccctctgcggcctaccatcttggccacagccttgaccttctccctccccctgcacctcagatgcccacaccccctgtgcattacactgtgcgctcccacccagggcagcagccccctgcagggagggcccaggctaaaatcccacccattctgtttcctctccttccactagaatcccacctgttttgagaagttggcagggcctgtgttagggaagcacctgataaccaacgtgagaatggtggcgctggtcccatgtcctgtctcacttttagatgaagagcttcttcatcctcaaaaaaaatgactcagaagagagccctttaatagactgctcggctaggggtggagggctcgtaaggatatttacagatccttgaaaacagagcttccagcatttaaccctgaagagagctggagcctgggccccaactccttaccccacctgagcctcctctctgcactggaggcctctgagcctgactccgcgcaccccacgctggcccacaagccaaggctccttctgatgccccctgaggctgctggcattggccagggctccatcagcacctccttgggtgggggggattaccgctttccctacttactccagccttggttagggggcccatttcccagctcctgccaggctctccacccatttgtggtcaaggcaagagagaccacacccccttgaatgtccaggcactgagtccctgccggctactcatacggatgggccctccccagccattcctcaccacggctgcgtccggatccacaccacaaccacagcattgttggaaagcaactgcacacctccctgcaacttcccctcgcatcccccagactgagtcatgcaggcggtgcccgtgggcagacctggccagggttggcaccagctggccagagagaatgagaggcactgaccacacccaggaacctcgctaaagcccatgcataagggtcaggagagcagccagatgctgggacccaagggtgcctgtgacacacaccaccctgaaagttgcagctgagcttttctgagaaggatggcaaagtcctggaaaagctttaacgacaaaactcaacatatggaaggcagaggaagcaggtaaggattctggtctccttttatgtgaaatagctttaaaaaaaactttttcaaaatcacgtttaatatgcgttgagccccctggctaccaggtgggaaagtcaaagtcctgaatcatttactcccaccctagacaccttgaacttcagaacttcagagaggagtcctgtggtctttagtcctcctggtcaccgctccctggctgattcactctcctccaggggcggtgtctccacttcctgcaaagcttgggcacatgggcagccatgtccctcgaggttcgccacctccccagggcactgccaggaggcactgtcctcgttactagcagagccagagccaccaccacaaccatagccaccacctccccagcccagggaactctcccagcctctttcctcggcctgtcttcactcccttctaactactcactcttttcctcttcctctctggggcaaccttccatcatccctgccatgtgccttggttcaaggaatcagctttggattctggcccttaagatgaggagtcacaagtacctcctaggaatgagaaagaggaaaagacctagcaggggaatgccaataatattagtgacactcactaatttcttcaacacttagccatgggccaggccctgctctaaatgctctacaaaggttaagcccatttaatcctcacaagaactctatgagggagacactgtcattcccattttgtagatggacaaactgaggcacagagaagtcatgtgacttgccctagttccgtcagctagtgaatgggagagccagaattccaacacaggcacatttctggagacagggcataggttcctccagatcctcaaaggcatgtgggaccaggaaagaagccataggtctgtgctctgaaacatggcaagaacactgttcaaaccatcccatcatctccttcctccacgagtcctctagaatcatgtgtggctcctggaaaccgcagcttgaaaaggattggtgagaagcctaattcctcctagaagtagtgtggtagtgtaattcagacttagattgttctttatgggtgagagagagggcaaattacaatagataaactggctgggtgccgtggctcatgcctgtaatctcagcactttgggagcctgaggtgggtggatcgtttgagcccaggagtctgagatcagcctgggaaacatggtgaaaccctgtctctacaaaatacacaaaaattagcggggcttggtggtgcacgcctatagtctcagctatctgggaggctgaggtgggaggattgcttgagctcaggaagtggaggttgcagtgagttgagattgtgctgccgtactccagcctgggcaacagagtgaagccctgtctcaaaaataaataaataaatcatcggctagtcaacaaaatattaatagaaaaatatgggattagaagggataagaacacagccatggagatgacttttgaaattgaagaaactagtgcatgcttataaattggagtgtcccaacattaaataataattttctagtatttctaaattgccaaaattgactcgagtgaaaagcacaaaaagaccaattaccacagaagaaaatttaaaaattatcatctctaagaaagacaccagccctagggagttttagcatgagttatttcaaactggaagaacagtgaatttctgtgttatgtaaactcttccagagcatatggggaaaatgctgaattgattttatgcttctgaattgattttattaagctaatcctaacaccaaactctgataaagattgctatcctgcgccacccaccctcacgctgataaccacagaccaattttactcctggctgtgaatacagaagtcctggataaaatgccaccagtggaatcctgtaccattgtaataccagatgcagcccgtgtttggcatgctttcccctccaccagatgtgtgctagggcaaaactggaacctgatatctgggtccaggcaatttggacacaacattcacttctgtggtcctaagcgccccctctcaggaagcaaagagtaaaatgaagcaggtgtccaaagcttgcaaatatgcagaaaggctacagcttggattactgctgttgactggcaacatagttaaccacaatatcctgttagagtgatcattcatcatttcttttttttgtttgttttgagactgagtctctttctgtcgccaggctagagtgcagtggcgctgtctcgactcagtgcaacctccatctcccgggttcaagcaattctcctgcctcagccttctgagtagctgggactacaggtgcctgctgccatgcccagctaatttttttatttttagtagagatggggcttcaccatgttggccaggctggtctcaaactcctgacctcaaatgatccactcgcctcggcctcccaaggtgctgggattacaggtgtgaaccatcatgcccggctgttatttcttttccttgctgagaagttcttaagtattttttgtgctttttttcctttttatggtaggtggctaccttctctaccttttccctgcagggtttgataacatgattgaataagcaagtcctaataaatgccctctttgctgtatcaacatgcatacccccgaaaacttgggaaacagtgcctgtcgtgccctgggaaaccgaatcctgggcccaagggacatgatccagctggtagtgcccctgtgccaggtgagaaaaagagaccttgccctctgctggagttgcagcagcctgggagcttctcagccagggaacagatcatcgctgcagctggaggacaccctatttcagatatgtgacatcagaggccatctcatttctgattcacagccattgccccttccacttcttcacaaaaattcaagtatattaagaaatacatatttttttgagacgaggtctcactctgtcgcccaggctggagtgcagatcatggctcactgcagcctcgacctccttgggctcaggcaatcctcccacctcagcctcccaagtggctggaactagaggcacgtgtcaccatgcctggctaattttatttatttattttttgtatttttttgcggagacagggtttcgccatgttgcccagtctggtctcaaacttctgagctcaagtaatcctcctgcctctgcctcccaaaatgctgggattacaggcatgagccacagtgtctggcaaagaaataatctgcatacagcaaaatttaccctttttaggtgaacagtttgatgagttttgacaaatatatgcagtgatataaatacccccacagtgaagatgtaatacctccatcactcaggacttccctcttgcctctttgtgctccgttttctacctcccacctccagcccccggcaaccactaagctgttttctgtttctgtagttttgtcttttccagaatctcaaatatgtggaaccacatagtatgtggccttctatatctggcttgcttcacttaacataatgcttttttaatttaaattttatttttatttatttatttttgagactgagtctcactttgtggcccaggctggaatgcagtggcgtgatcttggctcactgcaacctccgcctgccaggttcaagcaattctcctgtctcagcctcccaagtagctgggattacaggcacacaccaccatgcctggctaattttttatatttttagtagaggcggggtttcgccatgctggccagtctggtctccaaatcctgaccttgtgatctgcctgccttggcctctcaaagtgctaggattacaggcaggagccaccgtgccaggcctatttttcatttttgagacagtctcaccctgttgcccaggctgaagtgcagtggtgcaatcttagctcactgcaacctctgtctcccgggttcaaacgattctcctacctcagcctcctgagtagctgagattacaggtgcccaccaccacgcctggctaatttctgtatttttagcagagacaggttttctccacgtttgccaggctggtctctcaagtgatccgcccacctcggcctccaaagtactgggattagaggcatgggcctctgcacccggcctaatcttatttttaattgtaaactgacaaataacagttgtatctatggagtatgaagtgatgttatgatgtattaatatgatgttgaataatcaaactgagctaattaacatatccatcacctcaaatactgttcttattttttgtagtaagaacatttggaatttattctgttgataattttgaaatgtacattatttaagatatttgaccaggggtggtggcacatgcctgtaatccaaacactttgggaggccaaggcaggcggatcacttgagctcaggagttcaagaccagcctgggcaacatggtgaaacactgtctctacaaaaaacacaacaattagctagggatggtggtgggcacttgtagtcccagctgctcagaaggcagggatgggaggatcacctgagcccaggagtttgaggctgtagtgaattatggtctagccactgcactccaacttgggtgacagagggagatcttgtctgaaaacaaaaaacaaaaacaaagtggctacatgctcaccagacacattatatcctctttttttttttttttttttttttttttttttttttttttttttgagacggagtctcactctgttgccaggcttgagtacagtggtgcaatctcggctcagtgcaacttctgccccctgggttcaagcgattctcctgcctcagcttcccaagtagctaggactacagacacgtgccaccacacctggctagtttttgtatttttagtagagacagggtttcaccatgttggccaggatggtctcaatctcttgacctcgtgatccgcctgcctcaatctcccaaaatgctgggattacaggcatgagccactgtgcctggcctgtatcctctttttaaaagccattctagtaggtatcctgtggcagtcatctttccatattcctggggactgattccaggactcctgaaaataggaaaccccgggcatgctcaagtccctgatataaaatagtgcagcgtttgcatataacccaggcacataacccgctctactttaatttatctctagattacttatgatccctaatataatttaaatgctatgtaaatcgttgttatgctgtattgtttttatttgtattgtttttattgttgtattgttatttttttcaatattttttatctgtgtgttcactgtgcagttggttgaatccgtggatgtggaacccgtagataccgagggctgactgtatttcattctggtttaaattttcatttccctagtgactaacaatgttgagcatgtgttcatgtggttgtttgccaggatatctcttctttgatgaaatttctgttcagatcctttgcccatttttaattggcttgtttgtctcattattgagttggaagaattctttatctattctggatacaagttattcatcagtgatatgttttgcaaatattttttcccaatctgtcgtttgtcttctcattttttactagtaccttctaaagagcggaagtttttaattttgataagagccaatttatcggttttttttccttttatgggctgtgttttttgtcctatctaaatcttaacttaaacaatgtcacaaagattttctgtaagcactgcaataaatggtatcccatgagtttttaggactaagttctaatttttgattttgcccaaatttctatctaagggatctagggagtcatgccctacaaatcctaaattctcatcagatgggttttatttatatattgtgacttacttttcaatctgactctggtataacattacgagacaaggaaaaaatatttaaccccaaaatatatttccctgccatagcttgaaattgccctgcaagtctcttgtgggaaaaatccacattctatagagaatccccttgcccctttgttttccttccttcctttccagatccaggagataatcaactaagagccaggcactcttttaggtctaataagaaacattttacaacctgctctctctctcctctctgtctgaagtctgctatctgagagattcctctgcacaataaaacttggtttccacaatcctttattttaacctgaacatttcctttctattgatcccagatcttcagacaaactcaaccaattgtcaaccagaaaatgtttaaatttacctatagcctggaagtccccactttgagttgtccctcctttctgaaccaaaccaatgtatttcttaaatgtatttgactgatgtctcatgcttcctaaaatatataaaactaagctgcaccccgaccatcttgggcacatgttcacatgttctcaggagcttcggagggctgtgtcacgggccatggtcactcatatttggcttagaataaatctcctaaaatattttacagagttcgactcttttcatcgacagtgttgatatgttgtatttttatttccattagaatatttctaattatcctcatggtttcttctttgaaccataagttatctaaaagtgtgttgtttgatttccaaacatttggggactttccagatatctttctgttactgatttatagtttaatttcattatggtgagaaaacatactttgtatgatttcaattatttttaatttgttaagatttgctttatggcccagaatatggtctatcttgctaaagttccatgggcactcaaaaagaatgtgtattctgctgttgttgtgcgaaatgtcctataaatgtcaatcagattgttggttattagtgttattcaagttacccatacccagcctgattttctgtgtactcgctctaccaaatattgagagaagagtggatgtgtctatttctcctttcagctctaacggtctcgattgcatgtaccctgactgtgttctccagtgcacatgcatggacagttatgatgtcctcttgatgaatcaacccctttatatacagtccttctttattcctggaaatattctctgtttctgcttcatctgacattaatatagacacttgagctttctttggattagtgtttgcatggcatgccttttttccattcctttggttttaggctatctaggtctttattattattttttatttcttttgagacagagtctcgctctgttgcccaggctgaagtgcaatggcgtgatctcagctcactgcaacctccacctcccgagttcaagcgattctcgtgcctcggcctcccaagtggttgggattacaggcatgtgccaccacatccgactaatttttgtatttttagtagagatggggtttcaccatgttggccaggctggtctcgaactcctgacctcaggagatcagcccgcctaggcctcccaaagtgctgggattacaggtgtgagccaccgccccagccctaggtttttatatttaaagtgtgtttctcacagacagcctgagggtcccggaaattttctggaagttgcggctccaccctcagctctcagcaacccctgctcgcctgcactacctaggggatgcgtggtcttgccctcctcctggtggtaaatgtctctgtgtgctcttgcccgccccctggtggtaaatgccgttgctgctactcttggttgggctagtagtggaggcagtttgtggacgtgtgttaaagggtttccggacggtgggatgttgctccattctcctggcccagcctccgcagagcctgtgtactagggtctcagaaggtggagtcttcgaagtgctcctgtccctcctgtcgtgccttctatctcctgtgggtttaacacaggagagtgcgtcctgcgcctcccacaggggcaagtggtgtttactttgatcctgccccagaagcagtggatcttcgtttctgcctctcccgcagcagccctggggccagagagtgcagcctcccacgtggttttgcccagagagaatcgtcctggggaagcaggtgggggtcgctgcacagcagtcaatcaccgcttgagtgcttgtgccaccagcaagggggaggggtctctcccggctccccctctgcctccagtctttttcctgcagtgaaggcctgtgcaaaaagctcagaaggcagggcagactccctcctgcccaccacatgctctgcccaagacagttggtcttgcctttccttggaggggcttgtcactctttggaattcagttctcttggttgcctgccacctcagctatctgactggtttaagaaattatggttttgcaaattatctggtgttttgttattgttagagtcggggggcggggtggttcattcctgtactcccagcactttcgggggtgaggtgggtggaccctttgagccctggagttcaagaccagccagcctgagcaacatggggaaaccctgtctctacaaaaaaaaaaaaaaaaaaaaaaaaaaaattagccagacatggcgacaggagcctgtagtcccagctactcaggaggctgaggtgggatgatcactggagcccccccagaaaagaatgggaatgatgttcccttgtggtttttctatatcctaagaggaaataaaacactcttctctttcacttttaacatatgcaaatgagtgactctaaatgccttctagggcaatgtctcatggcttacagtgcctcgtggtttttctcatttctttcatgattgcagctgtatttgctaccacttgtgcagctgacatttaccaagcccttactgtgttccagcatgctttcatttagaaccatccctgactcctcttttctctcaaacccacgttcaatttgtcagataatcctgttggccccatgttcaaaatataaccagttcctttcaaaaataaaaatggacttatcataaaacccggcaattgcactgtcatgcatttttcccagagaaatgaaaacttattttcatggtggaacttgtacacaaatgttcatagaagctttatttataatagccctaaaccagaaaatactcacaaactatggtatattcataccacaggatactattctgctgtagaaggaatgaactattggtacaagcaacaacttggatgaacttttgctgagtgaaaaagccagcctcaaaaggatacatcactgcatgattctatttacacggcaaataatataattagagagggaatagactagtggttgtcaggagttaggaatgtgtattagtccgttctcctctttctataaagaaatacctgagactgggtaatttataaagacaaaaggtttaattggctcatggttctgcagtctgtacaggaagcgtggtggcttcagcttctggggaggcctcagggaacttacaaccatggggagggcaaaggaggaggcaggcaccacttacatggccagagcaggaggaaaagagatgggaggtgctacacacttttgaacaactagatctcatggtgctaatccattcatgagaactccacccggtttggtggggacccagatcagtaccatatcagaagggaggggagggtgtggctgtaaaggggttacacgagaggctttgtggtgatggtacagttgagcacctcggtcattctggtggctactccaggctacacatagggcaaatttacatagagctactttgtggttggctgggtgcgacggctcacatctgtaattccagcactttgggaggctgaggtggggggatgacgaggtcaggaggtcgagaccaacctggccaacacggtgaaaccccgtctctactaaaaatacaaaaattagccgggtgtggcagtgtgtgcctgtaatcccagctactcaggaggctgaggcagaagaattgctttaacccgggaggaggaggttgcagtgagccaagattgtgccactgcacttcagcctgaaaacagagtgagactctgtctcaaaaaaaaaaaaaaaaaaaagcttttttgtggtctttgtgctgataccaaataagtggtatcatttccaacaccaatcgattttctgcttctgtgataccaattgggtgttcaataattcaattctattctgatactaacctggagttagtgtcagactccacaggctgaagggctcagtcccataagactacccccatttctcccaggcgcagtggctcacacctgtaatcccagcactttgggaggctgaggcgggcggatcacctgaggtcaggagttcgagaccagcctggccaacatggtgaaaccctgtctctactaaaaatacaaaaattagccaggcctggtggcgggcacctgtaatcccagctactcgggaggctgaggcagaagaattgcttgaacccaggaggtggaggttgcagtgagctgaggtcacgccattgcactccagcctgggcaacaagagtgaaactccatctcaaaaaaaaaaaaaatggctgggtgtggtggctcatgcctgtaatcccagaactttgggaagccgaggcaggcggatcacctgaggtcaggagttcgagtccagcctggccaacatggtgaaacctcatctctactaaaagtacaaaaattagccaggagtggtggcgagtgcctgtaatcccagctacttggggggctgagacaggataattgcttgaacccagaggcggaggttgtgtgagccgagatcgtgccactgcactccagcctgggtgacagagtgagactcgatgtctccaaaaaaacaaaacaaaacaaaacaaaactacccccatttcacatgccagtcacaagtactgggtccccaggttacccacacttctgtccagccaactacaaatttggaggttcccgtgacctccattcctcaggtttgataatttgctagaatggctcacagaactcaaaaaaacacattacttcaccattactggtctattgtaaaagatacaactcaggaacagccaagtgaagagatgcataggactgggtattgtagggtgggtgtgcagagcctccctgcctgctctgggcgtcacccctccagcatctccatgtgttccaacccagaagctctccaaactccattgttttggaactttatgaaggttccattacagaggcatgattgatgaaatcattggtcattggtgactgaactccatccctagccactgtccactccctggaggtcagagagtgaggctgaaagttccaactctctcatcatcaatcatggcttagtctttctgatcagcagcctgtatccagaaactatttagggtcctcattaacataagctcaggtatggttgaaaggggtttgttatgaataacaaaacatcactgtaactcaggaaattttaggagggttttaaaagatctgtgccaagaaccagggacaaaggccaactctatttttctcactatatacatgatttcccatttcctacaggcacacacaaacacacacacaaatgggtgcgtgcataactggttagatctgaataaactcaatggattgtgccgatgttccatttcttcgttttgatactgtactctggttatgtgagttgttcgcatgagaggtagggaacatgggacttctctctacattcctttgtgaccttctgtgaccctacaattatttcaaaattaacaacttagaatacaaataaccagagtccacctcccgccctgctaccagcctggtccacaccactctcttttcttgcctggattattgcaacagccgctttttttttttttttttttttttttttttttttttttttgagatggagtcttggaacagtttcttaatgggtctgcttttacatacaatctattctcaataaagcagcttcgtaagacagatcctaccatttgtagaaataaacaaaaaccattcagagcttgctgtagcaaggttgtcagccagcatcacttgcatttttgtagggactcaaaatcaggctgagccttattgtcggtgggccgggggtaggggtgcgggaaaggaggtgggggaaggcttggggtgtgccctgattggaggctattggcctggagaagctgggtgggataatttggaggggattctgagattggctggggaggggtgggtgcatatttggctttctcttgctggccctaagttggaagctgggacaaaaattagggaagctgccagtttttaatcaagtcctggcctttcggggctgattgttagagaagttattgttttgcttcctggatggctactggagatagtgatctggcttccttcatgtctgacttatagcagactggcatcctgggctgtggattccagatgagggggttggtttcctgggcagcttgctgcaggttaggctcagagttctagtttccacagggtctggccatggtgcacgtgtatgttcagtccctcatgttcctctgcttagaaccctgcaggggctcccactgaacacagcccttcctgtggcctaccaggccctacatgagctggccccatttcccctctggcctggtcttctgccactctcctccctctctccatcccagccacaatggcctccttgctgttctagaacatgccaggccctctcccaaggcattcatggccttctaacatactgtatgcctttcttatttttctctctctctctgtttctcactctctctctctctatatatatatatgtatatacgtacgtatatacctatatgtatatacatatacacacacacacacacacacatatatatatgtgtgtgagacagagactcactctgttgcccaggcttggagtgcagtggtgtggtcctagctcactgcagcctcaaactcccgggctcaagctatcctcccacctcagcctcccaaagagctgggattacaagcaggagtcaatgcacccggcctcctttctgatttttaatgcttattgcttatgtctagctctcacaactagaatgtaaattccacaaggacagggttcttggtgggtttgttccctactatatccttggcacctagaacattgccttgcccagcacatagtgagtgcccaataaaaaatgtttgagtgaatcaatgagtttgtgcgtacatgtgtgcagatacatttactaacatctactacttctaattaggtgctcagtgtttactagacactatgctaagtgctttcatctagtatctaatttttattcttcatagctttcctatgggtaggtgacatcaggccacttatctttcaggtaaagtggtctcagaggacatgctgaaagcccatgagcttctcagggacctaaataaatgtttaaaacctgagaaaagtcttggctccaaaatgtaaaaactacagaatcatccaaattaataaatgtttaatcaaatgtctacaaagtgtcatcgattgttaatttatgtcattaattctctattggcctctttaattattaaatgcagtgttcataagaatttcattacttttgaaaagaatttgtagactagatgttaactcttggagcacagtcatgtatctgttaaccacaggaataccatcagaaaaatgtgtcattaggtgatttcaatgttgtacaaacatcagagagtgtccttacacactctgtgatgtgtagcctgctacacacttaggctataagagatagactattgctcctaggctacaaacctgtacagcacgtgactgtaccgaatactgtaggcaattataatacaataataagtatttgtgtatctaaacatagctaaacatagaaaaggcacagtaaaaatatcatataaaatatttaaaatgtacacctgtttagggtacttaccatgaatggagcttgcaggactggaagttgctctgggtgagtccgtgagtgagtggtgaatgaatgtggaggcctaggacaatactgtacactactgtagactttaaagacactgtcacctaggctactacactaagtttattaaaaatattattctttggcagggcgcggtggctcacgcctgtaatccctgcactttgggaggccgaggtgggtgaatcacctgaggtcaggggctcgagacctgcctggtcaacatggtgaaaccccatctctactaaaaatacaaaaaattagccaggcatggtggtgggcacctgtaatcccagctaccagggagactgaggcaagagaatcacttgaacctgagaggcggaggttgtagtgagccgagattgtgccattgcactccagtctaggcaacaagagcaaaactctgtctcaaaaaaaaagtttttcttcagtaataaattagccttagctttctacaactttatgaactttaaaattttttttaaactttttgactttttataataacacttagcttaaaacacaaacacattatgcagctatacaaaaatattttctttttttgtatccttattctataaactttttatttttcaattattttatttttacttttaaaacctttttgttaaaaactaagacacaaatacacacattagcctaaacctacatagggtcaggaccatcaatatcactgtcttgcacctctacaccttgtcccactggaagttcttcataggcaacaacacgcatggagctgtcacctgctattgcaacaatgctttttttctttttttttttttgagacagagtcttactctgtcgcccaggctggagtgcagtggcacgatctcagctcactgcagcctccacctccaaggttcaagggatcctcaagcctcagcctcccaagtagccgggagtacaggcacgcgctaccatgcccagcgacggggtttcgccgtattggccaagctggtctcgaactcctgacctcaggtgatccacctgcctcggcctcccaaagtgctgggattacaggcgtgagccaccacgcccagcggacaatgctttcttctgcaatctctcctaaaggacctgcctgaggcacttcttgaagaagtgtccgtcttttcagaagtatgtccatggtggtttgccaagtttgtttctttcttccgtcatagatttgcatgagtaatgctttgtgtcagctaaaatgttacatcggctatgacgtcactaggtgataggaatttgtcagctccattataatcctatgggaccgccatcggatacgcagcccatcactgacctgagacgtcgttatttagggtgtgactgtactttaagaatgcaaatgaatacccagggagggctgagaacgcgtaggtaattacaccataaatgaattactcttagccaagtaatttccaaggcaaacatacaaaaatcacctcgtgttacctgacagtgctatgttatatttaacgtaagaaatctgtgtattttaatatttaataaggtgtgggaaggaacttccaaaggtaatagcatctggtcctagcaaggtcttaaaacgccgtttgatttcagaatgcctcattttgtagatttaatccagaatctgcagtttctggcgacgcagtagtccgtctcccccagtttctcctggccaaagcctcccaccttcctctctacccccacaaccctgtcaagcgcacctggaccaggtacaacaggggtgtgtgtgtgagtgtgagtgtgtgtgtgaatgcatttgggaaaggctaggcagggtgaatattccctagaccccgctcttcaccgtcactctactacagcagctcactgccctgccccgcccctccccggccctggaaagcagcctctggaaagaggaaaccagctatctcccgtgttgccacaagatggcaccacaagctcgggactggctttctttgcgttcccgtcagaaaaaaacgagagctctgacctaggagccgaggctcccagggagacctctggacgccactccccgggctgcttctcctcctcggggtgactcgggccctctggagtgacctgcatagctttgtggttcgggctcccatggggcccagaagccagcatggagacttagggcttctcttgggccacttttctcctcatacccagcatgcagaccaaggttggggatgaattctgaacgtggggcagagtccctgtccccagagcaactctgagagcaccttgcccttcttcccagggcacaggcaccagccttcctccccagctcagtccctgcttctttctaagacaggttcttgctctgtcgcccaggctggagtgcagtggtgcaattatggctcactgcagcctcgacctcctcctggtgagaggtgacagcgcgcctgcagccctcgctctcggcgcctcctcggccttggtgcccactctggccgcgcttgaggagcccttcagcccactgctgcactgtgggagcccctttctgggctggccaaggctggagccggctcccttagcttgcggggaggtgtggagggagagccgcgggcgggaaccggggctgcgcgcggcacttgctggccagcgcgagttccgggtgggcgtgggctccgcgggccccgcactcggtgcggccggccggccggcccgcaagccccgggcagtgagggtcttagcacctgggccagcagctgctgtgctcgatttctcgccaggccttagctgccttcccgcggggcagggctcaagacctgcagcccgccatgcctgagcctccccccagctccgtgggctcctgtgcggcccaagcctccgcgatgagcgccgccccctgctccatggagcccaatcccatcgaccacccaagaactgaggagtgcaggcacacggcgcgggactggcaggcagttccacctgcagcccccgtgtgggatccactgggtgaagccagctgggctcctgagtctgttggggacttggagaacctttatgtctagctaagggattgtaaatacaccaatcggcagtctgtatctagctcaaggtttgtaaacacaccaatcagcaccctgtgtctagctcagggtttgtgaatgcaccaattgacactctgtatctacctactctgctggggacttggagaacttttgtgtctacactctgtatctaactaatctagtggggacatggagaactttcgtgcctagctcagggattgtaaacgcaccaatcagcaccctgtcaaaatggaccaatcagctctctgtaaaatgggccaatcggctctctgtaaaatggaccaatcagcaggatgtgggtggggccagataagagaataaaagcaggcttgcccaagctggcagtgacaactcgctgaggcccagtttacgttggcgaagctttgttctttcactctttgcgataaatcttgttgttgttcaccgtttgggtccgcgctgcctttatgagccgtaacactcaaccgcgaaagtctgtagcttcactcctgaagctagcgagaccacgaacccaccgggaagaagaaaaaactccagacgcaccgccttcagagctgtaacactcactgggaaggtctgtggtttcagtcctgagcccgtgagaccacagaccgaccagtgggaagaaattccgcacacatctgaacatcaaaagtaacagactctggataggccgcgtttaaaaactataacacttaccacgagcatccgtggcttcattcttgaagttagtgagaccgagaacccattaattcccgaaacacactgggcgcaaatcttcccttctcagttttccaagtagctgggactacaggcgccaaccaccatgcctggctaattttttttgtatttttagtagagatggggtttcactgtgttaaccaagatggtctcaatctgacctcgtgattcacccgcctcggattcccaaagtgctgggcttacaggtgtgagcccgcacacctggccaccagttatttttcaattgttctgtttccctgttcttgccttactaagaaagtaattttgaaatgaccgatccgttctttgttttttgtttctggtttcttcagcttattctgtctgtaaaacctgcgtcctctgctccgctccatgaagacgctcattctgttttatagaagttagtaagtgtgatatatctattctttgtttttgtctatagttcctggctgacagcccatataatcattgtaatttcctaggagactagagtgtgataagagtatctttccttaaaatatttggcctttcatcctttgttcttgaaacagctctggagcagctccagagtaagcataaaggtgaaagatgggccgggcggagtggctcacgtttgtaatcccggcactttgggaggccaaggtggcagataacgaggtcaggagttcgagaccagcctgaccaacatggtgaaaccctgtctctactaaaaatacaaaaattaggtgggcatggtggtgcatacctgtaatcccagctgctcaggaggctgaggaggagaattgcatgaactcgggaggcagaggttgcagtgagctgagatcgccactgcactccagcctgggcaacagagcgaaactccatctcaaaaaaaaaaaaaaaaaagtgaaagtcgggcttgttgtttggagccacaactgagcttaacgtttataaccacaggatggatggctgcttgccaggggatccaaccgtctgctcagagccccaccctccacattcggggaggagagaggaaccgaaggttgatcaccaatggccagtgatgtaattgatcatgcctacataatgaaatcgccataaaaacccgtaacgactgagttcaggggtttcccaggaaggtggtcttgtatggaagattttgtattcggggatggaagcttttgtatttgaggcccttccagagtgtgccccgtttatgtcttcatctggcttttcatttgtatcctttaaaatatgctttatgataaactgctaaacgtaagcaaatgcttccctgcattctgtgaggtgctctagcaaattaatcaaacccaagaagagggtcatgagaatcctgatttatagccagttggccagaagtacaggtaatacaacctggggcttgtaattggcactggaagtgggggacggtcttgtgggactgggatctgacgctatctccaggtagatagtgttggaattgaattaagaacacccagctggtggccactgcagaactggctccttgcttgatatgggggggtgggggaaccccacacatgtggtatcagaagtgtgtttctggagtatagtaggagaaattgagtttgttttctgctcatacacagagaaacaaaatcactaaagagcaacaaattgtattctgttcagataatatagtggaagaaatattccacttatagtagtaccaaaaaggataaagtacttaagaataaatgttcagacgatataaaggacatttcaaaacttctaaaggacacaaaagacatcaaaacacaccatgttcaaggataggaagactcaatatcataaagattgtcattttcttttttttttttttgagatggagtctcgctctgttgctgggctgggtggagtgcagtgactcaatctcggctcactgcaacctccaactcccggatgcaagcgattctcctgcctcagcctctcaagtagctgggactacaggtgcatgccaccacgcccagctaattttcgtatttttagtaaagacggagttttacccatgttggccagaatggtctcaatctcttaacctcgtgatccacctgcctcagcctcccaaagtgctgggattacaggcctgggccaccatgcttggccaaagattacaattttctatgagttacttgacacatttaatataatcccaataaagatacaatattctttttaaaaaactacaccaggtcattctaaagttcattgaaaaaacaaacactagtcagataaagacactgacagtattctttttaaaaaactacaccaggtaattctaaagttcattgaaaaaacaaacactagtcagccatggtaagtggcttgcatctgtagtcccagctacttgggaggccaaggtaggaggatcacttgaacccaggaatttgaggctgcagtaagctatgatcacacctgtgaatagccactacactccagcctgggcaacatagcaagactctgtctcttaaaacaaaaaaaggcagaaggtctttcttaagaagcattaaaaagaattcctcctatagatatttaacattttatggcaccccaataattaaagtggtcctagagaatggataaacattagcccaatggaacagagcagaaagccccactatagacctcaacacaaaaaattcatggtgttgaaaaaagggggatcaatattttatactttatacttatttaaattccaaatgagtttacaattttacaagtaaaaaataaaagagaatacattaaattctgttatgatctcagaatggaggttttttttacttatgactcaaaatccagaagtcataaaatatttatcaattcaaatacatttttaaaatttcatgagaaaacattataagcaaagacaaaatgcaaaccaacaaattgggtgaaaaatttacagctcatatcaaaaatggctaatcttcctaatatttaaagagctcccaaatgtcaaaaacagaaatagaaacaaccagcactagaaaaatgaacaaagtagataaaataacagtttgtagaaaaggagacacatggctcttaaacatattagaagatgctcaacctcactcaaaataacacaaaagcaaatgaaaaggtttctaggtaattcaatggggaaaagatacctttaaacaaaaagtgctggaacgattggatatcaccatgaaaaaaaagaacgtcaacttttacttcacaccatatacaaaaattaattcgaaaatggatcacaggtcaggcaaggtgtctcatgcctataattccagcactttgagaggccaaggcaggtatataacttgagctcaggtgtttgagaccagcctgggcaatgtggcaaaaccctgtttctacaaaaaatataaaaattagccaggtttggtaatgtatacctataatgccaactacttgggaggctgagtggggaggattgcttgagcccaggaggttgaggctgcagtgagccaggattgtgcctctgcactcagcctaggcaacgtatggagagtctctctctctcttttttctttctttcttcttcttttaagagatcaggtcttgctgtgttgtccaggctggcctcgaacttctgggctcaactgatcctcccttagcctcccaagtacctgggaatataggcatgtgtcactgcatccagctatactaagaacttttaaagctcaacaatattaatagcccatttcttaaataagcaaaatattgaacagatagttcacaaaagaagacacgtgcccaataagcaaattaaaagtggctcaacattgtcagtcacacctgttagagtggctaaagtttaaaagactgactataccgcatgttgacaggaccactttggaaatgtttgacagtttttcaatccagcaattctaggtatttacccagatgaaaatatatgtccaaacaaagacttgtacacagatgtctggaggagctttatttaataaccaaacctgaaaactactcaaatgttcatcaatggatgaatgaatacattgtgcctctatctagacaatggaatgtgttggcaatacaacaaactacagatacacagaataacatgtattactctcaaaaccattacagtgagggggaaaaagctagacacagaagagtactgtgcactcatttcattcatatgaaatgctagaaaagtgaaatgtgatcagcggttatggaaaggtcagtggctgctcaaagctggaggtggcaagcactgacgggaagtgacgtggagaactttgtgagtggatgggaatgttttgtatttgattgtagggggtggtggttactcaggtgttcacatttgtcaaagcacctcagatgacactttttattttatctttatttatttaattttgagatggagtctcactctgttgcccaggctaaagtgcagtggcatgatctcaactcactgcaacttccacctcctgggttcaagcaattctcctgtctcagcctcccgagtagctgggactacagccgtgtaccaccatgcctggctaaattttgtatttttagtagagatggggtttcaccatatcggtcaggctggtctcaaactcctgacctcaggtgatccacctgcctcggcctcccaaagtgctgggattagaggcgcaagccagccaaataatacattttaaaagggtgtttgttgtatgtaaattacacctttaaaaaatatgtaaatgctaggggaagagaaaccaaaccaaaccaaaccctgttctttgctggagctagaaatccaagacttacaaagcaataaacaattggacaataaacaggctgggctagatggctcatgcctgtaatcctagcagttagcgggccagggccaggtgggaggatcacttgaggccaggagttagagaccagcttgagaaggccctgtctctacaaaaaaaaaaaaaaaaaaaaagccaggcatggtgatcctttaagcctgggaggttgaggctgcagtgagccacaatcactgcactgcactccagcctgggagacagagtgagaccctgtctcaaaacaaacaaacaaaaaacaaaaaaataacttgaacaataaacaaaaaaattacactgagatacaaattttcactttccagaatgtcaaaagacccaaaagtttaataacacagtgtattgacatgactatgagaaaaaaacaccactgacaatgggagtgtaaattggtataatccccagagaaggtattctggcaatatttactaaattataaatgctttgatttagcaattccacttctaggattttatcttatagataaactctaccacaaatagcacatgttaaaggttattcattgcaaaagtatttaaaatagcaaaacacaagaaataatcaaaatgtctatcggtccacgacaggttgaataatttatgatacatccatactgtggaatcctatgtaagtacaagaaagcacagggaaaggctgtctgtggtaacatggaaagatcctcagtgggtaatgttaagtgaaaaaggcaacattgtgtttctatgttgccatttgtataaaaacaggaacaacaaaaacccagaagatacatatttggattttcttgcatatatttttttttaaaaaacaaaaccttcaggaagaattaccaagaaactaatcgcaggggatgggggaaggcatgggaaatatgtgtggagggagaattttcataatatgctttcctatctttttaaatgtttagccaaccaaaatttaaatattggctgggtacagtggctcacacctgtaatcccagcactttgggaggctgtggtgggaggatcctgcgagcccaggagttcaagaccagcctgagcaacatggggagacatccttatctctacaaaagagattttaaaaattagccggttgtggtggcacaacctgtggtcccagctactcaggaagctgaggcaagaggatcgtttgagccccagagttcaaggctacagtgagctatgatcatgccactgcactccagcctgggtgatagagcaagacggtctaaaaaattttttttaaatgcttaaaaataaggccaggtgcggtggctcacacctataatcccagcactttgggaggcctaggcaggcagatcacttgaggtcaggagttcgagaccagcctggtcaacatggtgaaatcccatctctactaaaaatacaaaaattaaccaggtgtggtggtatgcgcctataatcctggctactcaggtgtctgaggcaggagaatcacttgaatccgggaggtagaggttgcagtgagctgagattgtactgtactctaacatgggcaacagagtaagactcttgtttcaaaaaaaaataaaatacttttcaataacatcaaaataacacattatatattaatatattaactaggatacttaaactattatcattattcaccaggttatcttgaagaaaaatataataagaagtgtctagtccggtataaggacatatttggcacacagtaatggttactatttctataccctgcccctcaaatgcccgcacacaacctgtctggtacttcaggttctagttccccgaagcccagttgcctgactgcctcttccagctgtgcccttgcagggacttctcctctgctgaatgattttccccatctcttcttattgtccacctacttggtagctgggatgtggaggacatcacctcctcaggaaagccttctctgattgacacacaccctcctcctccctcttcacaccgaccctttaggtggcccttgtccttcctcccctgtggactgcagggtctgctcagtcctctgtagtcctggagtgctggccaaggatcgagctcccctccacagggtggggattcatggcaggggcaggccttactctccacctacacagacatccagaaaagtttcggtttcccctaaacgttatgttgatcttcccatgctcacaaagaagagtttgggtttcccctaagttgtgatctcatttttcctgtcttccctaccctccagccctaccccagccaaggggccgtgccagctttcatggtgaagatgcctggggtttcctgggcagcccttcatatactgtgtaatagcaatggaaggaatccacaggtgaatgctgatgcaggaagctcccagtccagcagggagggcagccatatatgcaaggagcagaaacacacaatgtggaatgggtgcagagagccaggcaagggcacagaggacaagtctcactgggcctcaaagggtggccacagtgtggctgcggggattggagggcaggctttggaacagacagcctcagctagaaagccctgggagggcccatgagaggcctccaagtaggcaaaggggcaacagcaggtgcagcagcctgggactctaggaaggggccctggaaacctgaacctcaatggccatggcagtgacagaggggtctgtgctgggctttagggaggtgcctcaggcaatgtggaggacctccaggaggcgggacaaggcagtgtctggcaaaggcagggacagacagcaaacaagacagagccaggcacccaggaagggcagagaccccttgggggagagggaagttgcggtgccacaggacaggctgggggctgttcttaaggggaggctttgatttttgtggttttgtttttcccagaagtctctccaaggagtaagattcctttcttaggactcaagaagtcagaggcccccttctctggggcccctggggtttgggcgagagtactggagcagaaagcagggctgggctgggcctggggccagacctcaatgactgtttccttcccgtcagcgagcggagaagcagtgacagagtgtaccaggaggggaagctgacggtggccccaactcctctcttgaatgggatatgaccaccccacctgcccctcagtgtttgcaggacactctggcacactcatgccttcctttcctggtgaacctgtatcccactacaaagaggaacagaactccccacccagccccacccttgcttccaggggctttgagacactcaggagaaggagcttcaaatattgtgagggtctgtctgtgtcagccaccaggatgtcaatccctgcctgggctggcagcatggaccttgtggaccctcctagcccaccccatgcccccaggagccccgcttggcttcttctcttttatacattgtaaacaccacatttatttgtctgaggcttgcaaacctctggtaagaagcacagaacgcagggctctccttcatgctgccctgggccccagctcgccaggcatgcaggacagagctggcagatgagtcagaaatctttgggagcagcgccagggaagcagcaggccctgctccttcccatgcccaatcccgccagcacgggcctggactgcagccaggaaggtgggccagccaggatccccaggtaacttcgccacagggacctcttcttggagctgccttcccttccctccccatccctctccaatccccgcagagcttagagcctgggccacatgcttggtccctcacacaaggaccaaaccagctgctgtcaggctgtttctgtgggtcctgtctctccagtcaggaagccagcagggcagggcaggcctggctctcctcctggaatcacaccgtgcacccagctcagcgctgggcactcagctggggaccgggatggacaaagccttgtccagagaaccactgtaggggagacgtgcatggcagccggactcagcctcctgcagcctccattcatgggctcttggctgggcctgaaatttgttagggcctcaactctctgtggtgcagatgaacacctcctcctccaagaggcccctcaggcttggtgccaggcttgggactgggctctggaaagtcagccaaggctgctacttcaaggccctgaggacagcctccagcttcatggccatagccaggtcgcccttcaccttcagccgtccactcatgtaggcccccaggggccgcagctctctgcatagcagggcccgcaggtctgcctcggccatctccaccaccacatcagggatgccatcaggcaccccgtgtcccactcttcctcgtcctgtggggcaaaagaaaaccgagtgtcagtaggggaatggaggaacgtgaaggagatctatgggggtgggaggggctggtatttcccattgggaggagagtactggttaagagtttgggttctaataccctgggtttgagtcttattggctgtgtgaactcttggatcctcagtttccaaatctgtgatgataattcctttagagatgacaattcctaaagcataggctcatggtgagaagtgggtgagataatgtacaaaaagtacttggcacagagcctgacaggcagcaggcctgtaacacgggcaggcctcttggtattggaagcctggctgcattgtcctgcggatggcggggagaccagggcatagttaatgcctggaaatggtgtctgagcccctgcctgccatgggttcaccccaaattattggcaggagcagggggcagtctacgagagcaccactggggtaggtaacaagaaacctagcaagctggatgggaaggagaggcaaggagggcagcggcacctgtagtgaggtccaggaagtaggcgctttgggtgccgctgggcaggacgacattgaactggtagcaggccccgacttggctgaccagggcctcagacaggaagggctgtagagcagtcagtagcccctccgccagaggctgcttcggactggacctggcaccaacttgaggggcaggtggctcaacttcactcaccatctccacggtgtctgctgggggtggccaacagggttggggaaggaggcagagaggaggtcatcgtgttgccaaggtcaggaccactcactgtggcctctgcaccttttgtggcagtttcctcttagatccccttcaggcctctgttcaacttcctcctctaccagaaaggtgcccctgagttttcagcctaaactgcaaactcagtttctaaactactccagcctcagatataaaattctttccagctgcccttctggtgatgtcgcctcctcccatggaggctgccaatggcctctacacactcagacacctggcctcctctcactgccttggctgtggtcagtgtgggctgaacatctgtgcagggtgtgtactgcacagagctgctgggatagtgagcaaagtctgtgctggcaccaagctggtaaacacccccgctctcctccccagggctcctcacctggccccggggacggggcacctcctgccattgagttcatgcttcctcccaggaagtgcagggccagctgctggagggtgctgtccaggttgggcccagctgggctgtcctggggcggctggagcacggcctccactgccagctccacgcggtctacctccagcccccaggccctggtcacatcgttgatctccagctggaggacagtgtgaggagaaatgtaattaattcaacaaacctttcctgagcaccttctttgggcagactgtgtggccgtgcatggacatggaggcaccacaccgcccttgagacactcctagcctgggaacacaggcagagggcaatgacctttcagctgtggtaagtgccaagacagaagcaaggcctgtggtgagcccccagcagaggagggtggtgccagcaggagggagtcctcaggtggaggaggacccttccagcaacaggaacagcatgtgcaaaaccccagacaagaaaacctggcatgttcgtggagctgcgaggaaccagagttccatttagctggaccctcacatgtcggctgaggactggagacagctgaggggtcagaggtggggtgtttctgcttactttgatttattctgaggcaacaaagagccccagggaggagtttgagcagggaggtgatacagcagacttgctttaaggcaagatcctcctggctgctgtggatgctggattatagggggctgaggggagggatggagaccaaggaagacattgtttcaaaatacagccaaggaatgatgcagctctggcgagggtggaggggagctgtgaagccaagatccactgagggaggcatgcctctatcaactgtactgagccacaacagggcactagagaagtgcaagcaccaggctcggggctgcctcgatgtgtgcaatgatatgagagggggcgggagtggggaggagtcaggctcctgaatggatgagtgtggcattcactagagaggacacacgggggtgggaagggagggatggcaacttttttttttttttttactactgtaagcttgaggtgtctgtggggcagtcaattgtccagtaggcagctggagaaatggcccagggtacagaagcatcagggctagggcaggacattgtgaataatcagcatccacaggcagcagacagcccagatggatgagctctcccagggaggtcacagatgagaagaggccagtgatgaaaccctggaaactcaagggcaggagaataagtggcagtaaccagggatgacagggaaggaggaagtacagggggttctgggggctgggggctgggtcgaccatgtcaaatgctgccaccaggtgatgtaagggaagggctgagaggtgcccactgggctggcatgtgggaggtcactgtgatgttggccagcgctgtcttgggagcccaaggaggccaggatgaaggatgtaggggcaggggctgggagcatggatgaaagtcttgcagaagaaaaggggagaaagggagtgggagctagagggcactgtggcaaagggagggcacatttctacacagaaaggagaggtgacagagagagagtgcatggagtggagggaaggcatcctgggatagcagggggcccacagcactgcgcagtacagggatgagcctcagagaggggaggcagaagggcaaggaggcaggaaagcagcacagaggcaggtgggtttgaaggggtgaaactggaggaagcagagtgctcatcctagagtttttctcctgagtgttaggaggcaaggcctgctgcagagagcaatgagcagtggtggggctggaggagggcagtgaagggctgaggcagctggcctggagcactggcaggtaaggagtggtaactggctaaggaaggtccagcaagtgagaggtggggactctgatttctctagaagaaaatcaggcaaaaaggggcatgtgaataagtgtacgcctgaaccagggcctgagggcggtgtgctggacctcctgaggttctgtctcaaccacaggcacagctctcactctaccaggtgctcactcagtctgggaaatgggacttaaaggactctcacatcctggtgtggaactgacctccccaaactgcctgtctcacatcaaaacaatgtgcaacaagactgagatcagttttctcttcctaaaggtgaattaacacggggcatggttttatgaataaaagttgttatccacttgctatctgagttgtgttagatcaagcactggattgaggggcgatggtgggatggaggcaggtggtctagctatggctcagctctgcccttgaccatagctctcagaggcaagtcaaattatttcttagccttagcttcctccctccaaaataaaacagtagtaccgacttgcagcaaaaaatgtcaagctcagaaatgctgggccagacaaaaggactttgtaaaccataaactgctaagcacgtaagagctactgttaggatctcaaatagtatttcctcaggaatttcccctcgctgcttccagtgggacctccaggactggcatttatcccattcccccgactgtcctctaaccttgattccccagggcaaagcagagccaagaggaatggggagaaatgtcacctacattcccctgtcaggacacaagaggaagcacaagttgagtgtggctgcaggggacacaactctgcatgtgtatttatttctaccccatcttgtagcagaagagatttagggcaaactccaatatacacatggagaagaggcaggaaaaagatccaaatgtcctcatgttcctttgttctgttccaaacaaggaaacaaaaatcacaagcatgcacacgctgcatggtgagcctggaattccccagcaggtgactgggctgggagggtccctgctccatcacccatctgcctgccccatgagtcaggcccggaatgagagctgtagaagccagtgtcatcatggcagagcagtgaggggtaaaaactaaggggcagaccccaagaatgtctgccggggccacttcctcttctcagggacaagtttgcccaggatcgttatggtctacgcccacctgccattcctcaactcatggccccacccaggcactggctcttcaaaggtggttacactattgggacatatggtaaactgaggcccagagtggtctgactcttttctcaaagtgacctggcaggtggagccaggccggtgccacccctcaagctccgtcttgtgaggggctgcctaccagaagctggtcgctgatcttgagcttctccatctggatctcccgcagcggcctcttgagcagggccttggtcatggcgttctgggctgtcatgcgtgtggctgtgttcaggtctttcacagtcatcaccgacagcaccgggtcccagatgcgaaactggacatcggctcccacggacagcacagccccgtccttagaggccagctgttgggggaggccatgagagagagacactcaaggggctgggggtgcagggaggtcaggcccactggggccacccagcttgaaccacctgcttggcagctagctcctcaagggcaaatggtgtcaccaagtatgtagggttaggtgtatgaagcaaggatgtcctcctagcttccatcaattttctggtctcttcttcccccttcccccctcagatggtgactcacaggctgaggtcctggcaccacagtacattctggacaggcccccagttcctctgtcaaggcagctgagaagcccctcaccttgcagggagggacgttgaaggctcgtgtcctcagatccaccctctgaaaggagtcaatgaagggcaagagcagaaccatgccaggtccctggggggtgcggatccggcccaggcggaacacaatcatccgctcgtaggtgggcacaatctgtccacaatggcaagggaaagagttgaaagtggtcagcctaggctggccaatgctgtctgcctaggtcccttcctcacttctctcctcctcacctgggtcacagttaggtatccctagcactgtttccagatgagaaaaccaaggctcagggaagctaagtgactgctcaaaaattgcatagccctaagtgaaatagtgaagatttgaatgcagttctgaataactccaaaggccatgtgtcttaactactgcactgtattgacttgatccttagagaaacttttcatctctgtggtctgaagttagacatgactcataccaggaaactgtctgtccttggattagttaggagaaaaggctcggctgccctaacagcacccccggggaaagggctttgtcaactttaggtccctggacctcctagagaagtagtgatgtccaaattgagaaatgaaggcccagagaggcaaagaaacctgttcaaggtcacatggcatttgtttctgtggcagttttagaactaggatataaggccatttaaggacccccttgcagaccacaccaaacccagaggttttctagagagggactgttgcctagggctacacaaagggcaaggcctccttgggcttccaccttcccccagctttcacgtgcgatgctgaactatagctccatggttcatccttttcccactgtaccaccccttatggaaaatgaggcctgaattcctattatgcactaccagctgggctaagttgggtgttttcatttctaatttattctaacccaaagagaagataatttggcaaagacatctgcgtgtaccttaaagccagtgtccagatcccaggacttaggagtttgggacttgcttctaccccctactggctcccagtatgactttagacaagcccaagccttagtttcctcccctgaccaatgtgaatgaatggttcttgcctagcccattacacaaaggggtaataatatttagggaaaggggacagaggataggcaaatttattcatcaatgccaaagctctcagtgtggcccaaccaccctgggggctgacccagccagccttaccttcagggcaaaccagccagaaatggggaaggtgaccaacagcagcaagaaccccaggaaactgatgaggccatgacagaggcaggagggccagctctggggtacatctgcaggtgagagcagaggtggtcaactggacctgcacgacagctgccaagcggagtgaacttgggcaagtgtaccttacgcccaccttcccctcgagaggctccttccttctcagggctctcaatctggctccttgcctaatattcccgtatctttgggcagctgcaagttagggtctgttccctcctcccatacatcaacactcatttgtcccaagtccaacaaccctcacaaggccttattctctgctaggcaacagccattcaatctcagaatccagtccgcgtgatgatgctctcctcactggactgagtaggggtcaatcctctcgtttaatttatattgcctacccatacctggcatggagccaggagcacctgggcatctgtaaacatgcactgaatactgctggcaaaacacattcctcctataccatcagccccagaagtgtgctttccaggagtccttatgaagatgatgccttagcctacagggataaatcataaatagcttatcaacgggagccacagatgaggaattagattattattttctattccacacccaactttaatgccttaatgaccattaaaaaatgcctatttcacgagatggcgccactgcactccagcctgggggacagagcgagactccatctcaaaaaaacaacaaacaacaaaaaacaaaaacaaaaaaaaaccctgcctatttcaattcaagaaaattgttaggggtcggggtcaggggcagggctagaaagatgaggcttatccaagccaaatgtcctggcccctggagattcaggagcccaagttgggagcaaagccgagacagctccagaatctgggatgaggttatttgccgctttcctcccaaccctggacaggaagcagtcgggagccctgctccattcttccaggaagccctgccctctgggctaagccccagagcactgaggctccactttgtgcctggctctgatccaccaggcctctcaagagacttctggatagggagagctttcaggacaggaaggccagggagggatcaaatccaaggttaggcggttaggctgaacagcgtgggatctggcctgtaggccaaaggagccacagaagactttgagggcaagacagaagcagggcagatccaacaggcagctgaggacctgtcattttggcctgcacatccaggagatgcctagttcccgggcttctagaggtgccccctagggcgaaaattcttccatttccctgcagcaggtgcctttagggtgctggtggcctcctctgcctagacctcggtttcttctatgcgaaatagaaacctgaaacgtcttcccaggcctaaagggctgataagagccgaggacaaatgtggtgaggtgaggttttggaagataggagcaacgctggctggctctggggccaaagccccatgaccctagggagggcggatcggcgctagcaccaggcgccgggtccagccccctctccacatcgtatccctttctcagtcccccctcgtagggtgcgacggcaccgggccggccgactcctcggaggcagagattcgggcctgggggttgccggccggtcccccccggctccgccgtgccaggcggccactcaccggcccctgtccccacgccgccccgctccggggacaagcagcccttctgcgagcccagaaagccgaagctcgactgctggaagcggtcaaaatcacccaggggcagcgcccggtacccagacctgccgagcatggcttttgacaggagacacgccccgcgcctccgcgcggcgccctccctggccagtgggccctacgcggccccgccctcctggctgctgcttccggcttcacccgcgcggccacccgcggcggcgcgggcgcaggaagaggaggccggccggggcccgcttccgccgtcgcatggctccccctgcgctgggaggaccgaactgcagcccagggctactgggtgtgatcggcgttcctcggaccccgctggggtcatcgcctcctcccctcttctcctactcagccctagaaaagctggaggggaagctgggcacggtggctcactcctataatccatcaatttgggagactcaggcaggaggatcgcttgaggccaggaattcaggaccatcctgagcaacatagtgagagcccatctctacaaaaaatttttaaaaattagcctggcgtgggatgcctgcctgtggtcccagccacttgggaggctgaggcgggaggatctcttgagtccaggagtttgaggctgcagtgagctatgatcgtgccactgcactgcagtcggagcgagagagcaagatctcatcagggtttacaggaagccaatcttctccaggatcaaggacatgctatatcagccttctcagcactccttctctcacactggaggcaggacatgccatatctggactttgggtttctctgggacatagtctgcaaattattcctctttgtgaacccacagcccagcaagcagggactggcatagggcaggtctcaatacttatttgttaagtaatggcctggccaggtcaccgtgatcaaggtggagtaggaaggcctgaactttggcacaaaaagaaagaagtttcacatgcagacttcggggagcatgggagtgtaaggaagaaggggatagcacagagctacatgagggcaggggccccagagcaccacagaggtgaggccctcagtcctgcaggtccagaaagagcatgccccttgatccaggtacctggaattaacttgcctctccagggcttgagaaaacctgaatgcaactcgtgaatttcctttgagaagtgttaacttccaacaggactttggggtagtctgggagcaggctatcttccaaagcaagcaaagaaatgaataaagcttccccagctctgcctcctcagccaatcgcctctggcctccgaagccccatcctgccatagcccacttccaggtcccttgtgcagatggctgcccaccatatttggctttcatggactgattctctaaaggcctgggagtactgaccaggctggagggaagggcaggctcctgaggccttacagtccctaggaagttgcgtatctgcccaacccctgctctccaccctgcagactgtaaggtttacaagagccaggccctatcatcatcctttctagtctgtttctaagttggaacagagtacggaatgggtacacaggagccagcacagtggttgcgatggtttaagtttgaagccggggcgctgacccagtgaggtcacctggaactgtgcccctttccccttaccagctgggagtctgacatgcttttccattggcgaagacctagctggctctcccctcaccctcttcatacccgctctccagctctccccctccctcctgcccccaccacctcagatccaccagcctttccagctgtcactcaaggcatcatcctgctccctcacctccagtcactggcttcccaggatctctgaatcaagtccctcctctgcatcccacagccactgtcctagaccagggcacctgctcctaggttgtcagagtgactgtcccatcatgcacagctgatcgtgttgttccctggttccaaatccttcagcaacttcccatcactcacagaactggttcaatctcctcagctaggatcttgtcctagcacactccttgggtatcatttctcatgaattccctcttaaatctgaaaatggccaaaattagttcccaaacaggcttttgcaagagctatcttttctgtttcaagtgtcccccgtaccccaccacctacaaccctaaatccctggtgaatttccactgcttttgcaggtcccagctgtgggctctcctttccagaatgtctccgtttgcaggcttgctcttccattacatctacggctcttagaaagcaggggctgcgtgtggctcatctttgtacgcccagctcccggcaggacgtggcacgaagcagtgccagtgtgaacggatgaatggatcaaagccgggagcagggctgcccccctgcagctctgccctacctctcccgctttaccgtaagtcagcggtaggtctgcagctctccgcctctacctcctccccgctctgggcgtgtctttaaaacccacagtcggcctctctgccccctagaaccgcccccagcttctgtctcacttcctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagaggtactattgggttaggggatgatggggttaagctttgttggtttgctgtggtggggagaggcgggaagagagggtctaacggaggatttggtcaagtaccctagagagtgacacaaagcgggaagtccagacaccagggtcctgaccgtctcgggtggggcagggaagggagggtaggatagagtagaaaagaggacacggaggagttggggcggcctcgctgggctgcggtttctccactgagcagttgggcaaggtgagaagggtcagtggcctccgggcctgggcccttccgcccaccctcgagccctgcctcaactttgcctcagatgcaggacttcagattagggaggatggaggtagtacccctgttgcgctggcctggagccaggggcatgtcccaggcacggcaaaactaaaaccaacttcccagatccgaggtgagaaactggctcagactgaagaggtatctttgccaaggcctcccagctcatgtggtttctgcttaaggaagcctccccaacgaacccttctcttgccacacctttcctgcccacctcccacctcccccgacaaaggaactacttgggtttcttgctctgctgcctttcaggcccttttactccccttcatgaaagtacagaggacaccgtattacagtaacttttataaacattattacaactaagaataacattacttaacaatactaggtaacatttatgagcacttcaaatgtgccaggtactgtattaagcactttggtttttttttgttgttgtttgtttgttttgctttgttttttgtttgtttgtttatctgtttgtttttgagacggagtctcacactgtcgcccaggctggagtgcaatggtgcgatctcggctcactgcaacctcctccttccgggttcacgccattctcctgcctcagcctcccgagtagctgggattacaggccacgccaccatacctggctattttttatatttttagtagagatggggtttcactatgttggccagattggtctctaactcctgacctcgtgatccacccacctcggcctcccaaagtgctgggattacaggcatgagccaccatgcccggcctgtttttgtattttacaaaatgtggtaaaatatacctaatggataagttcctatgttaaccatttataagtgtaccattcagtggcattaagtagattcacaatattgtgtaaccatcaccaccatctatttccagaactttttcattactccagaaactctgtactctttaaaccataggggagggaaagatggcttgcctccacccttctagtttccttggctgggctatgaattaaatagcctatgaattaaatagtcataaaatagattaccagcggaaaacccatatttaattacatatgtatactcaggagtcccacaatatatgagactcaaagaaaggtcagatgattgaagcctgtataacatcctgagctacggaaaagagcttggagcttctgggtgatggtgataacacaagttatgggagggtgaggagaggagctgtttggtgaatagaggttgtcttgctatgtagattaaaagttcttagataataaaagttgtctggagcagccctcttttaatatagatcattttactaatgtagattttcttttaagatataaatgcctttcttttttacaaaaggagagcttttcagagctattcctgtatcagcagtttctcagaataaccagcttaaaatatgccaaagaagtatatttcaagagcctcctgcagtcatactttgaagtggtgtgtcctgagccccagtaatgcaatagctcctcattttctccttcccctagcccttggtaacttctaatctaccttctgtccctatgaacttacttattctagatatttcatgtaagtggaattgttaccagtagaggatcttgactgcaaattgttcaggttcttggcattttgaacaaagaattggacaaaatgtacagcaaagcaaggaaagagtgaagcaatgaaagcagagatttattgaaaatgaaagtacaccccacagggtgggagcggctagagcagggctcaaggaccccagttacagaatcttctgggttccaaataccccctagaggtttcccattggccacttggtgttcaccccattggttgcagaaagcaaccaaccagacgtactttcaattttccatctgccctgcaggaaatggggtgatttgcaaagagagtagcctctcttccttttgttactgaggcatggagagttgcggttttcctttcgatttagttctaggaagtcagagggaatcggccttaggttccctgcctccagaccctattctcctgcctcagaatcatacagtgtttgaccttttgtgactggcttatttcacttagcataatgtcattgaggtctatctatgttgtagcatgtatcagaatttcatttctttctaacgctgagtaatattccattatatgtgtagaccacattttgtttatctattcatctgttgatggatacttggattgtttctacattttgtctattgtgaatagtgttgctgtggacattgttgtacaagtatctgtttgggccttgtttttacatcttttggttatatatctaagagtggaatttctgggtcatattgttgttccatgcttacctctttaatgaacccccaaactgtgcattaagcactttatatgaggttggtacttagtgtatctaccttccaaactgagttccttgaaggcagaatgtatcctacacctcttatatctcagagcctattactgtgggtgatgagaagtagatgctcaataaatggtgcagtgagagctggagggcctgaataaatgggggtattggggtgctgataagccagggttttgcatcatccaatgactggctggaatggaatatgaggtcctactccagggtccagctgtaagggtggttggccggtaggtgggggcttttgggacttctccaggcctcacctgcctctctggtcccccagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccaggtgagtaggccggcacagggtggggtggtgcatccaagtaccaggtagagggcgagaggagcaaagatccaaagagtcacacagctgaggacaaggagcttctggggccttgcaactctaaatgtggtctgcagatatgcagtgtccgtgttgatgaccacaatttatgctgccagtccccacgcaggtggatagtaagtttccagtttcctcctgtaataaataatgctgcagaatcatctttgcatctttatccagtaacttctttaggataaatttttagaagtgccactgctgggtgtagggggacgggaattctacatttgatacatgttaccaaactgccctttagaatttagtggaattttccgagagcactgacacggaatctcagtaaggctggattctaggatcagagacaagtagttagtttctgtctgaaaagttgaaaccattaacaccaggcagcgctatctgagaatgtctgtatggggaaaaaaaatcacatccagttgtaattatttttattaaacagattttaactcagttttttaataggtaatacattcgtacagttcacgaacaaaatttgtaaagaggagagagagagtgcaatcttctgtccatgcccaactgcctaattcccaccacttctccctcttcccatccacaggtagccattgttactagttttgaatgtttcttctgagagtttctttacgaatatatatgcaggtaggagcaatcttatcaggtcctattttccctcttttagccaaaaaggtagcataactatgtgaacttttcaccattagcaatagattgttcatagaaggcgcttcttggttcttagagatccacttgcaaaatgaaagcatttttcgctggtttttgacaactcagaactatatatggctaaaccacatatttgctgaactacatatctgctaaactgactgtgatttgtttcctgctttaggataaacttcccacactatcagaataagctttcccctccgactcctcaacagctggtatcaccacgtttcttagcttattgtaaaggttgagtggctttccacttgtttattggccattgtgtttctgcatttgcgagtggcctgtttaggtcctttgcctgttgttgttgttgtttccgttgaggaattaagggactaattaaagaattcaggaacaaattcctcgaaagaaaaaaatgtatgcatttcttttgctcttacaatttatgcagttttaaaacttacatatttattggattttgattgaaattgcaataaattaggagaaattggctttatctctggttctatcttttggatttaaaaaattttttttaattttttttttttttttttgagatggagtctcgctgtgtcacccaggctggagtgcagtggcgcgatctcggctcactgcaacctccacctcccgggttcacgccattttcctgcctcagcctcccaagtagctgcgattacaggtgcacatcatcatgcctggctaattttttggcatttttagtagagacagggtttcactataatggtcaggctggtctcctgacctcaggtgatccacctgcctcggcctcccaaagttctgggattacaggcatgagccaccatgcccagccttatactaatttcttaatgaatttgtaagctttcatgttttgaacgtgataatgcagccatcccacgggatccatgggagtctgtttcaaattcatagatgctcaagtctctgatataaaatggcatagtatttgtatataacctctacacatcctcctgtatactttattttttattttatttttattttttgagacggggtcttgctctgtcgcccaggctggagtgcagtgctgcactcgtggctcactgcagcctcaatctcttgggttcaaacaatcctcccacctcagccaccagattatacaggactgcaggtgtgcaccaccacactcagctaatttttaaattttttgtagagacagggtttcacgacattgcccagactggtcttgagaactcttgggctcaggcagcaaccctccctaggcctctcaaagtgctgggattacaggtgtgagccactgtacccatcccctcctgtatactttaagtcatctctagattacttataatgcctaatacaatgtaaatgctatgtaaagagttgttttactatatttttgaatttgtatatttttttattgtggtacttttttaattgattttttttcgcctgaatatttttgatccaagatttgttgaatccacgggtgcgtaacctgcagatactgagggccaactgtacatataaattgtttagcgtagtgcctggcacatattaaatactcagtgaatgttaaaattctattataatttctctgctctagaacaatttgaagaatataagaaatttaggcttataaaagttttttgaaaaaccatcttggaactggtgccttttttatagtagatttttgggaacttttcccatttttgccatggcattaatctgttttggctcttgtgtcagatttttggaagattttccagttcatcctgagttatctttcattatttaaaaatctcctatatgcctgtaactataccccctttttttatttctgatgttgtatatttgtggtttagcagtcttttcaaagtactgtacttttagtctttccttagattgcttactgattttaatgttttccttctttctgtttgatcattttatttttgtcattttcttccttctaacttttgtcattattcattttctagcttcttgaacttataattcatttatttgcaatctttattgtttaataataataacttttttttttttgagaatctccctctgtcacccaggctggagtgcagtggtagatcttggctcactgcaacctgtgcctcctgggttcaagtgattctcctgcctcagcctccccagtagctgagactacaggtgcccaccaccatgcctggctaattttttttatttttagtagagacggggtttccccatgttgaccaggctggtctcgaactcctggcctcaagtgatccacccgcctcagtctcccaaagttctgggattacaggcgtgagctacaatgccctgcctaataataactcttttaaggcataagttctctgtatatggttttggctgtatgccataactttgataacttcattagtgttctcatagtcaatcatttctcaaatttcatttcagtcttttcttaaaaaggttctcttgcttaaggtcaagagttcgagatcagcctgggcaacatagcaagacctcatctttacaaaaaataaaaaaaattagccaggcatggtcggtggtacatgcttgtagtcccagttatttgggaggttgaggcaggagggttgcttgaacctaagaatttgagcctgcagtgagctgtgatggtgccacttcactccaaccagagcatcagaaccggaccctgactcgaaaaaaaaaaaaaagaaatttttttctcttgaaaagttttagagaatagtgttttctaaaattttcaagtggttttgatgtttggtttcttgttctgtcacccaggctggaatgtgatggtgcgatttcatacttgttaatttctgcactatggccagtttatacagtttgtatgagttctacatctaagactatattgagattttcttagcggcctaggatattccttggactcacatattcctagcaataatccttagagttgaaaagttgtatttgttgtacacacatatatatacatacacaaatatatgtatataatatatatgtgtatatatgcatatatctatatgtatatatccatatatatgtaagttctagtgcttgtgtgtgtgtgtgtatctccacgctattgaaactttctacctttctttcttttctttttttttttttttttttgatggagtcttgctctgtcatccaggttggagtgcagtggcatgatctcggctcactgcaacctcctcctcccgggttcaagtgtttctcctgcctcagcctcctgagtagctgggattacaggcgtgtgccaccatgcccggctaagttttttttttttttttgtatttttagtagagaaggggtttcattatgttggccaggatggtcttgatctcctgaccttgtgatccacccgcctcagcctcccaaagtgctgggattacaggcgtgagccaacatgtctggccgaaactttctacctttccttccattctgtttcaccagttctctaaatgataattacagagtggtaacttccccatcaaaacatatatataggccagatgtggtggcttccacctgtaatcccaacactttgggaggccaaggccggtggatattttgagcccaggagtttgaggccagcctgggcaatatggtgaaaccccgtctctacaaaaaaatacaaaattagctggacatggtggcacatgcctctcgtcccagctattcgggaggtggaggtattcctcagagaggatcacctgagcctgtccgttcaaggatgcagtgagccatgatcacgccactgcactccagcctgggtgacacaatgagactctgtcttaaaaaaagaaaaaaagtgggccaggcgcagtggctcacgcttgtaatcccagcactttgggaggctgaggcaggcggatcatgaggtcaggagttcaataccagcctcaccaacatggtgaaacctcgtctctattaaaaatacaaaaattagccgggcgtggtggcgggcgcctgtaatcccagctactcgggaggctgaggtaggagaattgcttgaaactggaaggcggaggttgcagtgagctgagattgtgccactgcactccagcctgggcaacaagagtgaaactccatctcagaaaaaaaaagtgtatacacacaccaacacacacatacatgcacactctagaacctatctcatctatcaccacaaagagtagaatataactattcttccagagaaaataaaacatttagcacacttttatagtttttcttcttccctcttccttctcactttcagatttagttgaaataatgtgaacttttagttccagattactaccaaattgttaatttttttttcttttgtaaacatcctttctgaacaggtattaagcttcatggtcatattacaacgcacttgttagccataccttatactttaattggtttcattgctcatgataagttttcctatagcttttcttctcctttcttgaattatttaaggtgattaattttccatttggcaggaatactccatcaagtaattaaaaaaattattccagagtttactttctgagaccttaagtgtctttacttgtatgtccttcttttgctgtcacatgtgagggaaagttgagctaggtgtaaaattctgaggtcataatcacagtgctttcacctcagaatatataaaccttgcttcataaatttctagtctctggtgttgtagatgagaagtccactaatggtctattttttctctgtgagtaatctgtttttgtttgttaaggatctttatttatttttatttattttactttttagagatggggtctcactctgtcacccaggttggaatgcagtggtgcaatcagagttcactgcagcctcaaactcctgggctcaagcaatcctcccaccttgacctcccaagtagccaggactacaggcacctgccaccgtgcctggctaataaatatagttggatggttttcatttgtttatttgtttgtttagagataagttcttgctctgttgcccaggctggtgtgcagtggtgtgatcatagctcactgtaacctcgaactcctagactcaagaggtctgctagccttagtctctgagtagctaggactataggtgcctgccaccatgcctggctaatttttaaaattttatgtagagatagggtctcactatattgcccaggctggtctaaactcctggcttcaagtgatcctcctgccttagccgcccaaagcactgggattacaggcttgagcccatgcccagcctgctaaagatctttatataattttttcttttttcaataatcttctatcgccattgttgatctgaaaaactcaagtctttcttcagctcttcatctcagggaaattgtattctgctttttaattttttttttttttttgagatagagtattgctcttggaatatagtggcatgatcttggctcattgcaacctttgcctcccaggctcaagcagttctcatgcctcagcctcccaagtagctggaactacaggaatgcgccactacacctggctaatttttgcattttctttttagtagacacaaggttttgccatattggccaggctggtcttgaattcctggcctcaagtgatctgcccgccttggcctcccaaagtgctgggattataggcgtgagccactgtgcctggccatactttttaatatactgatagcccttcatttgtttattttattttttatttttattttttgagacagggtctcactctcacccaggctggagtgcaatggcacgatctcggctcactgcaacctccacctcctgggttcaagtgattttcctgcctcagcctcccgagtagctgggactacaggtgcgcaccaccatgcccagctaatttttgtattattagtagagacggcgtttcaccatattggccaggctggtctcgaactcctgacctcgtgatccacccgcctcagcctcccaaagtgctgggattacaggtgtgagccactgcacccggcccatttgtttatttttaaaatttttactactgttgttatatggatattggaactccaagaacatattttacatcttttaaattttttccccattaattctgttgctttgcttttttccccgagattctcagagagctcctcgaattgtttttctaactcgccagctcatcttttcgccgctgactccattcttctatctgctacccctgtagagttgttgtgggtttttttccccccagcaatctttttttttttaattgccaaaagagcttaatgctctcaggatgctttttcttggcagcctgctcttgttttctcattgtagtgtgttcttaagtctccctgaaaaacacagttggcatttacagaggtgtatgtttcctacacgatccccttttcaatgggtacttgctcagtttggctgctgattctcttcataggtcctgcggtctgtgctatctgctcccatgtaaaagttgacatctagattgttcagtgtttgtagctagcgtgggctggcagcaattgtgtaaagcacaatttataccccacattcaatccctgcagtggaacagggccgctccccacgagccccagatggtgtcagcttgtaagtagtcccacctctgctgtgggggtcagaggtggatttctctccattagggatagaaaaaaaccttttgtctgtacccattttagatgtccagctaggtccctgtaaattagactaacaagatatagattaacacgagaaaagcaggctgggtgctgcggctcacacctgtaggcccagcgctttgggaggctgaggtgggtggatcacctgaggtcaggagttcgagaccagcctggccaacatggtgaaaccccatctctaccaaaaatataaaaattcgccaggcatggtgtcacacacctgtaatcccagctactcaggaggctgaggcaggagaattgcatgaaccctggaggtggaggctgcagtgagctgagatcacaccactgcactccagcctgggcgacagagcgagactccgtctcaaaaaaaaaaaaaaaaaaaagaaagaaaaacaggagctttttagcatgtgcatctagcatgggtatcacatctagcatgggaattgtgcatatacctgggagtatccagagatgagtaactcaaagcgttggttagaacttcagcttacatagcatcttaatgaaagagaaagaaatgtttagagaagtggcagggtaaaagaaaggggttttaggcttgcaaaggtggcaaactgttggaagttgtgtttctgttttgcattgctagaaggaatacctgaggctgggtaatttgtaaagaaaagaggtttatttggctcatgttctgcatgctgtacaatcatggcaccagaaacctgcttggcctcaggtgaggctgcaggtaggttttactcatggcggaaggtgaagggggaacaggcgtgtcgcatggcaagaggggagcaagagagagagaaggaggaagcaagagaaggagatgccaggcgcctttaaataaccagctctcccttgaactaccaaagagaggatttactctttaccacgggatggccccaagccattcataaggcatccaccctcatgacccaaacacctcccactagaccccaccttcaacattggaggtcacacttcaacatgagatttggtaaatatatgggaactctaatggagtaaggtttgtttgtgcgggcctacttggtgccagctttccatcttcgtggctgtaaaacttccctgagagaggagatttatggtagttcttgtttctcagaagtttctgttttttgtcataagagcaaagagcgtaagagtcaaaagagtttctgtttttagtcatgagagaagctcttagaaggctcctttctgcgtctgttggttttcatttgcctgcagctcaaaacaatcatatgccaaagtggcatattttggagtggcatatttttatcccttatgtcaggtacaatgggcagggaaggttcagccagcaagagggcaggattcctgttccttgagcacggtgcatggccttaacaaacctgaaaaatcatgtgctcccactcccatttcacattgtttcacaatttaccagtggttactggacaaactcaacttattttttctgcacaaaacttcaatgccataaataagagctcacaactttcctctggtcacaagtcagttagcagccacctcgctctttgaccctgggctgatttagagctcacactggggagcagccccagaggtggctttaaacctgggactcggggtgtctgccctggggtggctgccctggggtggctgccctggggccattggtatttgctccacatgcctgtggagtccattttttcatgttcatgtcacacctactgtgttgcatgttctttactagggggtggggtagaaatatgaatggacatagcccctccttgagatcacagcctggtaaacagatcagccattaacaattgaggcggcagggttccgtgcagaaggctgcatgactttgctgtctattgtgactgcgttttgatagttacctttgtcacactgtcttctgtattatgtttgccctcagcaacatgtcgtatctggcacagggctgacatcctgtttgtgctcagtcatttgtggaaggaagaagtcaggcaggcacaaaggtggctgagctcagaaaaggccacttaccctgctgggatcagctggggaaggtggcttccaagaggccatcacacttagtgtgatgtataaggaaatagaaaggccacagacaggagggactgcacgtgcaaggaaggggcactagtgagtttgcagcatctcaggaactgcaatagaaggttgatgtgagggcaggcactagaagggtgagttggggtcagatgtggcaggcttggaaggagtcaggactctatgctacaatttccagaacactcagtgttctcagctttctcctttgtcatgccttcataccacctaatcttctcaccagtgactatcctctggaagacaatgggaatgggaccctgtggagggctctgttgaaaacccattgatggggccgggcgtggtggctcacgcctgtaatcccagcactttgggaggctgaggtgggcagatcacgaggtcaggagattgagaccatcctggctaacatggtgaaaccccgtctctactaaaaatacaaaaaaattagccgggcgtggtggcgggtgcctgtagtcccagctacttaggaggctgaggcgggagaatggcgtgaacccaggaggcggagcttgcagtgagccaagattgcgccgatgcactccagcctgggtgacagagcgagactgtgtctcaaaaaaaaaaaaaaaaaggaaaacccattgatgggcattgaggagtggtgggatgatcagagcctctctctgcactctggtactttgacaagagtgggcaagtttgggaacagggatatcagtatttctttggctgcatacttatttatatttcaccccattccacggagaatttgaggggatttatcaccagatgtgggatacttatccaatagaaactgaagcaaagaatctggacaagggaaagggagcctcatgagtacactaggtcttaggtccaggtgggggtgaggcctgcaagaatgcagagatggaggggtgtggagacggctgtggtcccacactgccagcacttgcctgaccagacattctcaggagtgcttccacccaagcatggtgtgggtctagggctgcaggtggagctaagtcctgtctgcgtctgggtgtcagatcctaaaatttgctggatggagttggggaattaatccagctgaaagagcttgaattatcattgaatggaggaaacaaaaggcctattaatcaagtttaagaggtgtgattgaaggattggcacctatccctgcttggtgctctcttggtgccctctgtgaagttagcagtaaattgcattttattggggattgatattattgggattgcttcctggcctgcaaggagcattacatgggcagaagaaaggctgctgccaggagttgggcaacatgatgaaagatgtggacaataaatgacccatttcctagtttttctatgaacttatcttgaaggtagatttatagaataatatgtggataaaaggggttttcctcctggtctcctttgatgttttggagaaagaagcaaggactttatttatttatttgtttatttttgagacagtgtcttgatctgacacccaggctggagtgcagtggcacagtcatggcttgcggcagcctcaacctcccaggttcaagtgatcctcctaccttagccttcctagtttgtagagacgagttttcaccatgttgcccaggttggtctcgaactcctgggctccacccacctcggcttctcaaagtgctgtgattacaggcttgagccaccacgcccagccagaagcagggaatttaaagcagcgcaagccaagatcaggattagggctggtgctccggtctcacttctcctgaaggccaatcgcctctactttctgcagctatgggagtgggctttgctattcagggatggaggcctgggacattttagaacaatttgggttttttagttttgtttttttgagacagggacttgctctgtcacccaggctggagtgcagtgtgcgattatagcttactgaagccttgacctcccaggcccaagttatcctcccacctcagacccccaagtataatagctgggactacagacatgcaccaccatgcccagctaattttttttttttttttttttttttttttgtagagatgggctttcattatgttccctaggctggtctcaaactactgagctcaggcaatccacctgcctgggcctcccgaagtgctgggattacaggcgtgaaccactgtgcccagcctttagaacaatttttaacaagacttgaaattaacaagcttttggcatagtggtgcacgcctgtagtcccagctactagggagactgaggtgggaggatcacttgagcctcagaggttgaggctgcagtaagccataatcatgccattgcactccagcctgggcaacagagcgaggccttgtctctaaaaaaaaaaaaaaaaaaagaaattaacaagcttttctcattgattgctaactgataaaattaaaaactattaatagaaccaccgccagccagccagacagccattgagcaatcacttattgagcatttatttcatgactggtgttatgatagctattgccagatgaaaaagaatgcctgccttcgaagcttgaatttgtggagagtttcagcctatggataagttgcatgtgtgtgcagacttgtactctatggcaagaacccagaggtcccagaagatacgttcagatcaagtgctgtggcagttttcagaagggaaaacttgtatttatgtgggagggtcagggaaaccctgatattttagcatttgggctacaccttgaagggtttatttgtctctataagttgcatctaaaacaaactgtataaattagtgagtttttttagttagtagcttaagcaaaagctggattgatggctgatgtaagtgcataggggtcaagctggcctctgacctgaccaattagatattcagattgtgtcaccaggaggtactttctctgtatttcttgtgacctggctttcttccaagactggtccattcacagaagggtttactcctcatgggtgccagatgattgcaacagctccagaggttacaccctcagccccaaattcaaggggaaaagagtgtgaatctctcccagcattccaagctaaatctcagtgtgtctttgattgggtcaggttcctctccctgcaagggtggctcaggctaggggggttctcagattagcgtaagcctgagtcatatgctcccccaaagctcatggactgagaacaggaatgtgtggctacctaaaggcaaagtccagtttcatattggtacaagaagaaagaagaatgtgcctttaatacatcttagaaaaaatgtccaatagccaccgtaaatgaaagcaaagaagaaaaaaacactccaggtatatggaaggcagtggaacagaaactgaagtgcaggggacaggtttgaagccagcctcaagtgaaacaccctgaccccttggtgcctgggtaaactcttttcaatagaaagccatccttttccaaccaggttagggaatgggctgttcaggctgcatgcaacctttcctgttgacaaagtggagaactatcctgccatttgagatgtttttcctgtgctattctcctaactcccacaccctcctgtaagattatcaggaagagagaactgttccctttgtacaaacaaggcgagaggccagagagttaacaggagcttcccaaaagggagagcttgccagagccggggccagaacaggatgcagggtttcctgattgcagaatgggtgcccctttcctactcctgctggactctacattcaggcagcccacagctaatgactgcactgagttgcaaaaagaattctaaaagttgtttcttaagaatttagagtgtatcttaagtaagcatgcaatttaagcaatgttgaacttaattttcccttttacagaagataaagaaactaaagtgaaattagacttgctgaacttcaaagaaataattcttcatcttaaaatattttcctaaaaggtccctctaagattaagagaaaaaaaccccaagacattaagaggttggagccattttgttttttgaaacagagtctcgctctgttgcccaggctggagtgcagtggcgcaatcttggctcactgcaacctccgcctcccgggttcaagcaattctcctgcctcagcatcccgagtagctgggattacaagtgcctgccaccactcctggctaatttttgtgtttttagtagagacagggtttcaccatcttggccaggctggtcttgaactcctgacctcgtgatccacccaccttggcctcccaaagtgctgggattacaggcgtgagccaccgtgcctggccatttttttgtatttttagtagagatggggtttcgccatgttggccaggctggtctcgaactcctgatttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaaaaagcaattttttttttccaagaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaattattctggaacctagcatgctccttcaatctaaaaattatctttatttcaattgcttaaattacttctcctccatcttccttttcttccttctcattttcttctttttcttgctctattactaataatatcacaatttgtaatttattaactttaggtgtgttcagtttagtaatataacagtactactaccatttagggtgggggaacttatttacttaatgacttaatgaatgagtaacaaagattagaaccaccatatacattcacttgatacatatttttataaaagtgcttgagaatatcagaattatttatgtcacacaaggagttactgcctgttttctgtgtcaccagattctattaacatttaatgattacctttactctttgaattttgaattttgtaacaaattcctgctgtggcatattttgcaatttggttatgttctgccaaagctgtaacagtaggtgaggtgtttcaaatttggcatgactgaatagaagagctgcccgttctcaccatatgttactcaactcatatattgctatgttatttttaccttactcatcaaattatcttttctcttatacatggctttaattaattgattattttaggtatttccatctctggacatttcatgtactgaaaatagatcagatttaaataaaatagctttataatcagtatttatgtgataaactctgtcttatttcttgcaacatttaccggcatgtaaatccaaattgaatattggttaatgttcagcaatattcaatactatataattgtagtgtattgttatgaaagtcaatgaatttccccccatgatgtactttgttccaaaatttgaatctcctttaataacatataacacataagttgcttaaaaaatttctcactgctgacactatttggattgtacttatgacaggcatactggccatcacctcagcatatgaggataaccatattttagaaataccatgctggtggcactggggagagctgattggagctggagagaccagaggcagggaggcctcttaggacatcgtgctcaaggagataagcaataattgaggcaagaacagaggcagtagcagtgggaactgctgggacaggtttaggagccagcattctgccttaatcatctttacacccttgccgcatgcctagacctagttggtacttagtaattttgggggggtttttttgagatagagtctcgctctgcctcccaggcagtagcgcagtggcgtgatctcagctcactgcaacctctgcctcctgggttcaagtgattctcttaccctcagcctcccaagtagctgggattacaggtgcccgccaccacactcagctaatttttgtatttttattagagacgggaggccgaggcgggtggatcacaaggtcaggagttcgagacgagcctgaccaatatggtgaaaacctgtctctactaaaaatacaaaaattagctgggcgtggtggcgggtgcctatagtcccagctactcagtaggctgaggcaggagaatcacttgaacctggaaggcagaggttgcagtgagccgagatcatgccactgcactctagcctgggtggcagagcgagactctttctcaaaaaaaagaaaaaaaagaaatcattgaagccatagaggacagggaggcatccaggagtggccattgaatggtggtgccattccccaccataaagatggcaggagaaacagggaacccacgtggcagtgtacccactgcctgttgaatgagtgacatgatccaggggaacactgcccactatggatacaccagccatatgccttgggagcaggtacctgtgtagaaaagagtggagaagaaaaagcacaaactttctcctccccattcctgggtgtggcaccagcatcagacaggagttcaaacagtgcttcctttcaccgctttccttgctgcttttctattctggtatcttcttctccaagacctcaggctttcccctctccaacactaccttctcagccaataaatcactggaggggaggtccataggaataatgcattcactctcttcaaatatcccaggctctagaattacccatctcctctcctggtttcagaaatcttgttttttcaatggtgagatagcaggaaactgatctggtaaaatgcattcatactactgtataaatgattgatggatccttttaactgtagttacttgaatttccaaaagagctctcttttaccactctaccaaagtgaaagtgccaagttgctgcatggaaatgggacaggtagaggagagtttttggtcaccattcaggcaagccaggtggtaccagctctccttcactggtcctatttcataacatttttgcttcttgcattttagagctaccagtttcctagaacagcagaagtagcatgctcccctggcccaaccaacaggtgcggctatagtggcctatctgtactggggaggggacaccccaaatctgacattgacaggttcacccaacagcagggatgtcctgtgccatgtgtaataccccctcttctttcatagctccagaatgtccaatgactacatagcactgtgctgagtccttcacatacaccagcctgtctttgtgcttgtaacagtctataagggaagcattattactcccattctacaggtggggaaattaagactcagagagaaaaggtaatttgctcaaggccttgtagctagaaatttggaagagctaacacataccactcttggcatagcagtttagacatggacagctttaggatggggagactgagaacccaggaaacacgttgaggcttctattaaaatacactactcggccaggcgagatggctcatgcctgtaatcccagcaatttgggaggccgaggtgggcagatcacgaggtcaagagattgagaccatcctggccaacatggtgaaaccctgtgtctactaaaaatacaaaaattagctgagtgtggtggtgcacgcctatagtcccagctactcaggaggctgaggcaggagaatcacttgaacccaggaggcagaggttgcaatgagccgagattgccccactttactccagcctggtaacagagcgagactccatctcaaaataaataaataaataaaaataaataaataaaataaaatacactactcaggaggctgaggtgagaagatcacatgagcccaagaattcaagtccagcctgggcaacatagcaagaccctgtctctgaaaaaaaaattaacagtgtggctatttcactgaataatcataaagggataaatgaaacaatacatcccagagacgagaaagagctttgttgtaatacctagatgggatgttctttgagtgttccccattgcttcctatttaaagtccaaactcctttacttagaattgattatagaaagtttaggaaaatctaaataggtgaaaaggagggatgagagaaagaggaaactactatcactctagaccttttcctttcctttttgctatctctgtgatcatctaaaacaaaatgaacaacatttagtgttgtataacttgcttttcttataaatagtcatgaagatctttcaaaaaaatatacagttttgaattttttaggcagtggcatcttttttttttttttttttttttgagatggagtctcgctctgtcgcccaggctggagtgcagtggtgcgatcttggctcactgcaagctccgcctcccgggttcatgccattctcctgcctcagcctcctgagtagctgggactacaggcacatgccaccatgcccggccaattttttgtattttttagtagagatggggtttcaccatgttagccaggatggtctcgatctcctgacctcgtgatccacccacctcggcctcccaaagtgctgggattacaggcatgagccgccgcgcccggccgggcagtggcatctattgattgtatggtttcttttatttcttcagtaattatagtgtctttactatggtgagagtaaatagtccactgtgttttctccttcgagatgtaattttacacatttaactttgtgattcattggaagcatatatgggtatgaaacaagaagcaaggctctaacttcattcctgccccctaccctcctccctagccaatttctctgattccaattgttgaaaacccctttaatgtccatcagtttgggctgctggctgggcgcagtggctcacgcctgtgatcccagcactttgggaggcaggggctggcggatcacctgaggtcaggagatcgagaccagcctggccggcatggtgaaaccctgtctctactgaaaatacaaaagaattagccaggtgtggtggcgtacacctgtagttccggctgcttgggaggctgaggcaggagaatcgcttgaacccaggaggtggaggttgcaatgagttgagatcacgccactgcactccagcttgggtgacacagtgagactctctcaaaaagaaaaaagagaaaaagatgggttgctttctttgttatataaaatattacatttctatagatgccagggactacatcaggcctatctggtctgttctactgatccttctcttgactcttgaactagtaccatattctcttaataatggcatttctataatgtgttatcccttccttacactgattcctcaaacatttcttagcagctggtcatagtggcttaggcctgaaatcgcagcacttttggggccaaggtggaaggatgacttgagcccaggagtttgagaccagcctgggcaaaatgttgagactctgtctctataaaattaaaaatttttttcttagctattttatctgtttgttccttcatatgaaatttagaaacctagccaggcgtggtggctcacgcctgtaatcccagcacttctgggaggctgaggcgggtggatcacctgagatcaggagttcgagaccagcctggccaacatggtgaaaccccagctctactaaaaatacaaaaaaaattagccaggcatggtggctcacacctgtagtcccagctacttgggaggctgaggcacaagaatcacttgaaccagggaggcagagattgcagtgagccaagattgtgccactgcactccagcctgggcaacagagtgagactcagtctcaaaaaaaaaaaaaaagaaaagaaaaagaaagaaaagaaatttagaatactttggttaagtttcaaaaataatttaaattgccttaaacctgtttattaactcaaggagaattaataatcttataatatttagtcttatctcttagtaggtttttgtcattttctaggtattttgtaccttcttttttttaatttaaaaaaagttttttagagatggagttcttgctgagttgcccaggctggcctggaactcctgggtgtaggcaatcctctcaccacagcctccctagtagctgggactataggcacacaatcatggctttgtagaattttttaaatagctgctgtgaatgggaagatggatttttttcccatatttcttctcatttgctttgctaagatagaattatgctatttttctttcttaattattatgtaatctagccactttggtgagcaatttcttattaagttagtggtgtttttgcttattgttttgagtattccagaagcaaatagatgttatttcgcctttctgaagatacggttaagtctgggttcttgtcacggagcccttctgggcagtttcccacttcacctctgcctcctccaaagtgccaagcacgcagcaggtactcagtgagtgtcctctgaatgaaggtaaaggaaccgcttggctaaggtcattcctggccctgggtggcagccctttgattcaggatctgcacctcagtcttaccagagggctgggggcttttagacccaggtgtctgattcaggctagccacctcacagacacttgccgcccatttccatctagagggaaagcaggggccagtcaccctagggagaccccattcaggacaaaagaagcttagaaaaaggacccagcggaggctatggccatccagaacgtcttgctctctatccagccaggctgcctgaggcgtgcccttccaggcttggaaccctgtctccaaggaaggggatccaacatcagacacagcccctctccccaagtgtccaagatccaaagggggaaaataacaactgtttcttattctcttccctttattcctataccctatagaattgcccacatttattagtattctgttttttaatttcaaaaaaaggaatacattcatacattcacaaggctcaaacataatctaaaaaggtatgcagtgaatgtcttactctaccctcattccacccatcccatagccacttttattaatttgcatgtccttttaatatttatttattcaaatacaatcaactatgaagatattcttatttttccccattcttacacaaaaggtagcatctgatacacacatttctgcaccttgatttctaacttaaaatatatatcataataatacaaatagttagcatttattgaacactcattgtatgccagtcatttttcaaacttttatccatatattaactcatttaatccttccagtactcctattattaacctcatttctccatggagaattttccttatcagtatataaagagcttcctcaatggcttacagctacatagtattccgttgtatgggtggatcataatttatgtaactaattgccttgtgagggacacgtgggtggcttctaattctttgctattgtggactgtgctgcagtgaatatattgtatggatatcatcttgttatgtgtagagatagagctgcagagcagatccaaagaaagaggattgctgggttaaatgcatttgtaattctgatgggtattgccaaattgccttctgtagagttattagttcttttcataattgcttagtatttctaattaaacgtagcattgatgagcactatgtatcagtctggctggctagtaggctctctgttggtggttccagaacaagttgatctcagtgtagtcccagatgagaccctttcttctggcctcaggtgggctgacttattccttttttttttttttttttttgagatggagtcttgctctgttggccaggctggagtacagtggtgcaattttggcttactgtaacctccacctcctgggttcaagcagttctcccacctcagcctcccaagtagctgggattacaggcgcacaccaccaagacttattcttatcactgccggtgagagtaaattacagcaatatttctggggaactaacagtattttccctggtaatatttgaagaagcagccttgtaatggttaagaacatggactctaagctggactgcctgggtttttatattttctttcgctgctgtaacaaactaccacaaatttaggggcttaaaacaatgtaaatgtattctgttatggttctggaggtaagaagtctgaaacaggtctcactgaggtatataaaggtgtcagcaggctttgctcctttgggaggctctcagggagaacgttttcttgcctttcccagcttctagaggctgcccacattccttggtgcatggcccctttctgtcttcaaagccggcaacatcacaacattcccacctctgcattcatcacatcacatctcctctcattctcctgcctccctgccctttcctttgaaaggattcacgtgattacgttgaacccacccagataatctagaataatctctttatctcaaagtccttaattgaataacacctgcaaagacccttttgccatagtaaggtgacatattcacaggtctcaggaatttgcacgtggacatctttagaggccactattctgctactacagtttgcatctagactctaccacttactaatcgtgtgatcttgaacaaattattttgcctcttgcaccagttttctcatccttaaaatggggataataatggtatctattccactggattgtcaggaggattgaatgagtaaatatttgccaatgcttataatagtatctgagacacaataaatgctatggaagtatctgctagctaaaatatattaaccaggccaggcacggtggctcacacctgtaatcccagcactttgggaggctggggcgggtggatcacctgaggtcgggagttcaagaccagcctgaccaacatggagaaacctcgtctctactaaaaatacaaaattagccggggtggtggcgcatgcttgtaatcccagctactcgggaggctgaggcaggagaattgcttgaacccgggaggcagaggttgcggtaagctgagatggtgccattgcactccagcctgggcaacaagagcgaaactccatctcaaaaaaaaaataaccaaataaaaatattaaaatacaaacactttgatctagcaggcctatatttataatctatttcataggaacaaaagcttccatgattaggctatataacttggatattactaaagtgttgtccatattggcaccaaaagaaaaaaaaaaggaaaggaaaacgaaagaaagaaaatgcacaaacaggaaattacctgaatgccagcaaaacgacagtgattgaatcaattgtggcccatctgggatataccagagctattaaagagaatacatctgatctgtgcctatgcacctagaggaatgctctgagtgaaagttcgttgagaggaggaagttcaaagtaattatatgacttgatttatttctttcttttttttgagacggagttttgctcttgttgcccaggctggagtgcaatggcaccatctgggctcaccgcagcctccgcctcccgggttcaagcaattctcctgcctcagcctcctgagtagctgggattacaggcatgcggcaacacacccggctaattttgtatttttagtagagacggggtttctccatgttggtcaggcaggtcttgaactcccgacctcaggtgatcctcccgccccggcctcccaaagtgctgggattacaggcgtgagccaccgcgcccggccgatttctttctttctttttttttgaacaaacatcagcccccaaaattattgtagatatctaggtcaatcatttaacatgttctgtttcttcctctgggaaatatgtataacgacaattctcactcaaggggctcttgcaaaggttaagtggcatggctgacatgtgtcaagtctgtaccatcctgcaagcagcagcccagtctggcatttgtgtaaggcggtttcagtggagagatgtgtggaagggtgcaccccacgatgctcacctggtgcttcctcggtggggaagggaaattcagaagtggtggaaagagatgattgtcgtttcgtatatctttgtattgtttcccggatgttgaaattgttactgtagtaactttttatactcatgtgttattggtagtttggatactatcaccataaccacaaacactgaattaggaaaagcagaaacctagaaacatgccatgattcaaagtctggtatttttggaagaggaatttaataacgaacgttttaagaggaaaaagtcaggagagtcctaacccaggccaaccttgtgtgtccacagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaaggtaagcacgcacgccaccttcctgggcggcctgtgcctctgctgcaccctagggaaggcgagtcagaagagatcatctccatttgacagaaaagaaaactgggtgtttattcagtctttgggggttggtaaggtcttaggttccagggcacaggataagggggagatgaggccctgacaaagggctgcagccacccagaggggacacattttactaatttacaagactctgtggattgacctagcgatgactcatggggaacacgtgaaagttgaaaaactgcaaagctgagaatcagacccagtatcattttggcgccagagggaccaagcacttcaggaggttctcttaagccaccggtgtctcggaacagagaagtcaattgggacctggggttacggtagaagggggctaagaaaacctcctggggatggttggatgcttacccaaaaccatacagtggctcagtggaggagatcccttgtctgcaggatgacctgctgtctgccaacctttgcgcgccctgcctagtgttggacgcttgagaggtaaggagacacagactagtttctgatctcaaggagccagagccacttcacgtagctggagaatgagacagtgctcagctctgcaatccaaatccgggagatgtagcagctgtgtattagctggaacaggggggctttcaaaataaggggtagggggagtgtgccagagagtctccaggagtctttgactaaatctccaagctggaatgtgagctctgagcagctagtataggatgcccttactgggaaaggggagggaggctatggaatctgaaggcacctgggtagggtgccagtgacaaagagcttatttacttctcctggagctggacatgggtcatgaaggataatcttagagggcctggacctgtgccttctccacctaggtagtgaatgtcacccatattaaggaaatgaccccacagagtttacacagcttgccttgggtgttataactgggcaatagcagagagaagggttattttattctgaagcataagagatttagatttaataaaaaccaggctgcagataaggaagatcatggagctctcactatatgtagagagtcagtgagccggtagtgatggctttatgattgcgcacacttagccttgctgttggctcagagatggagagaggtacacttggggtttggagccaaaagcaagcactctaatgccacctccttttcccttctggctgggttcctgcccactgcattcgagagagctctccttccagctgcccctccagggagttgtccagtgctttgggatgccctggaaaataggtatcctggaaaagcaacagggacctcctctctatcactgtcccaggtcaggatgtcccttaccagcatgtccttgacctgcctgtgaccttctttgtgttctacagatgcagctgtatccaagaaagccagcccagaggctgccagcactcccagggaccctattgacgttgacctggtgagatgggtttgaggtctgaaggggtggtggtggggcccagcaggtcaggcaggttgtgagtcctgctgtccctgtgtgtgcagggagagcgtctgagtgagggacagcaagtggctggactggaaatttcagtgagaggaagtaaaggaagacattaaagaagggttggctggctagctggctctgactctaggctcctaaatgccaaagttgctcttgatgggccatgagccaggttcagtgggggttagatgtggggtagacagtcggccacagatcagggctgctgcagagggaattccagcattagatggcatattagtgccttccagccatgagaaactatggttgtcagatgtatggttagatatagggtcagcagtcctgagggatgtgcagatgtcctctcccctcctacaccctacccccaatgtgggagccttctcttggagtcagaataggtgggccttcccctgctctttccccacagatggttcttggaaaggaacggggaatggtgccaggagtcagatttcgatcccagttgcccgggttctgctggtgtgattccagggccaccatacatgtaacaaagcagactgtctcagggttcaaggtatccatgtcccatctaatgctggcattccttctgcagcacccctgacctgtggctgtccagctttcatgtacacatctccagggacaggaagcttgctcattctagaggcagctgctcccaactctggactgctctgacttagaaagtgcttttccgagtggaaatgcagtggtgtccctttgacttgccccctttggcattcacaagtatggctcctttccaccagaataagcatcctcggtttcttcctggacttggcatctggtctcttccctagcctagtcactcaggtttgcatgcgcctagcctatcaaggatctggcccaggactggccagtccttcatggacagcaggtcttctggtggtgggtaggggcctagcttttgccatggcatgacccataggagagagagagtgctgtaggttgaggcaatcaggagaggcttcctggaagagacaggacttaagagtctcagagttttagagccaggcaagagcatggagtctaaccccctttttttcacagaggacgaagctaagacccagaaaggatgtgacttacccaaggctacacacagcaaattaggggcaagattaaaagctgactctgttttttgtttgtttgtttgtttgttttttagatgaaggctcgctctgttgttcaggctggagtgtagtggcgtgatctcggctcactgcaccctccgcttccggggttcaagccattctcctgcctcagcctcccgagtagctgggactacaggcgcgcaccactacgcctggctaatttttgtattttttagtagagacggggtttcatcatattggccaggctggtcttgaactcctgacctcatgatctgcccgcctcggcctcccaaagtgctgggattacaggcgtgagccactgtgcccagcctaaaagctgactcttaactgccttgggtactgcattcctatatacacaacctcaagtaaaaagaggaattttttaatatatgtgtgcataatacaatcacatagtcagaaataaaaacatagaaagtgatcaatagtgtcttactcccactttagcccccagttcttatgcccatataactatcttttaaaaatttcttttgagacagtcttgctctgtcacccaggctggagtgcagtgacacaatctcggctcactgcaacttctgccccctgggttcaagcgattctcatgcctcagcctcctgagtagctgggattataggcacgcactaccacacccagctaattttttgcatttttaggagagatggggttttgctatgttagccaggatactctcaaactcctggcctcaagtgatctacccacctcagcctcccaaaagtgctgggattacaggcataagccaccgtgccccacctcttttttaaattcttatatatccttccagaatgtatgtaattacaagcaaatattattatagatatttgccttttgcattctgtgtttcacaaaggtaggataataccagatacacatggtatcataccagaattcttatcctatcaataggtagagagcttcccgatacctttttgcagctgcataatggaccattaaatggatatggcaggctttatttagccagttccttgttgctgcatatttaggttgttttgctattacaaacaatgctacaatgcatgatgtttgcaaataaataatataaaataataaggccaggtgtggtggctcacacctgcaaacccaggaccttgggacactgacgtgggcagattgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccagatgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcaatccttgcctggggatggcagtgctgctgagggaaggaagtggggaacactgtgagtgcaaggacaggtgaggcaggcacagacggctgtcccaagggaaagtgctccatcagctgtgccaggagagaagcagctcttgggtccgtgtttctgccttagaaggcaggagttgggcatctagctccagcactcatccctcttgaaactgctggtttgtttactttcattgcaactatatgcctggaagagatgaagagaaagctcaacaggcttcactaggattgtttgggtggggtggcagcagctcagatattttccctcctctgtttttcataggctttttgtaatcgtgttataatactttaatggaaaaaaataaatttattattttaaagctataaaaattataaatcagtcattatgatgtgtttttctctactgagccctctggtgtgttccctgttttattaacgtggatggagggtgtgtcagggaggttgggacagaggcagagaagaggccagcccggccttcggggagttcgtggcctgtctggaaagagggtcttttacataccagcagtttgcagagccagacacagaacgatagagcaggaccttttaaactcctttttcaaaaaaaaaaaaaaaatgtttaattttggtaaaatacacataatataaaatacatcatcttaaccatttcaaaatgttcagttcagtgtacactaagtgtacagttctttagcattgagtacattcacactgctgtgcagccattaccaccacccgttccagaaggattttcatcttcccaagctggaactctgttcctgttaaacagtcactccccatgctgcctccctcagccctggtgacccttgtctactttctgtctctatgattttcaatactctaggtacctcctataagtggaatcacacagtatttgtccttttgtgactggccactttcacttagtgcagtgttctcagggttcatccatgtagcatgtgtcagaatttcctttctttttaaagctgaataataatatcccattatgtgtatatgccacattttgttgatccattcgtctgttggacacttggcttgtttccattttttggctattgtgaatctgctactatgaacacgggtgtacagatatctccttgagaccttgctttcaattattttgcatgtttactcagaagtgggatcgctggatcatatggtaattctatttttaattttttttttgaggaatcaccatgctgttttccattttttattgcaccatttgacatttccaccagcaccgtgtaaaagtttcgacttctctacagcctcaccaacatttgttatattgtctctctctctttttttcttaaataatagtcattctaatgtgtgtgaggtgggttaaactcttttttgaccactatcctctattgaaaaaaaatatatattatatcttaacttatagtatatacatatgcacacacatactgtagctaaaggagttttataaaataggctgggtccagtggctcacgcctgtaatcctagcactttgggaggcggaggcaagtggatcacctgaggtcaggagttcaagaccagcctgaccaacatgatgaaacctcgtctcttctaaaaatacaaacattagccgggcgtgatggcaggcacctgtaatcccagctactcaggaggctgaggcaggagaatcacttgaacctgggaggcagaggttgcagtgagccaagattatgccactatactccagccggagcaacaagagcaagactctgcctcaaaaaaaaagaaagaaagaaaaaagttttacagaataaattatgattgttacatgggatgtactctgataatttctattctatactattatttttgacataaaaatgttggtcatgccccactaaattgctttcatggttggatccactaatgggtcacaagctgcagtttgaaaaccactggccttaagagtgactagactttcctagaggcctggcagagacagatcctgggagataatctgttctctctccttcccaagacaggctcacactctctaatccagagaggtcatcctccttctttttaaagatttggagaaaaagaaaggaaggaaggaagggaggagggaaggaggtcaatccatcatggccaatggtgtggagcccatgagaaggacccaccgcggggttctggtacctggcacacccaggagccagcactgtgctggggccatccctgccttaactcacatgcccagcagcctctgtcgggagcctccttgcccagccccagcttgcctgggtggttctcagaaggcccacacaggagggacagagcttgtccctgtgaggaaggtgtatccctgccactcactcattttcaataatcggtccagtggacgcttaaagttcacaaaagagagaaagatggtggggagggacataaaagactcatcaagtaaagaaaatgaagagcacgccggggcaggaagaggcctccatttcaagacactggatttggccaggtgtggtggctcatgcctgtaatcccagcactttgggaggccgaggcgggtggatcacctgaggtcaggagtttgagaccagcctggccaacatggtgaaaccccatctctactaaaaatacaaaaattagctgggcgtggggctgtgcgcctgtaatcctagctacttaggaggctaaggcaggagaatcgcttgaacccagaaagccgaggttgcagtgagccgagatagtgccactgcactccatctcctgggcaacagagcaagactctgtctcaaaacaaacaaacaaacaaacgaacaaaaaacactagattcaagtcaggccaggggtcccgaggtatgtgaccttgggaaatcacttcacctctctctgcctccgtttccttctctgaagattggcaataatcatagtacggtacctactttttttttaactataatttttatggcgataaaattcatataaaattcaccattttaactcttgaagtgtgcaatttagtggtatttattacattcataatattttttaaattttttaattttttttctttgcagctccagctcaaatgattaaatttttttctttttaattttcagagatgaggtcttgctatgttgcctaggtgggaggctcaggtgattctcccacctcagcctcctgtactttcataatcttgcacagccattgccacctatctagccccagaatatttttatgcccccaaaaggaaaccccttacccatgaagcagtcagtcccatttccccctcccccatctcctggcaaccaccaatctgctttctgtgtctatggatttatccattctgggcattgcatgtaaataggatcatacaatgtgtattttgtgtctggtttctttttttaaaaaaatttattattattattagtgtttgagacagagtctcactctgtgccccaggctggagtgcagtgacacaatctcggctcactgcaatgtctgcctcagggctcaagcgattctcatgcctcagcctcccaagtagctgggactacaggtgtgcaccaccacgtctggctggtgtctttcatttaatgtaatacattcaaggctcatccatgttgtacatctcagtcctcattgctttttatggctgaataatattccatcacgtggctataccacattttgtttattcagtcatcagttgatgcacatttagtttgttttaccttttggctattgtgagtagtgctgctctgaacattcacgtgcaagcttttgtttaaccgtctgttttcccttcttttgggtgcacacctggggtagaattgctaggtcatatggtaattctacatttaattttttaagaaactgcctctatttcattttgagataggtacatgaagcacttagcactgtgcctggcacagagtagtaataagaacaatatttatcatcatcaatgacattttctaagtgccaggtattttatattttacttgtattaacacatttcatccacattaccatatgaggtagatgttattattcccactttatagagggggactgaggcctgaggagttttaagcaattcatccaacttgtgtagtagctgacccaggtagagttaaggctgagagggcagaggcaaggtcccagggaggccagtttcagctcaatgggaggattttctcactgttaaaggagctgctttcgccagtagtgagcactttgtccctggaggtgtgtgtctaagtagggctaattactgagcatgtcctgagttgggcagtgtgattcctggggtatcttccagccctgttaggacacacaacaaccaaagtggtccctgggctccagtaactcagagtcagaaggaggtgatgccagtcgcggtggctcgtgcctgtaatcccagcactctgggagactgaaacaggagaattgctcaagcccaggagttcaagaccagcgtgggcaacatagtgagaccctgtctctacaaaaaaatttttttaaaaaaaggaggtgatgtgatggagagtttggaggacttcttgtccccagtgagctcggagctttgagtcagggagcctggacctgtgacttggtgaggccccagggattaggccaaccacaggtctggggtacctggccctggggctgctgcctagtcatttctgactcaattttcccaactttgcagcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggtaaggttctccccagccccagccttccctcctgaaggcctgagttccaccaggaaagtgagctggcactggggtgggaatccaggccttcatcagatcagctctttgtgggaaagtgtttgctcaacgccttctctgtgctctcccctgttcttggctgcatggtcagggagcttcccataagcatggcccactcccagcccagcaggggtgctgagacactcagggttgtcagaggccagcagagactggtggacagcagatagtaccagcttgggaaggcttcctgtctgaagagagacgtaatctgcgtggttgagagcagaggagaggggacagcaggagcaaaagggtggccacaagtccctggcagtcagggcaggctctgcccactcacccctgcaggcacctgacctggctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccacaagaagtttgttggctgatgcctagcatactcccagagagggcttgggcataccataacaggaaactggactccccatgaccttaactctgctctctcagtctacacccatcatttccccaagtgtttctgcaaaggccacctacctaagtatctcatttgtcagagttatcttctatgaacactgccaggcaggtagtcagttgggcaggagttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaattctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccgtttcccccagccgactggcctgcaaggattcccataggtgcacacccacacccctcccagcatgcatcctaggcagttcataatgcatctccccttccccgtttcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgtcggtccctcagccggtcctctcagactctgaccgcagcctcctgttccttgagctctcagtcctaccttcgcctccctccagccccgcgcactccccatttcatcccatctttcatcagaattgcagctccctgcccagcagaaaatcctggaaggactcaggagcttgtcgcctctgtgctgccacctggagaccgagatctgcaggagaaaggcctgggaaaactatgagtggttgcctgtgactgctaagggctccttggtgctccgcccagcatgtccttttgctctgcagggcagcccccgcctgcctttcttcactgggcccttgtcccagcctcaccctcagctgatggcggcaccttctgctccagggagaaaacaggagctctccaatggcatagggacagttgacatcttgctatttacagatccccatcgcaccccttccctgccctcgttagggtggaagggatgtccacctgcctccaggactcaccctgtgtcctggccccagcccttgaccccctgggagcctcactcctcctcctcatctctcttgcatcttctaatgtatccactgccttctgaactaaacaccctgaatgaggtctttctcatctcagaaaactccacccacttctctctccagctgtcggctccccttcctctgctctccttgtttacacttcagccccctccttgccccttcttcaccccacctcctgcgcttccccgccagtaccagggtggcctctgtgcctctaggtgcagtgtcgcgtttagtcgttattattcttgaccggcgctgggcccggtctttcctggaaagatcgcctgctcggatgcagctctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccataggtacctcaaactcagcaccttctcctcccgtctcactggctcgccccactctctgcccggttgcacaagccaagaccccatagccacccagggcaccccccttttgattattcctcacatccaaccagttattgagtcttgtctttctagggtgtaaattcctctgaaatctgggcacttctttccatcccataatcttggtaaaattaaagctaccactgaccctgggtagaggcagaagcctgggaaggaaaggtggagaacaggtttggagtgccaacagtgtccccagatgtcatggagaatcaagtagagggaccccagcaatattgggggtggggcggggagtatgtaatgctcagctatcagcaaggagtcattaggggctatacagtgaattaagggagggggtaaaagcacatttcaggtgatgatgaattaaatacctaggagctcacattagagagcaggcctagagacgtggggagagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagctttgcagtgaggaaagttgcagaatactggtctgctacattactactttccaagtgtatcagggcatttaggaacccctcccttgagcttcacctgtgtcctagggattcagtgagagactgtttgtgcaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttttcacccactcttgtgacagattactggctccggtgccttggtggcagcagcaacaggagggggccaaggtgagggggcagcctgtggcagaagtggcagtggtgacggcggaggaagggaggcctgtggggaatggctgatccaggggaggggccgtggcactggtgagtgtgcatctgagaaaatgaaacggaggtgctggccaagaggctggagctaggcagaagggcagcagaggccacaggctggccgagtttatggtccagttcactcataacatgtgcagtattcctggggtctttgaggctttgcaagagctggggttttgtgtctgcagaaagatagcaatgcatgtgtcttgccaaactgatcccagctgtagctgatgcttaagtgctcagaaagttcttcaggagcttgagggctcttgataagcatgaatgtcagatgttctgtatcttccagaggctggatgctgactatcagagtttggcttgtgtttggctgatgagcaaacctggaatgaatcagtgataaggacaattgttctcaagctggctgtacactggggagttttcccaactacagattcctaggtcctacgccctgagattctaatcgaatcagtcttgggtgcagcctgggcctcagttttttcttaaagctatgaatgcctaaccaaagtcaagaaccactgaatcgggggattcattgcatgtctgtggtagaggaatgctgctcatttgtttatagatgtggcagtcttgaatgcaggtgacattttcataccagggtgtaataccgcagaggaggggagaggctggatcttccctgatgtacctcctggacttttggagtgtgattacaatgccaatccagccacttcctctgagcatgcttgggacgactgttagacctgctgtgttgagttagaatgcacttgacctgctcaggccgtgaaatctatgaggaaggggagtgagatggatgtagctcatgagccagattgcaggtgtatccaagttgcatgtatatcctgaaaaaatcctggctctcacgaggctcagcctgaacacagttttgcattcaaagaaacaatgtccattaaccaagtataataaagaaataaatcccagtatttacttgcatcttttgaaagaacattaaagggaatccagctcataaccccagcagcacttcttcagtccttcttccccttttctttggcgcctggcatctctcactgcatagcaaagctttcccccttgattcccggtcctcacacgcaggctcaaggctctgtttcccatcttctttcttctgtcccccttccttttctcttccaagcaaatctaagtcttttccagtgactgtccctctctatgctcccccgacacccagttatcctaatttgcggaataaggccaaggtgtggggcctgggggcagaatgggagagtctcccctagtgagcagggaggggagtatgttctgcaccaggccactatgtctgatggccctgctggcaaacctgagtctttcagaaagtcttgtttaaatgcgtcagcactccccagctgtgatgctggagtttaaggcggagcaggggagaattctgggtttacagctggctggagttccagtgagaccagctccatgggtggccatactttatggaagtccccaagggcaagaggaattttggaggaagtgagtcagggctgaaaggtccagcctctcctccattaacaagcttggtggaaagggggtgtccttttattaaaggagacagtagaggtttcttagagaaggcagctcgagtaagtttaggacaaaggacatttccctggccccgggacaatggaaggctctaaaaacgaggttctagtggctgccataaatgaccctgctgtaacgatgggaggggtggcctaaagagacagtactgtggctctccagggagctctcctcttggaagagcagatctgaaggcgggaagactggttctaaggccgaggacattgccccgagctttgtggaggcactcaggaacacaaaggggcatttccagttgggtttggagcaggaagaagaacgaaaaagagaaagtcctgtgtgccatgtcagtgggtggcagcatggactcagcctcagctattggcaccaaggatctgaaccagggaggacccagaaggggagcccagcccctccaccagcttgtgggagagcgctgctgcccagtgaagcctggagagaggaaacaactggattctcccaaagcgggagaaggtggagtctccagccacccagctacaagctaggaagacgccttgtagaaggctccttacagggaggaaaccgagttggaaaggcgagacagcagtgtgggctcacccggagcaagacgtgtgaaatcagcttttgacagcgtggctgaatgaggatctggagatgcgaggcgctgggcagactctctgactagatccctggatatgaagaggcaaagccagctctagatggattcatagtgagtgtctgcttctgacaataactggcagaaagctgatgagcctggagcagggctgtgaaatgcaaatccagtgaaatccagccactcctacaaaaacccaccacatcttaggttacttgtgggtggaaacgctttttctctcagttgaagcttggttggaagcagatgtttcacttgggcattggaagggtctggggaaatgtgctgcctcctaggccagggacattagccagaggccagaattaactgaggctttagcaccaggtgacaccaacttcattgagaagccagcggcagtccataaagaggaaaaacccaaggcctgccctggactctgtcccagccatgctcccaattggccctgtgatcctgtccatgtctcttccttgctggtctctggctaacgtccacaggtggcattcatgggaggttccaagttggtcatcaaagactaaacatctgggcttggcagctgagcagatgataagcaattaactctgtattaccatcagaggctccacctccctctgtagtcccagtcccttgggaaaatctcagagctggagcccttccctcatcctctggctccccaccccatggcttctcgaacagtgttcccaccaggaccttgggacaggagagaacgcctcacctgaaggactcccaaaactcaggtttctctaagctgctggggcagatgccaagagcctccactgctctctcactgccaaggacctgggtgtccacctagatgtggccttcaggaggccaagcagtccttcccctcgcctttgtgtaggacactggcacctcggctgacttcggggacaagaaaaggcaggctcccgaccccttccaaagaatcatctggggttcaagatgaggcttctttctcccgtcccaagttttggtgtttcttctgagtctgctcagaaagatgaaattaggagcagacatctcaggtcctgcctgccatagcagatggctccttccctgagcctccataagcagcacagcacactcatgcacacacccactggcattttctctcacactttcatacacttgtgtcaacgcaggttcacagctcacacttaactgtgcatgcacacacagatttagcacttggattcattcccacacatgcacgttcacaacctgtgtgtgtcacccttcctcccctactcatgagggtgtatgccctggttcatacatgtaaccctcacatgtgacacacccagttcacacccattcatgcacacataccttctcttgtgcacacgtcccctttcccagtggtacaccctccttcatgtgcacgcagatgctcccagctataccagcttgctagtgttctgcacaggtgcttgccttggccctctgaatccctgacgcttggtttttctgtgttgcagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctccacaagtgcacctctgaccagttcttctctcagacagagagcctggggaacacactcctagacagaaacacaatgcgtgagctcattgccgtgagccctgtcatccaagtaaggcctctggctgtgctacacgtttctgagtagagggccaatcccacaggtggctgcacagggctgcccacagatccaaggtcacagagggatcagaccccttatcctggaagcccctctacttcctccagtgcttgccctggctctgcaaatgcccctccttgagccagagccccaggccctaccctgtggcatggactcaacattggggctagcccagccagacagaaacagcaagtgttttcatggtacagaaaagtcatttgcagacctcagtgggaggctcttggccttgctctgagtggagtgctttctatgtcccagggctctgactgggctggggtccttgaggggattggaggaaggagcatgggatggagagctaagttcaagcagcctgggatctctagtataggtggctgaggctgatagaagacaggagggacctgtatccatggggtttggccaactctggggccggtagtggaggaggggagagctggatccccagctggtgaacaaagtgtttggagggcagccgagcctccccttctgactgctatcccaccacaaccaggatcagagctgcatttgggggctgatgtgtggctactgccagcagaccccaaggtgaggtctctagatggtgagtcagcagccctagaggaccccctgctcccaccccagagctctctgtgaccctgggtcctcaccctgcccttctctcctgcccagcccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaacaggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaagcctgatgctccaatcacagactctgctcagcatccccagaggaaccactgagaagccttttgcctggataggagggggctctcccaggcataggcttgtggccacttgcccagcacaactgtgttttgtggggcgtcttttaggacttagcagagctgagagccctttgttgctcaatgctgtgagccttaagcatgtgaatccccccacatgacaagtggggagacccagggtaggctttcctttggatcatctccaaatgggagtgccatgtggcaggaaagaagcaccgatttcaagaattacttcctagagaaagtcaggaactagagaccagagtctgcaggaactttgccactgcccttcactggctaatcctgtacttctctctgtgttccttgagtgacaggtggtaaaacccttaaaaagggaggtgtgggaggcccaggactttggtaacaggtgatgaatgtgttgtcttggccatcacaggtggagcttcagttagtacccgagggattcccctggcacaagcattataggaattagtccaccactggcgtgggtgagcagccaggtaatgggaattgatcagtgccaccacccttgaccccaactaccatcccagatgcccagattccagtcctggagttttattctctcagcttgatcctttgaccaagaagatccagtcccaatatgtcacctgtgcttcatctttggactatatctcaggtgtttacgtgtcaactaatgggagcttactgggttagaagtcaggacactgagtttcaatcctcacttagtagtctgtggccctctttggcacattaacctccctccttgatcctcaggctgcacctctggcaaatgggagaatgcggctccttttgacttcaagggatctttgtgggaaccaatgagaaaatgtgtgtgaagatagctttttggtatattttaaaagtgcacaaatttaagatcttactgctttataaagtgctttatgaattataggaaaataaacacattttagatcttagaaaaaaacaaaaaaacatgggcttgtcttcagggtagtaaagaacaagatctgggatgaacaaacaattgtgggggtcctggggtctgaaggagccaagatcaaggggtcaaccatggaggggctggacaggaggtggcactgtgctcccagcacacccagatgggacatttcactcactggggcccggagtagacaacaagctttctatgtggcagctcagcgaagccctgctccagggtctccttctgaggcctgaagtcatttaaaaatctgctttgcccctaaccccaacctggctcttagctccagcagctgtcacagagcctggtcaggctgttttcccaccctctacttccccttgtcctggcccatgtccacccttctccctgcccatgtccaccattctccctatcccagcctcactctgactcctggccccaaccctgaccactctccatgcctcagagtctcaccctcagcctagccctgccagcaggccccatctcctcctctgacctcagccttgtctccgcctcacaccccaggtgcctccagcacctaagcctagagtaaggggctcccttctcatctttcctcactcctcacaattaaggaaactccatggctagtgtgcataccacccgggctggaatgcaccaaatgtcaagtcaaagggggtaggacacagggaaccctgcctggcgagaaggggagctgagctagggctgctcccggactctgccagcagagggcgctgcagcgcaccccccctccccccccccccccccgccacccggtgcctggcaacgggcatgggccacggtagtgctggtggtgctggtggtttaagctcaggcagctcagtcctttctaaagtgctatgcgtgcttcctgtggtatgggagataactgtagatacgaggcacgtggagaaacatttttttaaaatgttaaaccttttatatttagtttaacatctgttagaaacaatacaaccaggccatgcgcggtggctcacacctgtaatcccagcactcactttgggaggccgacgcgggtggttcacttgaggtcaggagttcgagaccagcctggccaacatggtgaaacctgtctctactaaaaatacaaaaatttgctgggtgtggtggcccgtgcctgcaatcccagctattcgggaagctctgaagcaggagaattgcttgaacctgggaagaggaggttgcagtgagccgcgattgtgccactgcactccagcctagatgacaagagtgaaattccgtctcaaaaaaaaaaaaaaaaaaaaaggaaaaagaaaaaaagaaacaatacaaccagctcatcgaaagtctgatttctggccaggtgtgatggctcacgcctgtaatcccagcactttgggaggccaaggcaggtggatcatgaggtcaggagatcaagatcatcctggctaacacagtgaaaccctctctctactaaaaatacaaaaaattaaccgggtgtggtggtgtgcacctgtaggcccagctactcgggaggctgaggcaggagaattgtttgaacccgggaggcagaggctgcagtgagctgagattgtgccactgcactccagcctgggcaacagagtgagacaccatctcaaaaaaaaaaaaaaattgtgatttctgggatctagttgctcagaatgatgctgaagtggaattctttaaagatccacttaggacaaatagtaagtaactccacactcggaagggacacaggtagaggaaaacttatgactgtggaagtgaatggcctgttaatttggggaaatactgggttaccagtggacttagggtgagctccacagctaaggatagggcccaagttagaactggggtaaggatggggtgggcttagaatcggggtgagggttagagctaaagttcaggggaggccccaggttaggatttgggattagatcagatggaggggcacatttggtgcttaaggttgagaataaaccttaggaattaggaattgagttagaattggggtgagttaggaatttagttagaaatggagttaaagtcactcttcaggccacaagtctttgtgactttagtaactgaaaagtccatggaactgtgaacagatgggcaggagcttctcgaccccctaataggcaccccaagttcaatctgccttttcccccaaatcctcttctagaagcacctggcaggggctctgcctgagctcacaactccaacaaggtcaatgtacaccaatcggattggagggactgaggagtgggcaatcctgcccaggagggagagcatgggacaaccaggtaagacaactgggtaccagacacgatttcaccatttagcacaagtaacctttaatcttcccaactgtcctatgtggttacagcccatcttcctcctacagaggagcacagcagggcagcaaggctgagtacctcgtcagggtcattaaacttgtatgtggcagagctgggatttgcctgcggggagcctgtgtctagactggcaccatctgtggcctacatcatggagcgcatggccacgtgttgggggacaggctgcctggtctctccttctctcctttctgtgctctcctgagttgtcagtctcaggtgatgcagaaggcaggtctctggaagctacccccaccttctcatccctgtgcttgaactttcattttaattttttcatttagggcagtgtttctggacctttttataattattattattgtcctcttaaggagcatttttagcatcttttcccaattgtgcctccctgtatgaaattttaataccatagatacactgtacattccataggattttctagatacaagatcgcatcatctgcgaatagagatggttttacttcttccttacatggacatatgtatggactgtgagcctttggagggtcagaaaccatggtaatagccaagatggtcaactgcccttcctcccctgccttttcatcctctgtggggtgataatgcctctgttgagaatgcatgatttagggtaaggccccaccccgttacaatgtaggtaagaagtggtcacgggaaggagtgggtgggatgcgggctgcacctctatgtgggtggagactaggtgggccagatggagggagatggaagggaatggagatccaggtttctgagaacacactcgcctgtagtggccttggtcctggtcccaggcacaggcacaggctgagcctggggctaggggaggaatggggccagtaccgtcacttatttttgtctctgaatccagatgtcagctccagacccgctggacctgaataaagcaaatacctgtggagactctgttgagagaagagtctagaatttcaacagattctccccatactaaaagcaaacaaacaaaaacaaaatgaaacaaccaaacaaacaaaaacaaaaaacaggaagtttggacgtctctgttcacccttacaaaatgcatttgctgtcaagtgaggggaaaattccttcattcttggctcaaggaacttccttaaactaagaccagctgcctggactgtgctaaattcagtttataaatattataaatatcccaaacttgatagccaagcacattacaaaagctagctagctaaccgcagaaattttccaaaatgctagccagtcagacaagtatgagatattgtgaaatcctgtgttgcttgtctgatttcctgaaatcattcctctcagactgagtgcagaaggcctgggggtggaattcaggagcactgactatctcctacagttctagagccttaaagccctggccgaccccagggtggattgattgcacagtaagtcagaccaaccagctgggcgcagtggctcatgcctgtaatcccagcactttgggaggccgaggcaagtggacctagggtcatgaagaaggtggaggcactgaggccctgagtgattttataaagaacaccttagcaaatatccagcactatgggttcaccttcactcaggacccacaaagccccacgttctgacagattttgtttatcagacaaattgcacttagtcatgcttcattcatttttctcggagacttcccaggttacatagacctgagataatctccccatctcgccgtcaccccccacgaagtcactccatgtttctgtttgcaatacagtcttacatggatcaatattagattttcatggtgctctttgcattttgcaactattgcttaagctggagacccaaaacgagcactagctttagagtcaaagactcctggattccagtttcagctgagagactgtgagcacatcgccagcccactctgatcctgtatcctatttgtacaatcacctatttcccatcaattgcaaggctggaaagaaaagtgcccactctggccagtacacggtaggagcttagtaagcttaagctctcttgcttccccactaccctaaagtgttaggggaaagacagatgtggggaatgtcacctgggaagctccagctgtatgcttcacaatcctactgagaggtgacagcctgctggcagccctggctcgctctcgggcctcccctgccttggctcccactttggcggcacttgaggagcccttcagcccgccactgcatggtgggagccccttcctgggctggccgaggccagagccggctccctcagcttgcggggaggtgtggagggagaggcgcaggcaggaaccggggctgcgcgcggcgcttgtgggccagcgcgagttccgggtgggcatggtccgcaggcccagcactgggagcggccagcgggccccgccagccccccgcaagtgaggggcttagcacctgggccagcagctgctgtgctcgacttctcgccaggccttagctgcctccccgcggggcagggatctggacctgcagccctccacgcctgagcctccccccaccgccccgctatgggctcctgtgcggccggagcctccaggacgagcgccaccccctgctccatggcacccagtcccatcgaccacccaagggctgaggagtgcctgcgcacggcgcgggactggcaggcagctccacctgcggcccccgtgcgggatccactgggtgaagccagctgggctcctaagtctggtggggacttggagaatctttatgtctagctaagggattgtaaatacaccaatcagcaccctgtctctagctcaaggtttgtaaacacaccaatcagcacgctgtgtctagctcagggtttgtgaatgcaccaatgggcactctgtatctagttactctggtgggggcttggagaacctttatgtctagctaagggattgtgaatgcaccaatcggcactctgtatctagctcaaggtttgtaaatgcaccaatcagcactctgtgtctagctcagggtttgtaaatacaccaatccacactctgtatctagctaatctagtggggacatagagaacttttgtgtctagctcagggattgtaaacacaccaatcagcaccctgtcaaaacggaccaatcagctctctgtaaaatggaccaatcagcaggatgtgggtagggccaggtaagagaataaaagcaggctgccccccccgcccccccccgccccagccagcagtggcaatgatgcttagattccctttgacgttgtgggggtttgttttttttggtctttgaaataaatcttgttaccgcttgctttttcagttcacggtgactttatgagctgtaaggctcacggcgaaggtctgcagcttcacttcggaagccagcgagaccaccaacccccctggagaaaggaacaagtccagaagcaccaccttaagagttgtagcactcacggcaaatgtctgcagcttcattcctgagccagcaagaccacgaaccccccagaaagaacaaacgcccaccaccagaaggaacaaactctggacacgccgcgaggcgtgtaactgtaacacacaccgcgagggtctgtggctttattctttaagtcagtgagaccaagaacccaccatttctggacacaatgccaatgaaaattctgaattaggcttcagtttaccatctacaaaatgagacaggacaggagtgggtaggaagaggagcttggctttgttagtttaaagtgggctggtctgattgtgtaacgcgggcttttgttggctccagccaactccccaggcagggcttcacttgctctgaatgtcttttggccaagtccatggctgtcgagggttggggtggggtggggaggcggcgtggaggatagtggggtgggggtggaggagggtgggggtagaggggggtgggggtggtggagaagcagttcccccatgtaacctgcaggtggcaccagagcagcgcaggatcgtgggttccgctccagccttccaggagacccaggcagggcgtggtagggcgaggcagaggtggtgcagagcgctcagctgcgcagcagcatgagcgtgactacagatcaggccgcaccgtttaaaatggatacatgggtcttctggctaacttcctgtctttggtagggtgatcatatgctttatcatccaaatccagacacttaagagagtgaaaggggcactataataattgcacgaggacagcagacataactttagctgtaccttgcaaaccagaacatatggtcaccctaccctccggtcactttttcttctttgtttccattcttttaatttttttcccttttaaacacacagcattatctttccctgagcaccattgtctttgcaaatgctcttgcaatcgggatatttttgacctggcaacatgcatattcagtctgaacagtctctctgaacctaccccaaaacctggttttagcttccaggcagaagactctgttccctggcttgcaacccccatgactcaagaatgaaagatgtcagaagatgtcacaggtgggacagtggctcttatctcaattttggtgcctctttgctaaatgtattcctgtaatttttttttttttttgagacggagtctcgctctgtcgtgcaggctggagtgcaatggtgcaatctcggctcactgcaagctctgcctcctggttttatgccattctcctgcctcagcctcccaagtatctggtactataggcacgcgccaccatgcctggttaatttttgtatttttagtagagacggggcttcaccacgttggccaggctggtcagaaactcctgacctcaggtgatttgcccgcctcagcttactaaagtgctgggattacaggcatgagccactgtgcccggccctattcctgtaattttgttctgagtgctcatttccttcgtctcttttaatttacgtatattggtttattgaattgcaagtagacaagtcccattaagcaggattcttgtatttccaagatcatctcattactccattcaaccccaaattagcatgccatttatccccttgtttctgaaccctcttcacttaatagtcttgaaaacatccatccattgcaaaaaggactcgaactgttttcacgtccatttttagttgattcattgatatccaagtaatgatttgtctaggggagtcattagtagagaactgtgccgttaaatttagttttatagttggattctgctagttaatatctctctcttgtcattctcacattgcaacaaatgactatggttcctgtcttaacctaaaatccaggttagaaatttggttttatctgaataagatattaatagataatgtgagaaaaataatttactgaaacttttctcagctaagaatgacactcgtcgtcattaagcaagtggaaaattgggctataaatatataaactcttaaaatattatgtttagagacaaggtattccttttttttttttttttttttttttttttttagtaaagcatatttgctatggttggaatgattgtgtctcctttaaaattcatactggaacttaatccccaatgtgatagaattaagaggtggagtctaggagatgactaagctgtaagggaggagccccctcatgaatggggttagtgaccttatgaaagggcttgagggaactacctagctctgttttcttttgtttttctgtcctttccaccatgttaggacactgttcaaggtgccatcttggaagcaggagcagcccttgcgagactacaagcctgctggccccttgatcttggacttctcagacaccaaaactgtgagaaacacattttttttctttacccgttacccagtctcagatattttgttataacaccacaaatggactaagacagtatcttacatacagtgaggtgcatatacctaaagttacaactttgtactatcgttttttggtttgttttttgtttttgagatggagtcttgctctgttgcccagactggagtgcagtggcaagatcttggctcactgcaacctctgcctcccgggttcaagtgattctccagcctcagcctcctgagtagctgggattataggcgcctgccaccacgcctggctaatttttgtatggtagtagagatggggtttcaccatgttgaccaggctggtcttgaactcctgacctcaagtgatccacctgcctaggcctcccaaagtgctgggattacaggtgtgagtcaccacgcccagtcaactcaatagtatttacatatgtgcacactcatgtaaccaacactcagctcaagatacaggatgttcccatcagcacagagggctccctcttgccccttctcagttgctgtcccctcacagttaaccaggatcctgacctctgtcaccatggattagttttgcctgttcttgaacttcatataaatgggatcattcagtatgtgcgcgtttgtggctggcttctttcattcaacagaatcctgtgagatttagccacgttttgggtactggtagctgtttatttttctggttgtgtagttttccatatttcatttattacccttctatttttgtctctaactcagtgtcttttggggcctattggtcctttttagctagattgatactaagcgtcttcttatcagtggagcttaggacattttagaagatgaaagcctaataaccccaagccccccaatcttaagccaagtttcctcctcacgcctgcttcagttgctcttcttcatgtggtattttttccctcacaaaactgatggaaattaagaaacccaaaagctcttcatcatgttatcagcttagggacgcttgtcatctgaataacagggtagatatttatcatctgaaatgttaaaataactagagcaaacacttatatagcactgactgctgttcacagtgctttacatatattattttcctcaaaacagctctgtgaaatagacactattattgtcattcccacattttagatggggaaatggaggcacagagagaccatgtaaccttgccaaggtggtagggccaggacttgaacctgttttctggttttagagcctgcacccttcaccaccacaccatattgtgtagcatgatacttcatgtggttaaagtgttttcttctatttacctgggagcattttctgaataatttgaatcttataaatttgcttcaaagaatacaagtaaatcaaaatggaagatctgatacagaatgtgtagcattcatgaataaattataggactctctggttttaaataataatcatttgcttcccttgtgacttttgtcaggcagggctgtaatgcgctcacctcattttccttctcttcaatgggaggagatgggctcagagacaggcacaatttatcgtaaaatctgatcacactttccctcaccatctggaagctggaggtaggtttgtgaaatcttaattgagaaagagttgaatgctgcttgtagcatagtgagtttaaaaaaggtggtttttctccccaattctgttgcacagggccctgtgagttttggcaattaacatatgtggccaacagttttctcacaaagattatcagggttctagaggaaattatcttccagttttaatctgctgcttaagtgctatatttctttatagatgaactaattaattcttggtcacttgtttttattagacatttctctgcctctgtacgctgtgctttgtctctttatgcccagccccgggttttatcttctaactgcaagaaaaaggtcattgaaattttctctctctctcaaactcctgggttcaagtgatcttcccctgtctgcctcctgagtagctggcattacaggtgtacaccactgtacacacacacacacacacacacacacacacacaaacatgcatatacacacacagacatccaaatgtatacacacagagacatacacatatccacacatactcattagatatacatttacacaaacacacacgtgcacacacacatatacacaccttgtttccatcatcttctcaggactcggggctctcagagagtggaaagagtctcataccatgagtccaggatcaactgtgcaaccttgcccaagcatcttccctcttgagatcttgtttataataataaacatccttacccaccaattagggttattttgaagatagaaaggataacagggtgatggcatgttgtatagtttcaaataaaagttaacattgaccaaaaaagaggtctggcctttgtcctagactcctgggacgtaactgtcaacatgtaatacctgataggaatatgtttgcgtggggatcttaactcatgatggctggtctaataataatagttagggtggggactagccaggccaggaaaagcaactaagtgatttagagtctgggctttaggtcatccctggaaggacaggagactggaaactgagagcagccacatggacaatcaagcatgcctctgtgatgaagttccagtaaaaaccctgaacactgaggcttgagggagcctcactggctgggaatactccatgtgtattggcacatagcaaagctgggaaggcagtgcactctgactgcatggggaagggataatggacactctgtgcatggtaccctcctggactcagccctatgcctggtgccctcctggactcagccctatgcctttcttcccctggctgattttaatctgtatcctttccatgtaatcaaaccacagctataagtataatagatctctgtgagttgtagccagttcttagaggtaaccaagcagagttgatctactgcctgcttgaaaaagctatttaaaaatccctaaaccaaagaagaccagatccctcatgaatctgacccaggaggttttgaagccaaagctgagggcatttgaagccaaagcctggctagacagagataaggctcctgggagggaacaggtgcagtcctgctcaggctgcagtgtccccgggctacagctggacaagggctccctctgggtcacagcctctagggacagagtttggggcaggtcgactgatgtgtaggactctggtgatgaactcaactgggaaactctgtggtaatgggaagagaatggttttgcttttccaaatcatctacccgctgcatgcttggatccacatgggaactcagtgtggaaactacatttgaacagcctaagcctgaactctgggccatgtgtccagtttcctggcctccagctttgttcaccccttatccccacccatcactgatgccagatccatcctcccaaatgtcctttcatcatgttaccctcctcaccacctcatggcatcttctacacaacaggaaatgcctcccacctcagcctggcattcaaggttcttttgatgtggccgccactcaccaccgcaccacatctccctgtgggccctgccaacttggatcaatttttcctatccatgagctgaactttcccacctccatactgttgcttacactgtgaccttcctgtgcgtgttcttttcctccctcttcccaagtccaaatgctatagactgaattgtgtctcccaaaagttcatacttggagccctaacccactatatgattgtatttggaaacagggctcttaggaggtaaagttaagtgagggaggaggggcagagcaagatggctgaacagtagtctctaccaatcattccccctgtgaggtggctggcttcaggtgagacccagcacattcccagctatggtggctgtggtgagagatttcttctgcttgagaaaagcagagggaaaggtaaaagggactttgttttgcagcttaggtacctgtctggccacaatggggtagaaagcaccaaatgggctcttgtggtcactgattctaggccttggctcttagacagcatttctggacctgccctgagacagaggggagcccactgccctgaagggtgagccccaggcctggaagtgggcttaagagcccatgggccctaagagaacatcgacagtagcctggcagcactccctgtgcacctgtggtggtggccacagggtgaggctcctctgcctgtggaaagggaaaggcagagtgggaaggactttgtctcatggtttcagtgtcagctcagccaccttagaataaagcaccaggtaaatttctaaggtttttgaccccagacagcatctctggacccgccagggcctgaggaaactcgttgccctgaagagaaagacaagcctggctggctttgccacatgctgacggtagagccccagggcctcgagtgaacatagacgatagccaggtagtgttgacagtgggccctgagtgagacccagtgctttgctggctttaggtctgacccagtgcagtcccagtggtggtggccatagggatgttgtgtcagctcacccccagctccaagtggctcagcagagagagagggagggaggaagacagagagagagacagagacagagactgtttttggagagaaactacaggtaaagaataagagtctctattgcctggtagcccagagaattcttccagatcttatccgagactaccaaggcagttcctctatgagtctgcaagaaccatagcataactgggcttggagtgtatctaataaagatacagttgagatcacaacacccacatcctttcaaatacctggaaagccttcccaagggtgggtacaaacaagcccaggctgagaagatggtggcagcttgaaatcagccatggaagatttgcaccatggaaatggcaaacactacagaacagacttctgttccctccccgacagagagccccttgtgtaacaacagcactccactgccccatccctgagcagagcgctgtgtgttgcagcagagtgggggcaggtgtcttctcccttgggctacagaatacacattttttttccctcagcacatggatcattctcaaggatagaccatatcttaggtcacacaacatgtcttaaaacattagaaaaaaatgaaataatatcaaatatcttctctgatcacaatggaataaaactagaagttagtaacaggagaaatgttggaaactatacaaccacatggagatgaaataatatgctctggaatgaccagtgggtcaatgaagaaattaagaaggaaattgaaacatttcttaaatgataatggaaacacaacatgccagaacctatgggatacgacaaaagcagtactaagagggaactttatggctataaacacctacttttaaaaagttgaaaagcatcaaataaacaacaatgcaccttaaagaaatagaaaagcaagaacaaagcaaacgcaaaattactagaagaaaagaaataataaagatcagagcagaaataaatgaaattgaaatgaagaaaaagcatcaatgaaaagaatagttgggttttggaagagataaataatgttgacaaacttttagcctaagtaagactaagacaaaaagaagacacaagtgaataaaatctaagatgaaaaaggaaaattacaactgataccgcaaaaattcacaggctcactagtggctgttataagcaatgtatgcaaagaaataggaaaacctactaaaaatggatacatttctagacacatccagcctgccaagattgaaccgtgatgaaatccaaaacctgaacagaccaataagaaatcatgacatcaaagcggtaataaaaagtctccctgcgaagaaaagcctgggacctggtgcttcactgctgaattctaccaaacattaaaagaagaactcataccaaccttacccaaactattccaaaactagaggccttacccaactattccaaactcattctacaaggctagtattaccctgataccaaaaccaaagatacatccaaaacagagaactacaggccaatatcactgatgaatattgatgcaaaaatcctccacaaaatattagcaaattgaattcatcaacacattaaagttggggtgcagtgtcccagcttcactcaacccttccccttttcctgtgatcccaggtggctgtgatcccaggtggcagcggtggcggcaatgttggggtgtgggcctcccaggacaaggggaatgtgagtgtgcccttctcttgcctcctgccaggcgtctgtaacctggcaccagctctggccaggtcttcaagtaagggacctggagatgttcttttccaatttctggattgggaaatggagacaaattctgggtactagagtcagaactaagatgaggctgaatcgggagagtctggggtcctgagaggccgagacctgaaaccctctagatcgtgtggggagctgggtgtgtgatctggccagttgtttctccctgtgcctcaatgttccaggtacccttggagggactgagatcctggggatgcctggagcctggctgcatggcctggccgccctgatgccctcgtgctctccatggcaggccagcaaggctgaggagaatgtctccgacagcttcatgcactccatggacccacagctggagcagcaaatggagaccactcagagcctggtggactcctatgtgaccattgtcaacaagaccgtgtgggacctcatggttggtctcacgcccaagaccatcatgcacctcatgatcaacaacgtgcatgcaccacctcatgggggcaggggctcctgtagcactggggacacaggtggccgtgttggcctggcagagatgacaaccagccctatgggaccaggtgcagggagaggggcacggtccagaccagagctgtcccatagaactataacgtgggactgggcacagtggcccatgcctgtaatcccagcactttgggaggccaaggcggaaggatcgcttgagcccaggagtttgagaccagcctgggcaacatagtgagacctggtctctacaaaaaaattttaaaaatagctgggcctggtggtggcacgtgcctgtaatcctagctactcaacaggctagccttggaggatcactttgagccaaggaggttgaggctgcagtgagcagtgatctcacccactgtactccagcctggtgacagagcgagatcctatctccaaaaattaaaaactgagtagacaggtgtcctggtggcatgataggtcctgggtcccctcccagatctgtgaccttgggcaggtgacttttcctctggacctcagtgtccccatctgagtgagaaaaagcggtggggaggtgggtcttcgagtctaagcagtgtagaagccgcatctgaaaagccatacccggggctccaagtccagcgtacagccccagcaggacctggcggcgtggccagggtggcacaggcatcaggtcccaacctccttccctctttgcccactctcagaccaaggagtttatcttctcggagctgctggccaacctgtacttgcatggggacaagaacatgctgatggaggagtcggcagagcaggcacagcggtcatgaacacaatcagcacgcccacgggggcccatggacaactcctgactgcaggtgcagagcatcctactggatgcaggtaccagggctggcccccacggccccaaagccccccagcctccatggctaagactgtgggctcttggaacaggctccatgcccaagttggcagatgtgggtgctctctagagtcctcggagagggcagagaactcatggtttatggtgtaggggctgggaatgtggagggcgttgtgtgtggggctggactctgaggcggccagaggcctaggaatgtcacctgggcacaacataactgtcgtgcagtctgagtcatgctgccagggcagggtatccagttcccagtctgggagtgccgagagccaaatccactgtagagcaggggtgatagtcagggtcccacctcctctatctgttggcaatccagtggtgatcctggataaaatcttgagagtcccatacacatggtcatcccacaacacacctcacaggccaggcaggaacacacagcccccttccctccctcccaggtaccaccatagctgctagcgtgtgactgaaggcagggtccctggcccctgctgaaacactaccgccagccagcgggctcattcaccttggcctgttgctcttaggggtcacctgtgctattcagccaaggagaccacagtccctgctggcccagctgagctccacatagccagcccacccacctcccctgccacagactctccctcttctgcttttcccagcaggaggggcccaggctcacctatgcaacctgcaggcccccacaaccagctgaggctcccctcttagacttataagtctatggccagtggcatatgcccttcctgcctcccccagggtcctttcagagggtcctgggctttctgaccacccagaggggcccctggcacactccagtccagccatcccttttagcttcaccatcctgggtcaagcagtgttccttttctatcaggcctggtggctgttgggtggggctccccaaggtgagaggtggccttgggccagtgggttggaagggagggggctgagcattggtctgaactgtggctgcactgcctgggtgccgtgggagaggccagtgtgtgtgggctggggagggccgccgcagcccccaggcactacctgtgaagctccggctcctccctccatcttcctccccttttccttccagcctctcttttccaggaaccttgccacacctgcacctgcgtcctcccctccccggccctcccacagctgctgcagcacgcctgtgctctgtgcttgcctcaccagctctctgctcacttttctctctcccgttttctctttgctttctctccaactgccaggtgatcaggtcaggcaagtccatcctgtcctgagagccccaggttccactttgacctctaaacagatcctcctcttctcggaggcctccctttccaagcctgcctgggcgggtgtcctgtgacttgacagtggctccccagccccaaagccagcccccttcatctgtgacttagtctgtcgtagtggtgagctgacacatccaggtgtgacccttgctgaaaacttgtgccccctctgtggtatgcccctgccctgttctataaatatctataaatactcatatgtatatatacctacacatggctgaccgcctcgcctctagcactgggaatctgtcaccgtgctgtccttgtggagtcttgtggcccaacaagacgaaggtctcccctgacactgcccctccaaagtgtgccacctccagtgagcctccctgtcatgtccggcctgtggacagccagcccccgccatccctcccaccccccaccaagaatgggggtgctgtgcaggcagctgtgtggcctgacagtctctaccagtcctgctgtccctcggctgagaatcaaacccatttctggatgatggggaatgtgtcctctgctagctgtgttctctgtggagtgcaggggagggaaaaggccaagccatttctagggtgctgttgggaggagtgaaaaggccacacaccctttccaagggacacttttcctggaaagcccctggagcttagctggcttttatcctgcgaagccggctctggccactagggggcagggccatgaactcagcctggaggagcctgcggggcagccagcactaacaggccaccaggtacactggagggacagacagaacaggccaccgggtgcagacaggcgagggaggcagggggatggaacggaagatgcctggggtggaagtcagtgcccttgggtgctggtatttgtcttcccggccactgctacatcaggcttctgaggctgttggctgtcagggcgggactgtgccctataggcgccatggcagtccctgtgaaatccaccaggtgtcaccaggcagcatacaggtaacaggcctggaaggtccccaagagcccagctggacatgctcagacactctagggctcctcgttcagtggcacaaactccaggacccagtgagggacacgggaatccaccaggctgagcagtatggctaaatccatttactccaaaatgaaaagcaaaataaacgggagtcacatcaccagggagccacaaccccatccccgcctccttcctctgtcctatgctatcaataaataagtttcccagccacaaatagtgattagaacctcctcctcatatgccagctccaacctcctctaggtacaatacagggggtggccctaccccctggaatatacaaaatgtcacacagatactatatgtacactgcggaagggggtccaccccagcagcctgtgccctcacctgctctacagttagccccactgtcccgcctcagctgcctctctgaataagaagatgggagccccctgagggaaaagttgcttcggtgagagtagggaggccatgaggcctcctccaaacaaaccagctctaccagcctctggctcttaaataataatcatcatcatccagaaatttaaggactcagccctggtcaaggtggcaaagggtctgtttttctccccccattagacaggggtcttgtcttgctaccctaatggtaaaggggtgactgggagggggtggtaggagcatggtagggacagagactccagccccacttctccaggcttatgctgacaggggcctgcttttatttatttttatcccatgacttattttttaatcccataatttctttttcataatactttaagcttttttttttttttttttgagatggagtcttgctcagtcaccctggctggagtgcagtggcgcgatcttggctcactgcaagctccgcctcccaggttcacgcctttctcttgcctcagcctcccgagtagctgggactacaggcgcccgccaccacgcccagctaatttttttttttttttttttttttttgtatttttagtagagatggggtttcaccatgttagccaggatggtctcgatctcctgaccttgtgatccacccgcctcggcctcccaaagtgctgggattacaggcgtgagccagcaagcccggccctttttttaagcttttcataaaacttttacgttttttccacaactttttttgccacaacctttccacaacattttttatcctgtaactttttcatcccacaaccttttttatcccataactttggtttgtgttcttcaaataaacacacttcatggttacattaaaattttataaaaataaaaaccgattatctcatgccaagcgtgcccagcatttgcacagtctcaatacctttaacaccacagttttcaagacacacaaaattttaaggcaaaaacagcactttgcaacaatttaataatttattacattacagtagcatcacagtagcagtgaataatgccactttaggcaacagtgtttcagtatttccattatacattctgtttacaagaattcataaattggtaaaagtcattctaagaaaacttggcaaataaagctttgcattggaattggcatttctttctctacttttccttcccccagtttctttcttttaaactacagtattcatattttaaaatgtcttaacttattttaaaacttaagatagcagttacatttttgaatagttatattcttttaaaatgactctttaagataaagttttagagaaactattatggataggactgatttacattttcacattttctaaatatcagctttggttttagaactgactttttttcatttctggaaaacctatcagatttaatcaaatactttaaaaatgattatatattgcaatctttaaatcggtttttaattctttacttcctacagaaattcaaatttattcagttgaacccacactttaaaattctatgtttctgattaaactctacccttctaatgttgccttctaagcaaattgaacgctgccttatactgaatgaggaagagaacaaatacttggctgaatgaggtattgcaaaggaccacatgcactttgaagaaagacttaagttgttgtcatatgatttacatgctatttaatttttcttaaatatatgacagaatacctacacaaagagtggtatttcagttaatatagtacattcattttccagactgacattcagcttaaatatgccggtgtgtgatttaatccacaggtacctgatgaacacattattgtcagattggttgcaggtgctaaaggctagctgaagatcattcctagtcatttatatttatcagggtaaaagtgaagtgattgaactataaaaatacctttgaaataatttatcaatgtattaggtaaacccagtttcagaattataaagaaaaactgttagaccaaataaggtggctaattaacagtggtatgatttctagcccgagggtctaaattggactcaaactgtctttaaactgaactcaaagaatgcaaaagtggcaagttcagaaaataaaaggcaagaacaggacttgaagtccattttaaaccctcgggctagaaatcgtcctactgttaattagccacattcgttggtctaacagtttttctttataattctggaactgagtttatctaatacattgataaattcatacaatttggaagagtcagttgaagtcacaaggacttaatatttgcactctttcactgaatgcaggcacatctgttattccatctgtaaaatcgtattattgctctcctattaatgtcatatgtataaaagtatcatgaggatgccaaatgctaaaaatggagatggtctagtaactagaaatgcccaccccagggagcgcacacacatctctccctgcatcctaatactgtgacgtattttggaacacagacattagaacttcatgaacttttagctgttgattctttcccaagcatcttaaagttatgatttaggcaatgtatgactgaaataattcactcatcacgtataggcacattaacataaatatggcacaaaatatgcctctaactgaaactgagaggtataaaaacatatttcactctttgtgaagaactttgtgaggaaacataagtctgtcattgtatagacactttttctcataatacttggacattcacaaacattagattgcactgcagcttgtaaacattttaagttgcataaacttcgccttgattttcatgtgtagtataatactgtctactaaaactcctttttgtttcaactaagtactctcacatatattggtttataataatggttgttattatttttaaagtgttttccattcaaagaaaagaagtaaattcctatgtcagagtaactaatgtggctgaagaataggtattagccagagaggtctagatgataaaatcaatcttctagcctcaaagaagctccatgaacatagaggaaggccaggtgtcacacagctttccttcactcgaattcattcttgactagagcctgtatgcctcttccagggacatttaaactcttaaaggatttcttatgatcttcactaaataccttaagaagaatgccaaccagtgcccttttgtgtactgggacatatactcgtgattaaaacaggtaacatgaactctgactttaaaatgtattgtagatataaatgctctaagctagaaaaggttttccacatccacagtcaatgatgggagcctttcattcctcagaaataatccctttttaggtcatcaagaaagggtacaactgctgcagctcatgatgcaatatcttcatgagcccagagcacatacaaatcctaagggaactaccatagtacagcgctcattcttggcaccagaacaaatgaaacacactctatcctgcacacacctgccagagcaggccactttcctcttctgtgagatttaaaaagctccccaaaatgttattactcccatccccaatacacagaaaatagggaaaaggctgtttccagttcttggcctttaaacaactctaaatgtcagtactcacagtggcatattacaaagtaataaacagtgctcaattgagggcaaaccacatattgagctaatgaagagctcactgtggttaggattcgatcaaacgtaatagcagaacataagcacattttatctgaattctggaatgaatatacatgctgcaataacattaaaaaagcatggcagcctgttccaaaccagccagaatagttttgtgcaaattagtgggtctttgtgtgtttgaattcccaccacctaagggcaaactcgatatgcatactaatgacctacaattatcaaattaaaaataaaaatgctaaaggatgccagaaagaacatcagggaaagaccaactctcccttaactttttacaaataaatttaaacggtaaattagaaacacaaataaatgtgagtggctctagcattcaaatggagtaaatgaattgtgtaggagatgaaccccgtaactttttgttgttgttgttgttttaaatttcttgaccagctcttagaagatgatgatgtttatctccctgttctcggctgcctggtagaagaatggcacgcagggtttgctgggcaagcctgggtgctcctaggtgtcctgcatgacaggagacagctgcacgatctgctgtacagtggggttgtcatggggagaaccctccctggccgctcctggtgcaggctccacgttgttgtccaggctcacttcataaaaaacttcggagagagggaggcgggggtctgagcacagtgcgagcctcccctgcccctgcctgcccaccccgcctgagagctctactcaccatcctgctcaccggcagccccaagttcctggggggctggggcccctggagtgggctcatcagcagggttctgggcagcgatgaggaatttgccatgcccctcatggttgcccacaaggggcaacaccaactcttgcagctccagcagcttcacctgaagggaggggtgctcagctcccaccctggagcctgcaccagcgcccatgcccacccccaaccccgcagagatgttgcacgccctaccttcatctcctcctccttctgggccagcctgatgacatcctccatctcctggtgccgcgtgtttggcactgccccctggctttcatatacggtgaaggactctcctgtgagaggacacagctcagacactagggtccctccgacggccctgcagctccccgtgcccgtgccctggcctcccgctcactcatgccgtctgtcactccagaaggctggacgaatccaagctctcgtctctccacctgctccgtcccgtccgccttctccttcgggaggtccataaagctgctctggagccaaaataatggggtcacatctcgggagtgacctgttctgccccgcccccacttttcttggcccatgccaggactcactccctttcagcttcaccatggcctccttcagggcccggtagctctccccacacacaaactcacccccactccctggggctggggcctctgcctctggctccttccaggcgaaggccaacagatgagccaggtgcaggcagcacagccttcacaccttccgctgcccacatagccgtgcctgctcctcctgggaactggctccagcagaggtgaaaaatgccacttgaaggcaagaggtgagtattcttgtaggggcatagacagaacaaatgaggcagggaggtggagaacaaccccttcccttggggcctcagagagtgcacctgttggtcacaggtgacaaagtgtctgaccactggctcccggaaggggtgaggggccagagcaatcagaaggtgggaaaaccaagagcataagggggtctgggagggaccacagaggaaggtggcaaagcggggcagggaaagtcaggctcaccgtggcctcccggctctccaggtcctctgggatgtttggcgtgggccgaggcgcctcctcctcctcactgtccagatgttgtcctccatctcctgtagggaggtggccagaggggtcctcagacaacccaacaagggaggtactgtgggcccacctctgtccccaccctgactgtgtaaccctgagccagcctctccccagaggggagtgagctgctgttctttatttttccttttaagaaccaagatcttgctatattgcccaggcacagtcccactaccggtcggtgcgggagtcctgacctgctccctttctgatctggtccagttcattcatccttaggcaacctggtggccccctgctcccaggaggtcaccatattgatgctgaacttagtgcggacacccggttggcataacgaccagctgttctaaaggtctcttccaacccctcaatcctatgctgctaacagtccccccttcctcctggggctctctcctcttcctctgagtggtctcctgtaccttctccagggagagccacgaggcttagctgggtctctagctgttggttctggtggctggcagcttctaggtgctcctaaggggacgggaaacagagtgagaaggcacggaggttgccaggtcatccccctcggggccccgtcctcagcaactccctcccctgggtctcctgcaacttttgtccggccatctcagccaccgctttgccccaagcttcctgctgctgcagctggtccacgaactgggtctgcagcagtaactgcctgtgcagcgcctccttctcagaggtcagctgctgataggtggccatgtactgctgcaggtgacccaggtactagtctcgctgctgctgcagactctgagactcttggctcttcagctccacctgcaggaagaccctgggcatgagggcacatggcggctggcttccagattctgggcccattaatagggtagcgagggcaccgtggggctctgtcacctgcccaggaccctggtcccttgctccaggcctaagaggcttcctcccttgcctagaaccccatacctccttccccagcctcaaatctcatgtccttcttcccaccatttaaactgtaggccacagactggtggaaaagcagagggagccaaccaccatctgctaagtgtgctacatgcctaatgctttccaggtattctctcattcaatcctcagcacctctgcaaggaaaatgctaacttccttttgaagtcacagaaacagagacttagagatgaacagtagttgaatggtgaccagtggaacccaggccagaatccagtttgaatctaaggaggcttttttgttttgttttgagacagtgtcactctgtggcccaggctggagtgcagtggtgcaatctcagctcactgcagcctccaccacgtgggctcaagcgattctcgtgcctcagcctcctgagtagctgggattacaggcatgcgccaccatgcctggctaattttttgttgttgttgttgtaattttagtaggggtgaggtttcgccacgttggccaggctggtctcaaactcctgacctcaagtgattctcctgcctcagcctcccaaagtgctgggattacaggtgcgagccaccgtgcctggataaggagcctcttgtaccactgtctcttcccctgtgattgggggctccatgtctctagctgggatgatgatgtccagacctgggaggagcccagggctacccacctctaaaagtcagagggcaggaagcaagaaacagtcatagagctgcactggagggtgctggggtcacctgcctcccagctggagctgcctttggcctggcacctcccctccccagaggctggtgcccgcctcccagcccttcttggatggggtggaggttaccatctccttcacctcgtctagcttctcctgcagctcctttacttgctgctccaactgcagtgcgctctttttctcgttgttctggacagagagaagcaatcagtggccatccactgcagctggagacaccagaccttggtgtctgcctcccatatcaccaggaagggtggaggcaggttagaaaaatcatcccttctcccccacagccatcagagcagagcccgatgagctgtagctcacaggtgcctttagaagtagcatttcatgtgagggctacactggcccattttacaggtggggaaacaaaggcctggagggatagggatgagggcaggctccccaggtggggcaacccaccagatcctcgaagctgcactgtggctcggccagctgcttgtcgagcttgtggttctgggagagcgcgagcctctcctcctgcttttgtagcctctcctccttcttccacagcctctcctcctggtcccacagcctcttttcctgcttttgcagcctctcctcctcctttcgcagcctctcctcctgtttgcgtagcctctgctcctgctttcgcagcctctcaccctgctcctgtagcgtcttctgctgctcccgaagcctctcgttttgttcacacagtctctcctgctcccgcactctctgcgcctcctgctctcggagcatctcctcctgctcctggagtctctgcttttgttccttgctaaggagactcaaggcctgattgttttccacctgggactggagctttccctccagaccttccacctcctgcctcaggtgtttggcctcatcttgtagctgttccaccacagaggtcactgctgggggcgccagggatgggggctcagctgagaaatgaagcagacaataagggcctctggattccccaacccctctacccacatccccctcaaaaaaaaaaaaaaaacctcctcttgatgcacagctcctctcaggcttcccaaacttggcctcactgctaatcattcctcgcacccaatggtagccaatttccaagccactttcacatagagagcactgtgggtggctgacaacgggcactcctccctctttgctgatggggaccctgaggctcatggagatgacaaaacttgccgtctcctggcacagacctctttccctctgcctcaaagcccttccacccacccacctccctggggcattctaagccacccccacagacctctgatgccagtcctgctccgaggtcacaccagccccatcttacccatctggtttttgagttcggacaagctcctctccagctcctgtatccgatgtatgtcacgcttcttctcttccttcaatgttcgagcctgcccaaagcacaggggaaagggccctggagagaggggctggtggctggacaggctaccatctcattctctgtccccatctccacaaagcccagacccatgaccacctctggctgtactattcccattttacagatgcccagaaagatccagtgacctatctaaagtgggggctgaagggtcagacctcacctccaccgacattttccacatcctctcctgccaccgggccctctctccttttatgtgtttagcatattcgtctcgctctagctggacttgttttagtgactctgtcacctgcaagaaatgggcacagaagttaggaagggctgtcactggtcctcacctgctcctggccacctggggtcatcttccttccacatccctccctctgcaaagcctcacctgtgtcacgtgtgcgttcagcagcgcccgctcctttatggtctgctgtaaccaccgctggaggaccgcttctctgcagctcgaggactggatggtgaagagtgagaagttttgatctggggagctcaggcagtgccccttaaaagggctaggctcaatatacaactcggtcagtaaaggtcaaggcatttccaagcccgtggcctggttattaaaagaactcagtaaagttggaagggagagggaaagagatagaatttacagctggctaacagaggcccagagagatcagataatattgctattgttattactgttattactaccactgtttgaaccgttatggagtgcttcaccaggttccatgctagcaatcccatttaatcctcacaaccaccatatgagacggttactaggattacctctattgtgtagatgaaaaacatcgagtgttcaaggttaagtgcttgcctaagatcacttagacagagctgggatttgaacacccaggtctatcctattctctaagcccatttttcttgctgggggtggggacacagataggaagggggaaattaatcttttgttcactttttgaaaggatgatacattcatatagtccaaaactcagaaggtacagaagggaggtgtctccaggcaccctgttactctctcctgagttttttatgaatgcttgcagacatgtttttgtatattatcatagtacacacacacacacacacacacacacacacacacacacccctttcctctctctacagaaatggtaacatactaaaggtgctcttctgtaccttcacagaacaactacccaataccccacctaggacttggccaaggccacagccaggaaagggcagggcaggcacttggcctctgagctctgcatccagtgctcactccccacagtgccccccaactcacccacagcagctgactcagccccaggctgcctctaacaaccatacacaaaagtagtgagaaatgaccatgctgccttctgggcaggacactccatcctgcagaagggacctttaggctcactcctctatctgggaagccaggctgccaggggatggggcagctggttggactcaccctgtcctcttcctgctgctgtgtagacacagcacagagagcccgctccaattcttgaatacgctgtaaggagtattgcaggcggccagccagatccttggactcttctgtaatgagagaggttgagatggggcccaaaagactccccctaaagacctgtcaaagtgccaggttgaaggatgacgggatgcccagattcccaccttcgaagtgtcgggcagcacgtttagtatggtaaagggtggtcttcaagtctgccttttccaatgtgaggatgttgattgtctggaattgaacgtttgggagaaaagccaaggaaatgctgaaagagaaggaaagaaacattctccagaggacaggagaaagctccccaccctccactcacctctaaccgctccatttgtgctttgtgtatttcattgtttgttttctttgcctgtaggaagaggaagacagagctcttatcacagggaggcagagatggcacagcaagagacatgcccccagaatgccaccaatgccccaggacaggcccacccatgggaccaggttatcagggaccctgtggggatggggtggaatctgatgggtgagccttcttccccaggctgggagtgggcaagatgagactggcgcctctgcatctgagtgtcccccaaacccagcagtcatgttgtgagcaaagaaatcacgttacttcttccagctgatgttccacttgtttcttctgctgtttctgtggggagagtcaaattcaggtgactgagagtggccccctcaactctattccccagacctggaagcggtaggcagggtccaggaatggattttaaaggcaacattctcagaaccaatggcaacacaaactggtcaaccctcttcaagctcccaaggacagaggacttgggtctttgttggtttttgcccacagccacagaactcgaagtctgaatctggattctcttgaaaggacagtaacataaacccctagagagggagtctcaggaaggcccacccttctgccagcttgtgatttagaaaggtgccttcattcaacaaatatttactgaacacatacgggccagctacggttcttcacagcagatataggatggaaaaggacagacaggagcccttggccctcaggtttccattctaggggcctttaaatctcaggctctcagagctaacagagaactctgatgctctacctcctccagaaacacaagcccaaggaggacaggtggcttgtccagactcaaagcaaattagggactgagtcagggcagaaatacagggcccctgacaaccagtcaggctagcgcttccctgagaggtgacaacctcagggcgtgtgtggcaaggactggagcaggggtgtctggagaagagagagtcggcaaagagggcagtgacagaagagccatgctgcgtgctccttgctctggggtccctccaggtgaggcctgggtgctccagctccccatttgcccttggcaccaggggcccccagcccctttcttcagggccccaaggggaaactaaagcccaggattggcagcatggaatcaggggaccccactggacttaccaatgattctatgttttcattgagttgactgattgtcactgagcttgactccagggctactgctagttcttggtactggctctgaggcacatgcagagaggaggagttggaagaggattgtggggagaggtagagagaacaatcattagggctggggtgtgtgtgggctgtctcagctggcagagggtcacccagcccccactgtgagaggaggttggagggctggcctgcaaagtcactgcacctcagcccagggcctcttacttccagatccttcagggtaacagatgatgcaggagtaataaaaatgagaaattaaaaaaaaacttacatgggaaatagttatgtatatggagaaagtataaaaacagcaaggagccgggcacagtggctcacacatgtaatcccagcagttcaggaggctgagacaagtggatcacttgaggtcaggagatcaagatcagcctggccgacatggtgaaactgcatctctactaaaaatacaaagagtagccaggcgtagtggcaggtgcctgtaatcccagctactcaggaggctaaggcaagagaatcacttgaacccgggaggcagaggttgtagtgagccgagatcgcaccactccactccagtctgagtgacagagtgagactctgtctcaaaaaaaaaaaaaaaaaaaaaaaaaaaaaagagcccaaatcccacgtgcctgctctgtacgttattcccagattacttttaaacttttaggcgtcaccatttccaagataataaaagacgcggggaaggaaaaaacccaatcaatcaagcaggtgaagaagcagacagaaacaggctgaaggttaatggcagcaacataaaacaaggcagaggccaagcatcccccaagccagagaagcctcagggccatgcacagctgtagacagcaagccagagaggggtcttggcactgcctcaccttccacttgtccaatgggggagcactaccccattggagtggttaaggttggacacccgcaccttcagaatgtcctgaatctacaggaggtgacaagggaaaaacaagggcagggggtgaaagacagaagtggcttagagagaagcaagaaagtcagggtaggaggaagatgtgggttcaggaaaaggaaacgctgaagaagagcagaggagattaaaaccatggcctgtgccattcttccaaatggccacctgctgccttgccaggggcaggaaaaaatagatggaaaagtcccccgagtgacgcagtcacagagtggagtcagctgaccaatgcagatcttaatacgctcactggacccctctcctcaggcccaggacatgggcgatgaatctggtagagctccagacctccacctccattaaaaaaaaacagactcctgagtaagagttcacttgaactaaggggacttcagctaaaaaacaagtttgaaagacactgatcttatccagtatcatcttacagaggaggaaactgaggcccagcagaagaagtgatttttctgtggtcacccagcaagctggtggcaagttagaccttctcttgctcctagtgccttgggctctcctcaccacaccctgggcccccttcagtgactcctagagggacagcctgatggcaagtggctgtactcattagcccagcttccccttgcgagtggggatcaggaaaatcaaacagcaatgaccatttcctgggtatcctgggtgtttacagcaggccacgtactgggggttaacatgaaaacaacaacaataaggaatctcatttaaacttcacaaatggaagtcaaacaatactacccctattttacagatgtgaaaagagaggcccaaagagctcaagcaacttgccataaatcagatcgctagcagatgaagaagcaggattcaaacccagaattcttaaccagtacccagcaatctcaacaattaccctctactgccccttgggccccctgtccccaggagcctggccagccaagactcacatccccaggtgagtggcaaccaccggaagtggttgtctcagggctactgtcagtttttttcttttttgtctttgctcctgctggaataccagggctcttcctttgctgatattcttttagctgtgggaaagaagagcagtaatactcatgagaactaccagcccttacagccacaccctccttacagtttttgcaaaatactcttatacaccatctgatttaatgccaccaacaactgtacaaggtgttgtcacaatcacttaagtgactgagagggatggatattatggctaaaaaaaaaagtgtgggggggcaataatggaacttaaactcagtcttctgactccaagctctggggttttgccatgaatcagcagctgccggggaccaaaaccagacgcagaggtagaaaagtaaacattacataggcatgaactacacgctgtgtggtttagagtcatacatcctcaaatgcctgttagtgtgaagaagtgcaccagtatctctcaaacttttatatcaatgtgtcctcatggcagaaggcagcttttttgttaaatctgggaatttatcagaaagaggacaacccaagtctcatttcagagagaagtctggtatactcttagaaacctatgtgagggtcacccctaagtacattaatgttttttctctctcaagagaatcaagggaaactgatgcttcagaaagatctcccacatttatcctgtggcactcaatgtaccctaagttgagatgatatgaggaagattcaagctgtcaagttcagtttcccaagacctattccacagaagatgagcaaatctcacttcagagaccactgactgaagggcagtctggtcccagaaccgtggagaattagaatatgaggtggagaactcggaaaaaaatgttaaagtctctctggagagtagaagcctgggagaaaaccaaaccaaacccattctcccattaccacccagagatactgtcaacgttttgagctcacaggggaagtgtaggcttttcacactgtcgatgtctatgtgaagggagtaaggcagcctgaaacctcttgctcctaggtcccatggtccccatttcccttctagctggaaatttgtgctgtgaccagaggaaccagaaatggggtgagaatgcttaggggactgggttataagatcaaaggccggtcttgcagcagtaatgacagttcctaggaggactgtgacatcactacattccactcctcctgggggtgggggaaacctcatcagtgcaatggctgagttgccgatccacgatgggggaggggggacgtggggctgggacccaggtccttggagatgccagtccagagagcccagggaggtcgggcttgggtcagcaggaggggagagcagagtctgctcagggaaccccaggagtcaccagcccaaagtcaccccgggatgactggcgatgctggggggttggggctgggggacccaggtccttggagaggtgagcccaaagaacccagggaggttgggcttggggtggcaggacgtgagggctgaatatggagcaggtatccccagtagtcatccgcccaaagtcaccgcagggtgattggcgagggcagaggctgggctgcttgctgaaggggcggggctgactgacaagacgttggtggggggagtccagaggcgccggggtaggggggcccagcccggtgtgcctcaggagtggtatggactctgggagtggtcttgtcatcagaggggatctctggctaggttggggggccatgacctttttcttggctttttacctttttcttggctgctgccaatttattctgtcgagattcttctaacatcatggggtggggagggaggtagggttggggccacatcagcgaacacctccagtcacctacaaggctgctgtgtgactgagccagaggaggcgtaaccagggccacactagaatgcagaataggggtgtggccttaatgctccaatcccattggtcaatgagaaagatgaaagggaaaggaggcgtggccaggcagcagtgtgcccagaggaacctgtgacatcacaaggaaagctgcccatgcgactgctgtccctgcccacttggggagaggggcggggcctgcctactccgggagaggggagggctggtttttgctttaaaatgttaaaaataaactttaaaaaaatatgtatttatactttatatatatgtgtgtcagtgtgtgtgtgtctacatgttcctccagagctgtcttcattatccagcttctatgcatggtctatgattttggcctacatttttcatcttcagagggagtataagaattaccagtattaccccagttaagacacaaatcctataaaaatggaaaatccatagcatgtttgatgattaatgaatgaagtggactatattatccaacatcccaataaggtaaaataatcacaatgatttctcggctttggaaaaaacatttctcttattctcctacattattaagattttttaaaaaacaagaaacatgtctaatatctttaaaaacacaaagcttttgggccgggtgtggtggctcacacctgtaatcccagcactttgggaggcctaggtgggtggatcaccttaggtcaggagttcaagaccagcctggccaacatggtgaaaccctgtctctactcgaaatacaaaaactagccaggtgtggtggtgggtacccgtaatcccagctactggggaggctgaggcaggagaatcacttgaacccgggaggcggaagttgcagtgagccaaggtcacgccactgcactccagcctgggtgacagactgagactccatctcaaaaaaataaaataaaatagtcaaaaataaataaaaacacaaagctttccatttaataagcactcaaagctctttactggtttaaagcaaatacaaggcctatttttctagaatcacctggcctctctaagccttgcaaatgaaactgaatttctcacttgatacttggctatgacttgcaatcatgaaaaccaagaattgtgttatgtcactgtgtattgattgttacctgaattccacactaggctgggatcaagggttgaatctttcatgatttgctccataacctgtgagcgtcttttcctacaccaaactaagctttgttctagagttctacaatttacagttagtagacaagagtggttctcaaaaatgtagtctctggactagcagcagcagcagaacctgagaaccttttataagtgcaaattctcaggccccaccctggacatggtgaatcagaaactctggagtagggctcagcaatctgtgctgcagtcatccctccaggtgttcaagaacctctggcatacagcaggcagaaaaatgtgtttccttctgtaggtccaaagccagggataccatatgttctgtcttgatatgaaacaatggcatgcaattaaaagacataaatctccttcctgctcccaccctccatccaatgtgttttatttttatgagttaaataagaaaacaaacggcaatcagagattcagcctaaaaagtatgtttacaagtgtcagttctcatccagcctgatctcacacaataccatttacaccctcttccctctcaggttttttaaaaagtgtcttcacaatgtaagtctcgggcacactagcagttctataataaaacaccaagtagatcagaatgtccaaacttactagagaagaaaagtggaatcactggctgtattttcaagttgcattcaacaggaaatgtaagtttttcattcttttcaccttcacacttcaatagcattaaatcagaatactccattcttccaaagcctctagccaggcaaagttttactgtattacttcttgctttcaatagatataaagcagagtcctggtaggcacattttgtatgcctgcaaagatgcagaagtaaacagttccatctattcaatattaaaacaaaagtcctgcaaacctcggatggtgagtgtaatacttcagcactagcaccaaagcctcaaatataaacagataccaatatcaccactagcaaacaaaatgagccctcggccaggagcagtagttcacacctgtaatcccaacactttggcaagccaaggtgggaggatcactttaagtcaggagttcaagaccagcctgggcagcatagtgaattcacatctctacaaaaaatcttaaaaattagctgggggtggtggcacacacctgtagtcctagctacttggaaggctgatgtatgaaaactgcttcagctcaggagtacgacgctgtggtagctatgatcatgccactgcactccagcctgggtgacagagcaagatctagataattacagtctgtcctgctcctgtttatgttaaaatgctttcaatcagcaggataaaaattaagtgaaatgtgacttgggagcttggccagaaaataggcaatggagaaacaggcacttcccacaagaataaaaatggccaataagcacataaaaatgattcaaggccagggccgtggctcacgcctgtaatcccagcactttaggaggccgaggtgggtggatcacctgaggtcaagagtttgagacgggcctgaccaacatggtgaaatcccatctctactaaaaaatacaaaaattagccaggcatggcggtgggcacctgtaatcccagctactcgggaagctgaggcaggagaatcgcttgaacccaggaggcagaggttgcagttatccgagattgcactgttgcacaccagcctgagccatagagcaagactccatctcaaaaaaaaaaaaaagtttcaaaagcactagaaaccaaagaaatacaatgaaaacaatgagattttctccttaaatatcagcaaagaggacaaatggaaacgggatactggagctctgcccctgttgggagtataaactgaaccaatttttctgcaggataatttgaaaatttctattaaaaatcttaaaactattttatgttatttttctccagaaattctacttctatgacttcagccccaaaatgcttgcttgcgtccattaaaatatatatataagaaaatttacttctggggtggcaatgattaacttaatacacatcgagcttttaaaaagatgatgccaaggatatatttactgccatagaaatatgcccaaaacatagtgacaaaagactatatattacgattctactttttaaaatgttcatatgcataaaaaaatataaaaagcaacaaaccagaatgctttcagtggcaaaattaaagacttttcttcatattttgtcttccaaattattacaaaaagaatgcaattttctttataatcagggagaagtattattttcatttatttacatataaatttcttttcttttccttatttcttctaatgtatgtatcacatgtaccctaagagcttgaatccctacttcttgaggtaaatcagaccatttctgtctctatcaacttgccttttttggacatttcaaatcaacagaattatacaatatgtggtcacatgtctggctttttacttagctaaggtttttgaggttggtccatgacatataacaggttttggtagtttgttcctttcattactgagtagaagtccattgatggatatataccacattttgtcagcagagaacatttaaactttgctttcaacttcccgtggtctaaatgaaaccgctggaacacaggacttacagtgaaacctgctgtgcatgtcaaaagaactacttatcagaaccagctttgtcatcaggagcctgaactgctgcagaaatttttatcattttgcaacttcctttttacaagcagcttttgtgctactacacatcaggacttttgaagcatctgatacatccatctaataagtatgagcatgtgtctgagtggacaagtacaaccatctatgctacactgcatattttttcctcccccagactggaccagggaatctctcaactttctagagtatcctgtctccattgacaaagctgaacagtattaaagatcctgctgcctttgttaggcagatttggaagggaggcccaacagcaagggtggagaggaaaaagagaggggagcttgtggaacaggaagccccctggggtctgcacatggctcccagctgttgaggatgttgtggatggggaagtgctgatggtgtcccgaggcaagcctagcacctgcactgggcccagaaggtcttgactttggccccttacccacgttccagaagtgtttacaagctggttttgcttttcttcttttcccaaataatcattacttggtagttagttattaacctttctttgggagagggacagagctttaaaactgaagaacataattttcattaaaatatcaaaaatggaaaaaagttactttgtaaacaatttgctatacaaaccaaatggcagctgttgagaatctcaataaagtgttaaatgcatttgctgctgttagaagaaatacagtaaaaatatttaaaataaagaaaaaaatttgctggcagtggtaccatttgcccaaggttgggttgctgtgtcgtcatactgtggtggggggtatatgtggtgtatatgtgtgaaactcttcatctcaggatggatcataatgtgagctgcagttttccttccaaatagggttacaaagtagtaaaacatgggcttggaagtgacagacctgagtgaatcagccaagcttaaagaaaaacccaataaaattaacttttaataatcctgacgttggtttttgaaacaatagatacaatgatttactctaagcatcaggttatgattttgaatcagtaatacacactgtctcgacctttttctttttttatggaaacagaggtttcacccagaaaactccaaaacagtgactttttttttttttttaagacagggtgtcactctgtcgcccaggctgcagtggagtggtggatctcagctcactgcagcctcgacctcccacctcagcctcccgagtagctgggaccacaggcaccaccgtgcctggctaattattgtattttgtgtacagacggggttttgccatgttgcccagggtggtctcagacttctaggctccagccgttcacccacttcagcctcccaaggtgctgtgtgtacaggtgcgagccactgtgcccaacctgcattgactttttaaaacataagttcaagcatctcttcctaactcctttaattggaggtatctcttctctcattctcctcatctttggtgttcccccagagttcactgctgtctggatgtacaacatatatttcaaagtcaaggctgggctgggtgcagtggctcacgcctataattgcagcactttgggagtccaaggcaggcagatcgcttgagttcaggcaaggtaaggcaggctcccaaggcagagactgaggctgacccctgcagccccctactgcagggaggaacaccgggataggcaagggtcttaacctagaaagccccagcagttcctgtgaccattgaggcttggcggtggtggaacccaggaatggtctttgaacccaccacctggaaggggagccaaggatagtcctggcccaaaggctcccctacctgcaggcagtgtggaggcccagtgagtggaccccaggagcccagaccatgagcttacctggccaaagacagcagccagcaccaagacacgaaagagggcgggtagaaagatcatcacataggggttgactgcggccggcaccaggttcctctgtacttctggaacacacaggcccctccttcctatccctgaagtgcccctgcccctaccccagcaccctgaagaccagcccaatatatgcatttgtcctgggtcagccccactgtccaagcaactgcaatttctcactagagagccagggcagggcagggtataggaggggtccctggaagatgccccccagaatgccctgatgcctaaaacgttccccgttgggccttctcagggagggagggttaagacagccttgttctctccagctacctccatcaccactggagcccttacgggcgtcaggggagagaattggctcactggagccaggaacagcatggacacagccctggggctgaggctaagtgggctctgggagaccgtcactctctcttcaagctttggtctcctggccctctacaagccaggctgtttcaggctttgcgttaggccttgctcagagacagagttgaaacacagctggtggacacagtgggctttagggaggtggcacgtacctgggggtgggggctgggtaacagggaacggaggccctggggctagcatggcctgtctggaggtggcacaatgggacctgcaccacatgaggacagagggtccacctggaggagtggatcagccagatggccaccaagctggatggccaccgccagagcctgcaggacagcagagggggctaggaagggacagaggacagctgaggggcagggaatgtgggttcctccatacagacacttgagtcttccctaagtgggtcttccccatgggggtgagggggcattcaagacacacctccagcccacctcaaactatcacaggaggccaccaccaactcacacaggccagttgcattctcacagtgaccccagaacagcacagccctgtctttcagataaataaatggagagagtgatgcatatcacagccaggagctgggactcagacccaggtccagctgcagtgctgcctcaatggctccacctgcacctcctccgggactcagttcctgctaacaaatgaacacttgagtatgggtgaaataggtgctattatcccttctggctgctggggaaagggaagcaaggcacagatgacttgcccaaggccaacatatcatgactggttcaaccccatctgtctcagccagcacatccccatggcagaggctttactgtgatccaaacctggaaggtggcactccttccaatgtcccacccagggcacagagcatgcagccccatgtttggggaggtgacagggtggggaggtgacagtgtgggaaacaatctggctaggcgaaggcctcatggagcccagggttccctaggaccaggagagctctggagcccacactgacacccattggaaacctggaatccacacctgcaggagatcaggagaggggttcggcctccgatgcacctgcagcaaggtgagacaggcacaggtgggcgccctgcttccaaccagtgtcaggtgggcaggaagcagatctcctccctgaccttcctctcctgcctcccccaagcagaggagaaggggcagccgcccatcaggccattgcccagattgaagccactgaagctaggtcccaacaggtgagtgtgacccctgactatcccaggcccggcccaaggcagtcatgtctctggtgaggacctggtagacagatgtgatgtccccaagtggttctataaaccttttgaggataatcaaggaaatgggcaagaacatcatgctcagccaagaacctgataggcacaagggggaccagggcaggtaaaagtcagtttgggttcaggcctggcccctggaaggatggtggatgaagagccagccacggtgaaagggaatggatggccacgggctgggtggtcaggactgtcagctcctgcagcccctgcagaacatccgcccaggcctggctctgtgctcagcgttctgcgtggagccacaggtgcctggacaccgatctcaagtagggatggtggtaagaaaggtacttgtggccacaggtgggcacctaagcatgggacagaggggtatcatgccccaaagaaatcatagaggccaagagcttaagcatatgtgacaccatcaataaatccccttgtcctgggtcacgtcaattaagtcagagcctaccctgaccctgaagctgcagctcagtctggttgagacacacagagatgttagtgctgggcagggggcctggcccagcctgcgatgtccagcaaagctgtgggctggacaagaatctctgaagattagtccaggacaaggacagctgtgtctgggcagggagtgggggcaatgcccagggggcaggagacctgaggacctttaggtaggatgccaggtcaggacgtgcagaagagaaggtggcatggcagcatcctgcccgaggccaggctataaacctcggggccgccccgtctagcctaaaccatgctgacacccagatgccatccttcaaatgtgaggcagggctgggagagcccccagacccctcatccctcccatcccaagctggttcccatcccttaccagaaggaaagtgaactcttctatgggacacagcctgccaggttctctatcacctgggggaaggggctgggggaagggagagctgcagctgggtgagaaagaacccaggtcccactctttccctatctgacaggtgacctccggcaagctgctttctttgcctggggctaaggagagtcacaggggagcggccaggttaagagggctccaccttggagcccagagctacccacagagaaaaccccccatcctcccaattctgctcccagctcatgctgctgggataacatcccccccatcagagaggccgtgggaggcagaggctgacctttgctccttcaggcccctcagcgggtttgggtccaccttcatcatgatcagggggcgagtccctgggattgcaaaggtgagggacagcttcttgggctccaggtgctccaagggagaccctgcagggcaccagagctagaagagtgttagggaggctgggtgcagtggctcaggcctgtaatctcaacactttgaaagcctgaggtgggcggatcacgaggtcaggagatcaagaccacgctggctaacacagtgaaaccccatctctactaaaactacaaaaaattagccgggtgtggtggcatgcacctgtagttccacctacttgggaggctgaggcaggagaatcacttgaacccgggaggcagggctgaacagtgctaggacctgagctctgcctggccatggtgactctgagccacgtaaccctacgttagtctcagtctgtcactgtgtctcacgggggatgtcagcattacttttggagtcaaagtaggtaagccagggtaaccagagttccctgcagggaccaagaccaaaggatgcaggggctgggcctatcccagaaggtcaggctggacgaggggctccatgaagttggggcagctgagggcctgcccttcaggttacaggcatctggatcctggtctagaccctcatatgccatccagagacccaaccctagggaccctacccaggctggtagcagagagtcgatccttgtactcaccccaccaaaagctctgaaatgagggggcctatgggtgggggaaagactcttcagaaaaaggttctcagggtcagggaaggtttgagctgggccttagggcagccagagaggcaggtgacaggtctcctcacaaagcctgccagagaatgcaggaggaacacaggtgtagtggtgagagtgttctggaagacagcaggaagcctcctactcactgatggggctgagtgaggtcaggtccacacaccaggagaagctggaatccacacactggtgcactttgtttcttgtttcagaggcagggtcttgctctgttgcccaggctggattgtggtggtgcaatcacacctcactgcagcctggacctcctgggttcatgcaatcttcccaccttagcctcctgagtagctgtgactacaggtgcatgccaccatgcctaattttatttttttcaagacagggtctgactatgttgcccaggctggtctgaagcgatctttccacctcagcctcccaaaacactgagactacagggacaagccagtgctcctggccatgctggtgcattttctgccatggtgcacaggaagtatgagctggggggcagaatctgctcctggacctctacccaggcctgcacccagactgacccctgggctgtagggagcaggtgtggagagaatgcagcgagcagtacgggttacccagtgatggagacccaggctgggactaggagagatagggctccaaccctcagcctagtggccctgcccaaccccttggcgccaagatgactttctaggaagccaggcatggaggccagcatgcacctgaactgaggacagaagattctgatgagagggagggggaggcctctgacatagtttggatacttgtcccatccacatctcgtgttgaaatgtgatccccaatgctggagatggggcctatagtgtgaggtgtttgggtcatggtgggggatccctcatgaatggcttagtgccctccccatggtaatgagtgagttttcttattttttatttttttattttttgaggcagagtctcgctcatagcccaggctggagtgcagtggcatgatcttggctcactgcaacctccacttcccaggttcaagtgattcaatgagtgagttttctattagttcacaggagagcttgatgcctcctctctcttgcttattctctcaccatgcgacatgtctgctccctctttgcctcacactagaagtaaaagcttcctgaggcttcaccagaagcctagcagatgcttgtacagcctacagaactgtgaggcaaataaacctcttttataaattaccagtctcagtgccaggagtggtggctcatgcctgtaatcccaatattttgggaggctgaggcgggtgaatcacttgaggtcaggagttcaaggccagcctgaccaacctggtgaaaccctgtctactaaaaatacaaaattaggcgggcatggtggtgcgtgcctgtaatccaagctacttgggaggctgaggcatgaaaattgcttgaactgggaggcagaggttgcaatgagttgagatcacaacattgcactctagcctgggccacaacagcgaaactccatttcaaaaccctgtctctactaaagatacaaaaaattagccaggcatggtggtgcatggctgtaattccagctactcaggaggctgaggcaggagagtagcctgaacccaggaggcagaggttgcagtgccctgagattgtgccactgtactctagcctgggcgacagagctagacttcatctcaaaaataaataaataagccagtctcaagtattcctctagagcaatgcaaagcggactaatataatgtctactggacctgacactcagggaagggctggtctttactctgccattaacagccagactatgacagagttgttcccctgctctgcctcagtttgtcctctctcagctgagcagagcagggataattgcttctcatgtgggccacaggacaaaacaaagccctgagtcccacaggaagataggtgggctatgtccaagggaagacagaagtggggcagtattttatgtccccagggtggcagagggacatggaaaagatgcctcctttgtggacaaaggagaaaggaagataagcagagaggcgccagacacccgcctcacccccacctcccccaccccacaccaggcccattcccactcagcccccaactcaggctgcaccattccccttacggtcagcatgacttcccagccaagctgacagaagctgacagcttggattcatcagggacagcgcgtagtgtaggtgatgtgcaggatggaagtggagaggggagacgggagccgtggtgtcaggtctggggctgccaacatggtacctgccctggccgtgggcagaccatgctggtccaccctgccagatgtggcctctaattctaaggtctctgagttccaggccaggactggagccatactccccttggggacaggggacacagtacacatagacattacttgtgctttgggcaaagccagctggacaaatgaatgaaaggggccctgctggagggtaaaactgggcctggactactcagacctgcctctgtgacaggacggtcccatccttccaatcagactcctgagctggaagcctacccagccagggagtggggaaggggtggcctgcagtctcccttgagtctgtagcccctcccacccaagtcagctccataaaaaaagatgcagaaaccccaagtgctcctcccagctgctggctgcttcccggcatggcctgaaggaccctggatgaatcaagacaggcctgccagcagctgggggaagggggaaagctgggtccccagggtggatgcctagcaggaacgtgcaggcatggcgagtgatgggccctcagggctgagccccttctgcccaggggaccttggtgacacacctgctgctgagctcagcccaaggagtaagagcctggtgccaagtggcctctctgcttatgaagacagtcctgggattgttacccctctgcccagggctcaagtatccaggctggggaagggccagcagtcagaaagaaggaggccgtgggtgtgggtcccctagcagtcaggggccttggtggactaagcccctatgagggggatgagagggaagggagactgagctgtaccccctaccctgagatctgtggtaccaggctccagagggggccccggggggagaccagcatgacaggaactgctacgatgcctttgggcacctactctgcagggctgggccagcctgaggttggcagcagaggggtgggccaggggccacaaggaatgaagctttgtttggtagagctgtgaccctcttcatcctcttctgaccccccagctgacccttgtcctcagatctctgcagaactttgaccaagcggtggtggaggaattccagtgggtccggggtggccctgggtgacccagggctcataccggggttctggggttgaggacaggaggctggaagagatgacctcccctagtcccccaaggctgcacagacccctgaagtctgtgataatcctctcagcaggctggacccactgaccgccagagtgggtgccaccttcttcagggtggcgccagcccaggccgtcatgtggcactgtgcacgccagggcctgcacaccctgtgggaggcagcgggcgtcttggtagacacggtcatcctagacctcggtcagtacctccttccctctgcaggctgcctccctctgtccctctgcctcctcccttgggctcgctgcctccacatgccctgatctgaagcctgcctcccctcctcatggagccctctaaggtgctcctagccccagctctctggtcccgcagcaacttctgggcccagattctgtcttctcagaagtctgagaggcagagccccgcctggccatagccttcttgctctgctctaggcagtcctagccccaaagcctccagcctgctggatgcctttatctccagctatgccatggctctcctcatcctgggcctcctgctcatcacagttgcccttgtcctggtgagtgtctggcttggccagggctccttcctgagtggcaggctgagcctttgacgccttgagcctttgagccaagctgaggggtgagcaggcccctttacacccctgatttccccatccaagcccagcgtctcctcatcctccagctggggccgtgggatttggggccaaagagttgggcctgatcccagtgtccccgcccttcttgtcaaggtgctaaacttgagggcatgccttgggtgctgactttcccaggaactcagagccagagagggccaggcaccagcctgaggccaaacagccaggggcttcttccttcctagacccccaaggactggacttgcagggctgggacagaggtggggtgggggaaagcaatgccttgtcaacccatgcagggagccccactcccatccccaaggtgcacaaagtcgagaaacacccctgttcccatgtccatgctcactcagggccctgctccaagtgcttggcactcacaccagcctcctgtcctccatgccacaggtatcggtctcatttacagagggggaaatggtggccaaaagcctcccccagcacacacggctagaccacacagaggtcttaggtgcagctgaggggtccacagtctctgctgtcccttctgccactcgtgctgccagggaccacgctttggagagggaggaatgagagtgagctgggtgctcacacatggggcacgggggactaaggaagggtcagccaggaggaaagggcaaggtctgatcctgtacgtacacatcacagagcgcgcggggtcaggagaccgagggccacgtcccggctctgcggctgctcggtatgtgactgcggttaaattgtctccctggactctccacgcactttgtgtgctgcgtgcaccttctaggatgagcccggaccctggctggcctcatacttactgcgtaggctgcagacccgcaagtgcttctgcaaggggctttgcttctcctcataacagcagcacgggctggccgcgtgctctgggggtagaatggagaagctctggaggtagcaggtgggggctgggcttgggctcctggcccagacagggcagggtacacctcagggtcacagggcctggcccactctctagcagcccttggcccacaggctgcccagctgcccacccacaacccgtacctttgggcagccccagctgctgcagttcactggccaaggatttgccatcgacactgtgcttggccgcaccggagaggatgaaactcagcactgccactgtggccttcacatcgcctgactctcagggacccatgcatgggacagggggtgtcactgtgggcccagccacctccctgttgccctattaacttcagctcaaagcccccaggcctcctggagccataggcactgctactgctccaccaggagctggcagaggacaggaaggtgggactgtcaatgtctttctttccctcatgctcctccactagggaaggcaggttaaggatactgctgggatgtgtgtgttggcgggggggtggggggcgggctctgtaccaggcaccaggccgaggtcccagggttgcctggggcctgtgaactcagcggggtgctcaccaaacttggcatcagctgtgagtttcaggatcttcttatactatggggaaaggagaccttcagggggtgccaggtccctgctcaccagcccctcacccccagcctggatcctgcaataaggaacagacaggctggaaagaaggaagggaggtacccagagaggttgagaggctggctcacccgtctccccgggcctagtgcagagtttcagggcagtggtggtcataaggtcatgggacaatggggtgctggatcttgtactcacatcaattccctgtcccagcagctcctttagtacctggctgcagagcagctgcaacttcacagaggactggaaaggaagtccttacatcagccaggctggcaaacctcaccccttcttcctggggactggctcaaagcaggccagccactgatcaaggtcacaaagcatggtagcacaggctgagagcactgaggccctagccccagagaaacctcaccatcctctacagccacaatccccagcccaacacccctcctccacccagtgtagaccctgtgcactcaaccatcttggccagcgtgctgatctctgccaggacccggtcaggacagtccagatcaccacagaaccgaaacctctgcaagggagggaggcaggtaatcaggctggaaagaagactgaggtgtggccaggatccctgtgtctcccacactgctgcccagcagggacccctggtccccgacatagatggataccctctggccacttgttctcccctatcaccaggctgttgagtaaactctacctgacccaccctgccaccaaaccctgctctgaggtctactccaggcattcatctgctcagcaaacatcaattgagcaccttctctgtgctagctcccactctaagtgctgggggtacagcatgggataaaacaaagtcctgggcctcacagagacgagtgaactctctcccttcttccccatacccacacaactccagccactccagcttccctgctgcagctcagggacaccagccttgcttccgctgcactctctatgtggcttgctatcctttatttcattccactctctgctcaagtgacacctcatcagaccagcccttctttttttttttttttttaaagacggagtctcgctctgttgcccaggctggagtgcaatggcacaatctcggctcactgcaacctccacctcccgggttcaagcaattctcctgcctcagcctcccaagtagctgggactacaggcatgcgtcaccacacccaacttttttgtatttttggtaaagacagggtttcactgtgttggccatgctaatctcgaactcctgacctcaggtcatctgcacactttggcctctcaaagtgctgggattacaggcgtgagccactccaccctggcaggccagcccttcttgatcatacttcctaaaacagcccctaacacaaggaaattttgggggccggtggatatattcgttatcttgattgtggtgatccaacagtcaggaagatttggcctttacttgtccagactcatctttccctaacctccagatgatactctcccagctatgggaaatgcattcattcctggggagccatgctctctctcacctgaagtctctgcacatgctgttccctgtctgaagacacacgcctcccaccgttgcctcccaacccctggtacacaaactgtacttcagccagccaactcctgccatcgcctttaaggttgaaggcatcctcaggaagcccccttagcactacacacaaggcgcagttaggtctctgcccctggagccttaactatgactgccaattcaagcctctgatttccccttcccgcggcagctcaagtcctcccagtgcctagtacaattcatggtatagactaggcactttgaacctatggatggatggattggatgaatggatggataagtatcagccccaaaactactactttctggatctgaaaagagcggagtggcttcctaacagtgtgcaagagtgagcctgattctagcactttcctgtccaagtcccacagcagggctggggaagggggtgtccttgggaggtccttttggagctagagaagacctgaaaggactcccagctccagacaagccctagttcctgccccaggagtcaggggcccttccttccgccagggaagcagggaactctaagccggccggcctgctctgtcttacccgccccattcgggagagggatggcggtggacttttctctaccagacctgctgccctgacgcccgcacacactgtgtttgcggagcggccagtgcagacaacctcaacccgtttccggagccactggcgccccctcattcccgctccagcagcccatgcccgcttcacccctggtgcctcatacatcgcgcgaggaagccagggcccgggaatttctttttccggtcccgccaggtcagctgagtcgacgatcacgtgacttggactaacggcctctggcggggcgggacctgctcgagtgaggccgggagcggaccgcagcccgctggaggtgccgggggcgaaatgctggcgtctgctcctccgtctcccagaatcctgccctggaaaaaaccagcgccaaccgccggtttaactgaggacggatttaaggcattacgaaagacagtggaagttatttcttttacttttattttcgttaacttaagggggtaggatcccgggagccagggagattcaggtcattgccatgttttccactgttaagcgaatagcattatacacagctgcgggctgtggcaaaaaacattttaaaaacttttcaaatatattacacatacagaaaattgtacctattagaaatataaagcttaataagttttcatcaactgtagacctcacataaccagcacccagataaggaaataaccaggtaacttcttcaagtgcatgggtattttatttcattttgatgaatcgtctaggtgcctagtaaaaagggctgtcataattaacatgctcaggaaaaactccccacagcttcaacatcactagatcttatcttaatttttgccagtctgatgggtaaaaaaaaaatcggttgcttagattgcagtggtagtctgattactggtagctttgagctaatgggtagtctagaacaactaagtttccgacgttgacttgaagaggcaaaaacaaaaagacaaaacaacaacaaaaatacattaaagaataaactaataaccaaagaagaaattgaatacagtcgtcgcttagtaacctcaagatactggttccaggaccccagagataccaaaattcacagatgctcaagttcctgatataatgtggcatagtatttgcatataacctatgcacatccttccgtatactttaaatcatctctagattgctataatacctaatacaacataaatgctttgtaaatagctgatataaagtatttttaaatttttgtgtttttttattgttttactttttccaaatatttttgatgcacagttggttaaatccaaggacccagaacccgaggatacagaaggctgaccatagtttgagctctctcctcaattccatgcctatcccatgcaccaggtgcagctggttttattgttgcaggctttcaagttttcaaaagacagacctcatgacaagtaaactgctctatagaatagaaatagaaagtgtcccaattcatggtaaaattgaactcatttctgaagagttattttacaaatcataagcactatcctcttgaaagcaacagtgtgttaagttactagactatcctataccatgtcaaagaaaaattttaagaacataagacctgtaatcatagcactttgggaggccaaggccagtggatcgcttgagcccaggagttctagaccagcttgggcaacatagggagaccccagtctctacaaaaaattagctgcttgtgctggtgcacacgtgtcatcccatctacctaagaggctgagatgggaggatctcttgagcatgggaggtggaggctgcagtgagccatgatggcgccactgtactccatccagcctgagcaacagaatgagaccatctcaaaacaaaaaaaggaaaagaaaaaaagctgggtgcggtggctcatgcctgtaatcctagcactttgggaggccgaggcaggcagatcacctgaggtcaggagttggagaccagtgtggccaacatggcaaaacccgtctctactgtaaataaataaatacaaattagctgggcatggtgctgggtgcctgtaatcccagcctcaggagactgagtcacaagaatcgcttgaacccgggaggtgggggttgcagtgagccgagattgcaccactgcatttcagtcaacttgagcaacaaggtgagaaaaaaaaaaaaagatgtaggaatggttcaacttttatttcatgctgtcagtaggttaaagaagagaaaaatggatagttttgggaccattttttatttaaaaagaaaattaggaacagatgaaaactgtcttatcttaagagtatttgaaaaacaaaacagcaaatttaacattagacagacaaaatatttaaattcagaaataaagttaaaaggtgggtggtgcgcccttttaatgtcatactgagcattgtttcatagatacttgttttactattaaagattgactatttagagcagtgtttctcaaacattagagtgcatcctaatcacttgcaaggcttgtgaaatgggctgctgggccccacaccagagtttctaactcaataggactgaggtggggcctgagcattgcatgtctgtgttcccaggtgacactggtgcttccaatttgagaccatggtttgaaaaccactaatgtagggaaatatactagagaatatgttatgaatatatgtgagaatatgtatatatgttaacgtacagatttcagtacagtagaaaagataactcccaaagatgacagttttatttcccaataggatttttttttttgagtcagaatcttgctctgttgtccaggctggagtgcagtggcatgatcttggctcactacagccttcacctcccagttcaagcaattctcctgcctcagccttctgagtagctgggactacaagcacccaccattgcgcctggctaatttttgtatttttagtagagacagggtttcaccatgttggccaggctggtcttgaactcctgacctcaggtgatccacccacctcagcctcccaaagtgctgggattacaggcctgagccaccacgcccggcctccctttaggatattaacaagttttgtctctatctcagaatgcatttcggaatgcccttcctggagcactacagacactgtctctcaaaacgctccttgaactagcttcaccgtgttgctgactcccttgtaaattaaagaaaatatcttatacgtattccttcattatttgtatgaaagtcaagcttttcatattgtgaaaattatacttcaggctgggtgcagtggctgatgcctataatcccaggacttctggaggctgaagtggctggatcactcgaggccaggagtttgacaccagcctagccaacatgtcgaaccccatgtgtactaaaaacaaaatcaaaattagctgggcattggtggcacacacctgtagttccagctgctcgggaggctgaggcacaagaattgcttgaacccaggaggctgaggctgcagtgagccaaggttgccatgagctgatattgtgccactgcactccagccagagccagagtgagactctgtcccaaagaaaaaaaagaaagaaaattatactttgatacagtatgctaatataaaggatatgatatggcttggttctgtgtccccatccaaatctcaccttgaattgcaataatccccacatgtcaagggtgggaccaggtggagataattgaatcatgggggtggtttctcccatgctgttctcatgatagtaagtgagttctcaccagatctgatgattttattacaggctttcccctttgctcggctctccttctctctcctgctgccctgtgaagaggtgtcttctgccataattgtaagtttcctgaggcctccccggccatgcagaactgtgagtcaatttaaacctcttttctttataaattacccagtcttgggtatttcttcatagcagcatgagaatggactaatacagtgtactaataacagcccagacagtagtatacaggtactactatactttgatgctagaggtattcccattaaggtcaggagcagtatgtgctatcattaccatgatctaacattgttccagagggttttaggtcagcagttctcaactggaggtgattttgccgccctggggatatttgacaatatctgaaatcactttggctgtcacactgaggagtgctgctggcatgtggcaggcggaggctggggatgctgctaaacatcctgcgaggcgcaaacagctccagaacagagaactgtccagccctaaacatcaacagtgctgctgtggagaaagcctggtctagacaaataaaacatgggaaatccattaacataaatgtgggtggataataaactggtatttgccaatggcagtctagctaggaggtccaaaaggagcacctgaagaacagttagattttgcaggggctgcatggtggctcatgcctgtaaccccagtgcattgtgaggtcacattgggaggatctcttgaggccaggagttcaagaccagcctgggcaacatagtgagaccacatctctactaaaaattaaaacatcagccagatgtggtgctgcgctctgatagtcccagctgctgaggtgggagtatcgcttgagcccaggagttggaggctatggtgagctgtgatcatgccactgtactcaaaaaaaaaaattttttttctctgttgcatatggggtcttgctatgttgcccaggctgttctcaaactcctggcctcaatcagtcttcctgcctcagcctccgaaagcgttgagattacaggcgtgagccactgcccctggccttacaaaataaaaattaaaaaaagaagttacaggatgttatgtggcccgttgaaagatgttggaaaacagttgcgcatgtgaccccgctataaccagttataaaagtatcaggattaagaaatgtactgcatctggctttcccaagtttaggatcctgctgaaagaatgagatggatcttttcttcctccgctcctcacctccctgcaagaaccaggactgtgcattttgacgggcaggctcttacccctggcaggccacagggggcatgcaaagcatttccgtgtgtgttttctgagtactcggataaagacccctgtccaggcctttgtttaggatatttggcccatggaggaatgagggtggaatcacctgggaggggcagaggcttcgaatggaaggaggagtgacctgagctccaggttctgggcctacactttgttcccatgcagcaccccattagtggtgactggggcctggaagtcagggaccttggtggccaagtgttaggtggacaggaggagctgagggaggtgaggggcatctctccaggaccgccccccgccccgtccccaaatcaatgccctctgatggctcagacatagccccggccagcagcagtgtgggtcaggaagggcgaatgcagtcagcacggatctgctccatagtctccacctcacttcatctcagtttggaaggtgtgagtccccgcagcactgataggatatcctgtcagctgagaacattcagcttgatttagaaagataaggtgggacatctcttgggcatggcatgtggagcagtgccatccctctgtggcagcgagccaagcaataaaccagaatgtgcaaagcctgcgtcccagaatcaccattcctggaggaaaagcctatattgtcaagatgcccactcctcagttaacccaaacattccacccagcctcgaaaaccagtagaactttgacattaatatactaaccctcaagtctatacagaaatgtgtaagaatagccacatactgtaatgtgcggtcattgagagagaggaggccgtcagaacaaatggaaccaagtctagaaacatgtctgtctaggcgcaagattccagcatgtgtgtcagccagggaagcagaccaggaggagatatttattaagatttaaaaccgggctccatggctcaggcctataattacaatactttgtgaggctgaggtgggaggatcacttgagcccaggagtttgaggctgcagtgagctatgatcgtgccactgaattgcagcctggatgacagagcaagaccccgtctcaagaaaagtgctcagatgcacccttacatgaagccaccttgggtacagcttccaagactggtgaggccttactcaggaccagggggcccagccctagctcagcttctaccacctgagtggcacctggaggtggtcacagtgtcctcagtccagtctctgttgggtttcagatcccctgatcatcatgccttttttgcccaagctctgcctcattatggccttcaatgaccgcagcctcttccacctccccaaagggacccctgctcatgctctccagcccacaggagtgcctgcttctccaggaagcccatcctgttggctctgggctctatgtaggagagctgggcaggctggatcccaccactgagttcagtcttgggggtctccacccatgctaggcttccactgatgggatataagtggccaggggggttctttacgtccacacaagagccccatggtgaccatgaatggggttctgagaggttaaatgacttgcccagggccccagagctggctagaattcctgcactgccatatccaaggccacgtttgggcctcccacctgggggcccggacacccctctgcatctactaggctgggaaacacatgtctgctgcagcttcctcccagtgacttacagcagctgcagatttctggggggacttctacggggcccaccacagcagagagccgagaattcttacagagcccttcattctctctccgcccccttcagctccgaactcgtactagttgctctgatataagaacagaccttggtgagggtgttggggctctggtcagtagcccaggccttcaggaatcaggtgatgtcaatctggagaggaggtgcctgctggagggactggggggagcaagcatggcccagggccctggcctcctgcaggggcagcccctcttccttcccagggtcccctgagaatccaaaggcatccagggtaaagtgcactgttcagctgtgtcctggggtccaggaaagccaaggagaagttgctccacctgctgtccaccaggcatcccggcaaagaacagtctcagcccaccccagcccaacaccagatcccaggaactgatccacctgtaagagggcagcataagactgccccattgtccccagagagtcccctcagtcatgggctgtgaccagggtgcaggtgggcccagcaggctggcccagtgtgggtatggctgtccattggtcctctgaagagcctcaggggcttgtggcagatgatgtgtgtctgggcttggaaatagaggatgtcccccagccagagggcaggggacacttgttttgcattccagtcctctgcaaggacagggaccccaggctctgggcactccagctctgcctgccctacccacagcttaccaccatttggcccaggcaaatcgtcctggctcccacagagggagccacccttcccacctcctgatgtttgcccgcaccagtcaagttccattctggaaaaaccctccacgtccttgggaaggcacctcctccttgaccttttcagagctatcgtccccactttcattttctacctatcattcgatgcagagaccagcttcttccctgggccagggctgctctggaggcagggaggtcgtggccaggccatggggtgtagcagagcactgggtatggatcaggctctccaggtacacctgggcagagaagtcagagacccacaggtgaatgcccctccttccggccccacccacctcacaggcagagggaggcttcacaaggaggttgaggtaaacaggagagcccgggtcacctctgtctgatctcctgccctcttaggagaaagccagaggttggagctgggaggtgtcgacagccctggcccagtccaggtttcactgatgaggctcagggaggggcggggtcagcccaagtcactgagtccataagggagggttctgaccataacccaggacgctagagttaactgaggctgcatccctttcccacccagaccaaggtagggcttctggcttctaaggctgaggcccagcacacctctccctccccttgcctgcagctgttgtcacacatcaaaagtgagcttttccccaaggggctggaggcacagctccttggactggaccaggtggccaatccaaacaagtccctgtgtgtccccaccagccaggaattctcacgccgcacagcagctgggggcaccaggataccctgggggattccagggatgagccctccctgaggcttccacagcagcactgccgcccccagaccccccaaagccccatgtccacgcagccctcaagaatctggcccctcacacacacctgccccactcctcccacctggctttcctgtgaaaagtgaaactggttccacctgggccagctggagaagggcctctggaaatcaccattttggggattcattccaatcatccattcatttattcaccaaatacccactgtccacctttctgtaccaggccaggggtaatgggtcaagcggaacacatgtcccaaggagttttcctctctttagagacagacaggtggactctcagactatgaggtgccctctgggctagggggtgcccagggctggatgcaatgtagggcctcgcccacaggaggtgctggtgggtacggacgtggaggccaccacagggtgagggtatccagacagaggacctagcatgtgcccaggcccagggtgtgacctggggcaggtgcggggctgctctatctggaaggcttcctgactctgccaacaataggccgtggctggatcaggcttcatgtcaatttttaacatttaataccttttgattatgtaactaaacattattgtgttaaaaattaagaaatatagaaaagttaaaaacacaaaagaccagcaaacaccttctctccctaagtaactgcttcaacagtattttctgactttttttctcatgtatctgcagctataaacataagttgcacaagatagtatccttccccatattctgttttggagctggatttttcactcagcagtgaatagaggcaggctttaaacaggccacgcattgtgagggccctgggaaaggagactgaccatgttgctgggtgaccttgggcaagtctctccctcctcagagcctggatttcctcagtccggtgaagggcaggaagggctgcagtaggactacatcagcgcttcccaaactcagaaccgccacgtggagctgtgtgagctgtcactgcacaaccccaggggcaggagcattcttgtcacagcctctgtgagtggggctcctgcccaaaagtgtgctgtgccaacctggggcccacaggaggattttaggcgatacggggatgaattgatttttaccatttccttctatctgtagtgaatgagaccgattctcaccgggagggcttgttaaaccacaggtcgctgaacccacgcctcagaggttctgattcaggaggtctggggtggcgcctgagaatctgcatttctaacaagttctcaggtcatggggatgctgatgctgttggcccagggaccacactttgagaaccactaatcacaaatttccttttattcatttatttatttaacgcagggttttgctctgtctcccaggctggagtataatggtgcagtcacagctcacggcagcctcaaactcccaggcttaagcaatcctcctgcctcacttcccaagtagctgaaaccatagacgcatgccaccacgcccggatgtttttttattttttgtggcgacagagtttcaccatgttgctcaggctggtcttgaactccttggctcgagcaattcacctgccttggcctcctaaaagtttcctttttaaatacatgtatttaggttttaaaaatgagttgacttaaagcacaagaatagatcttcaacactaaccactggggaaatgcaaattaaaaccacgtaagatatcactacagatctattagaacagctcaaatcaaacatagtggtaatatcaaataatggcgaggatgcagacaaaactaactcatacatcgctggtgggaatataaaatggtacagacactctagaaaatagtttggcagcttctttaatcaaacatacacctcaatatatgacctagcaattgcttctgggcatttgtaccagaaaataaaactgatgtctgcataaaaactcatacatgattgttcgtggcagatttatttgtaatagcctcaaactggaaagaaccaaatatcccccaataggtgaatggtaaagcaaactgacatatccattctatgaaatactattcaacaataaaaaggggaccaggcacggtggctcacgcctgtaatcccagcactttgggaggccaaggtgagcagatcatttgaggtcaggagttcgagaccagcctggccaacatggtgaaaccctgtctctacttaaaaaaaaaaaaaaaaaaggctgggcatggtgtctctcacctgtaatcccagcactttaggatcctgaggtaggcagatcacctgaggtcaggagttcgagaccagcctggccaacatggcgataccgcatctctactaaaaatacaaaaaaattagctgggcgtggtggcgggcacctgtaatcccagctgcttgggaggctgaggcaggagaatcacttgaatccaggaggcagaggttgcagtaagccgagattgagatcgtgccatcgcactccagcctgggcaacgagaggaaaactttgtttcaaaaacaacacaaaaacaaaaaacaaaagccaggtgtgttggtgggtgcctataatcacagctactcaggaggctgaggcaggagaatcacttgaacccaggaggtggaggttgcagtgagccaagatcgcgccactgaactccagcctgggcgacagagggagactccatctaaaaaaaaaaaaaaaaaaaaacagaaaagcaataaaaaggagcatgcacaacttggatgtatctcaaagggcatttgctgagtagaaaaaaaaagccaatctcaaaaggccacatactgggtgattccatttatataatgttcttttttcgtttggtttttgttttgtttttgagacaaagtctcactctggccctactggagtgcagtggcatgatctcggctcactgcagcctccacctcctgggttcaagtgattcttgtgcctcagcctcccgagtagctgggagtacaggcgtgcaccatcatgcctggctaatttttgtatttttagtgtagacagggcttgccatgttggccaggctggtctcgaactcctggcttcaactgatccacccgcctcggcctcccaaagtgctgggattatgggtgtgagccaccatgccaggcctctattcattcattcattcattcattcattcattcattctttgagacagagtcttgccctgtggcttccacctcccaggttcatgtgattctcctgcctcagcctccacgtagctggaactacaagcccgtgccaccatgcctggctaatttttccattttataatgttcttgaagtgagaagattataaagacagcagattagtggttgtcaggagtaggaatagtggaggggaagagcctggaataagtacagaggaatagcaggagggggattttcgtggtggtagaacagctctgtatcttgattgtagcagtggttaaaggagtctacatacgtgataaaatggcatagacctagacatgtgacattgttagatattgttctacactaatacaaaatagaacctttggaggaaactgagtgaagagtacatgaaacctctctgtaccatctttgaaatttcctctgaatctatatttccaaataaaaggttaaaatttttaaagttgctttaggcaaaaatattaaataaaaataatattgattgtatgcaggtctggaaaaacctttgacacattggatgactggcatctataacccattcaatgcacaattgcccctggccaggccgtgtcctaggctaggtcacctgctggaagataggactctggactatgtcctgcttggctttagagtagagatgccagataaaatataggaagcccagttaaatttagatttctgataacaaataattatttagtaagtatgtaccatgcatatttaggacatacttatactaaaaatcatttctctaaattctcttttaaccatcttcaccaagggttgatatttctctaaattctttaacgtatgtatgtagttactttaaagctcttgcctgctaattccaatgtgtgagccatttatgggtctgcttttttttttttttggaaatggatttttgctcttgtatcccaggctggcatgcaatggtgccatctcagctcgctgcaacctccacctcccaggttcaagcaattctcctacctcagcctcccgagcagatggaactataggcgcatgttaccacgcccagctaatttttgtatttttagtagagatggggtttcaccatgttggccaggctggtcttgaattcctgacctcaggtgatccacccacctcagcctcctaaagtgctcagattacaggtgtgagtcactgtgcccggccctttttttttttttttttgagacaagatctcactctgttgtccaggctggattgcagtggcatgatctcagctcactgcaacctgcacctcccaggcccaagccatccttccacctcagccttccaagtagctgggaccacaggcacatgccaccagcagtcctgactggtttcacggaagacaatttttctacagacggggtcaggggtggtggttatggtatgaaactgttccacttcagatcatcaggcattagattctcataaagagtgtgaaacctagattcctcacatgtgcagttcacattagggttcacgcttctatgagaatctaatgcctgctgatctgatggggggcggagctcaggcagtaatgctcgctgtccaccactcacttcctgctgcgcagcctggttcctaccaggtcaccgacgggtacagtccacagcctgggggttatgggcccctgcacaccaccacacccaactcagttttgaatttttagtagagatggggttatgccatgttgcccaggctggtctcaaagtcttgagctcaagtgatctacctgccttggcctcccaaagtgctaggattacaggcatgagccaccatgcacggtgcatctgtttgtattgactggttttctcttaattttaggatatattttctcgctttttcacacatctagtatttcttgagctgttggacgttgtgaaccttcattgtagagatgtgggttatgttatcctactctagtgttgagttttattttggcagggaattaaattgctgttgggttaacttgatcttgagtgtcaaggctacattttaggttttgttagggtgagctgtttttcagttttgctcttattcctagagaatcttccttaatcctaaggcatggccttctaggccctctgtgaatgtctgggatattcatcaagacctgagattccaagagtggagactctggctgagccagaattcagatgtgtttccagcactctgtgaccactgaaatcgctgtttagctctcagctccccatcagctgttctgtgctgggccttgcagagtctcaatccacacattcagagtttgggatttggccaaggacctgcagcaacctctataagatttctggggcttctcctctgcaactccatcctttctgatactctgccacacacattttagcagccctgagcagcagtctctgtttcctccaccaaacaagactgatcctcattgcctgaactctgcttcctcatgctgtcattgagggtttagaaactttccccaccagaaaaacacagcagtcacttcatgtgattcccttctctcagattgtacctggaactgcctattgcccaatggctgaagacaatttcttcatgtactttgtccagctttgtagttgtttatgctgggagaccatcatcaatacaggtactccatcatggccacaattcgaagtacgattaatatcatattcattctattctaaaagtagagaagacaaagaccaacagttctaagaaaaatggaaaaatatatatgaaagttcaaagaaaaagaagcgcaaatgccactgacacacaggaaaaaatgtttaacttcactgataataagaaagatacaattttaggccgggtgcagtggctcacacctgtaatcccagcactttgggaggctgaggtgggaggatcgcttgaggccatgaagtggaggtggcagtgagccgagatggcgccacttggggtgacagagcaagatcctgtctcaaaaaaaaaaaaaagatacagatgtaaacaacatcctgcaacctctacatgtggccatgattgctaacagggaccagatttgcctcccaccttgaacaactagaaaaatggaacaacatatataaaacaatagttttcagacatcagagaacaggtcgagcagaactatgatccctaaaagaaggtgaaccctacagtgtcctcagtttactgccggaagcacttacaggctccaatgcagggagggaaatccaaagtccagtggtcttggtggattgaggagacagagatcagagcttgggaagatcttcaaggctggtagaatttgtgaggtagagtaccagggaggaggtgggagaagagagcacatgaactctggagagctatggaagatgccctcaagcctttggcaaagggctgatatggatgtatgtgagaagaaagtacccagggaaagaactgccagaaagcagacagaagaatccccggagctcacaacaggctagagagaattcatattctcactagtcagaatgaaaacacctcataatacttaggaaatggaagagaagctttagaaaagtattgccttaatagtggggctaaatgagcactggagtaaaggcttctctgaaactgtcctaacaaagattgaaagcaaaccttgatagatccaacttatttaaagtaacttaactagtgctggaacagagtccctcactatttaaaggaaaacaaaatccagcagtcacgacacaaaaacacaatgtctaccagtaaataaaacattgccaggcaatggccaggcacagtggctcatgcctgtaatcccagcactttgggaggctgaggtgggcagattgcatgaggccaggagttcaaggccagcctggccaatatggctaaatcctgtctctactaaaaatacaaaaattagccaggcatggtggtacgcaactgtagtcccagctacttgggaggctgagacacgagaatcacttgaatccaggagatggagattgcagtgaggtgagatcacaccactgcactccagcctgggtgacagagtaagaccctgtctcaaataaataaataaaataacaggcaaaatagggcctataaccaggagagaaataaatcaatggaaataggcccagaaatgacagagatgatgtaatttgcagacaaggacattaacatattataaatatgctccatatgttcaagaaggctagaaaaatctgaacatgatgagaagagagaaatagaagatatattgaaaaaaaaaaaaaaaaacaacacaggctgggtgcggtggctcacaccagtaatcccagcactttgggaggctgagacacaaggattgcttgagcccaggagttcaagactagcctgggcaacatagggagacctatctctataaataattcaaaaattagccaggcatggtggcatgcacctgtagtcccagctactcaggaggctgaggcaggaggatcacctgaatccaggaggtcgaggttgcagtgagctgtgattgtgccactgcactccagcctgggcacatagtgagaccttgtctcaaaataaaacaaagaagaattactagagacgaaaaagttaactctgcagatatgggattaaaagcagttaaaatactccataaggacaggtgtggtggctcacgcctgtaatcatgccagcactttgggaggccaaggcaggaggattgcttgaggccaggagttcaagaccagcctgggcaacataatgaggcctcatctctacaaaaaaaaaaaaaggaataaaaattttcaaaaaatttaatgaaggcaaaataaagactttttcacacaaacaaaagccaggataatcaccagcaggcctgcactcttgagaagtgttaaaagcagttctttggtcagaagaaaaatgacactggatagaaatttggatctacacaaaggaatgaagaccactgacataataaatacatggataaatagaaaagatcctattttcttattttttgatgtctagaaataattgactgaggcaaaagtaataacattatggggtttataacatgtggaagtaaaatgatgatgagaatggcacaagggacaggtggggaaatgtaagaataccatcattataaggtggcagtcacagttgagggaggtgataaatctctgtgattccacctggaatactgcattgctcctggaagtgggaagagggagtttcagagacttcccctgggctcttcctactatagtggctcatacccacaggtcagggagtaaagtgagagctctgttagcttctaagcatactcatatcaattgcatatttagggacagagaaatgacaaccagatggggctgcagcctcttcatccagggatccatttattacctagccttcacatgtcctcagtcttactggggaggggacatggtggcattgtggatcttatggtggcacggtcagctctaatcctatatgaatgaccctcaaacagtctgggtattcccttttcatcagctacagttactttcatcaatgaccccagatccctttggagaaggactgaggtaataattaatgaatatcatggggtaatgttgcaggatctttttctaagaatacccagcctcccctacaatccatgagctataggtctcaattgtctcagtctgaaaactgggtaggaaattgcaattttttgttgcaaccttctgtggccagatcttgttgatgttgtttcctgaatacacaaatcaggaaatatcttagggctcacacctgtaatccctacaatttgggaggttgcagcaggaggattgcttgagctcaggagtttgagtccagtctaggcaacatagcaagacctcatcttcactaaaaattaaaaaaaaatagccaggcatggtggtacatgcctgtaatcccagctacttgggaggctgaggtggaaagattgcttgagcccaggaggttgaggctgcagaaagctatgattgtgccactgcactccagactgggctacagattaagatcctgtctcaaaaaacaaaacaaaagaaaaaaccaccctagtcaactgcctatgtaactctcccctggaatgccatcagtttgtagctaacacaacagctccctggaggtcagggcatcctggctatcactctagccttcctaccaattaagttaattacatccaccttgtggatgatggtgaagggccaccacctggcatccactgttctcaccttccaccattcccactgacaccacgaagcctggtctcatggcagcatctcctcttatcgatcccggcctaccaaggatagtgccactgagtctctcaaacattcaggtgcccttctcgctagtgtctgctggcatataatgaactgttgggggaaattcagccagatatcaggcaaaattcacccccgatatttcacataggttcttttctattttccctaagtgtcggctggtctgagaaataaagggaaagagtacaaaagagagaaattttaaagctgggtgtccgggggagacatcacatgtcagcaggttctgtgatgccccccgagccgtaaaaccagcaagtttttattagtgattttcaaaaggggagggagtgtacgaatagggtgtgggtcacagagatcacatgcttcacaaggtaatagaatatcacaaagcaaatggaggcagggcgagatcacaggaccacaggaccggggtgaaattaaaattgctaatgaagtttcaggcacgcattgtcattgataacatcttatcaggagacagggtttgagagcagacaactagtctgaccaaaatttattaggtgggaatttcctcgaaaataatggggctgatagagtatccagtgtatcttagtttttggataattatcactaggcatttgatagattggttggagcatctgaaaaaatgggtaggtaattggcaaaaagaaaaataagcaaatgaaggggaaaaatctgaagctattattattattattattattattattattgagatggagtctcactctgtcacccaggctggagtgcaatggtgcaatcttggctcactgcaagctccgcttcccaggttcatgccattctcctgcctcagcctcccaaatagctgggactacaggtgtccgctaccatgcccggctaattttttgtatttttagtagagacggggtttcactgtgttagccaggatggtctcgatctcttgacctcgtgatccatccacctcagcctcccagagtgctcggattaccagtctgagccaccgcacctggcctgcttttattatttttaatctacacataattgtatatatttatgggatacagtatagtatttttatacatatgtacaatgtgtaatgatcaaatcataattagcatctccaccacctcaagcatttatcatttctttgttctgggggcattgaaaatccactcttctagctatttaaaaatatataataaattgtcattaattatagtcacccaatagtgctaaagacactagaactattccttctatctagctgtactctttttttttccccagacagggtcttactctgtccccaaggctggaatgcaatggtgcaatcacaactcactgtacccttgacctcttgggcccaagtgatccttccacctcagcagcccaagtagctgggaccacaggcgtgcaccaccatgcctggctaatttttaaattttttgtagaaattggatctccctatgttgcccagcctggtctcaaactcctgggctcaagtggtcctcccaaactgctaggattacgggtgtgagccactgcactcagccatgtactcttgtatctgttaacctgttagccaacccttggctaccccctcccccttacccttcctcaccgctagtaaacactattctaagcaaatagatcttaaatgttcttaccacaaaaataataataataaaagtatgtgaggtgattaaaatgttaattaacttgatttaatcatttcacaatgtatgcatatatcacattgaacactggaaatatacacaatttttatttgtcaattatactttaataaagatgagggaataattgaatataatgttaaaacaaaaaacaattgcaaaacctaaagaaaattaataatctagagcagaccagccttttatacatgaggtcactgaagtgcagagaggtgaactgacttgtctcatcttacacagcaagtcactggcagagcttgacctgaaacccaaagccaagcgttttctattacctccaggtccttcaggccagccctcccagggctcggccttgggaattggtattggtgacaaagggaataaagaggaacatgcatagagctctccatttagattgacatattcacactgtgccagggcatcagcaagaaacagtgcaggctccaagcgcttgccccaaccccatcctctctcataaccaacttcagctaaaaggtctgagaagataagggaatcttaggtgactctcactagggtgtaaatgactcccaccatgatttttatcttatcaagacataactctaaaaacagtttgatggatacgatgccaggcagtaggatgaagacagatggggaaactgcctaccttaggtcaggagtttgagaacagcctggccaacatggtgaagctccatttctactaaaagtacaaaaattagccgggtgtgatggcgtgtgcctgtaatcccaagctactccagagtctgaggtgggaggatcgcttgaacccgggaggtggaggttgcagtgagtcgagattgaaccactgcaaaccagcctgggcaatagagagagactccatctcaaaaaaaaaaaaaaaaaaaagtcagaccaacccacggggaggcagagggtaggtgaggggggtgtggctgggtttacggtggtgcactcatagagtcggcttgggaacagggagctgtgtgtgtgtggaagttaaaagataggctttggagggacctggctttaaatcccagctttgctgtgtgaccttggacaacctgcttaccctttgtgatctcatatgcaaatgggggtgataatgcatacttcacaaattgtgaggattgaatgagacagcatatagaaagtactaaatttagtgattggcaacacactaaaaaataactctatacacccagcaccctagaccagaaggcattgtgctgactcccagaatgcactagaaagcagtctgcttcttcccttcctgcccttcctctcctctcctctgttctcctttcctctgttctctccttttttctctcctcccctgcccaccctatccctcttcccttccccttcctctctcactctcctctcccctgattccagcccatttagtatctaggtgactctatcccaagcttcttctcctggtgcctttgtccccatctctccaagccaccttgattgtctcctctacctgacagggtcaccctgctggctgcaggctggagggatttatagcaattccctccctccttgcctgcacggggctaccagacagccggaagatatgtgggttggacacagtggggccctgggagaggcaaataaatacatcaagttcccagctgagtctggagataaggacgcaggaagatggggctgcaggattcacagatgctgcactgcacggggtcactcttcatagcctgattcctctggcttccccaggaaagtctatttggggcactttgaagaggacacagaagaggacagcacctgagcaatcttttcctgggaggcgctgcactgaggcacccttcctcagcttggatttggtagggacaggcttgaggagtgagaatgtgacagacccaaccccaagatgaggcaggaaggagggaaattgagccccacagcacaggaggggaaactgaggctgagaagggagaaagacttccaaagtctcacaggaagtcagtgaagagaagttacagtcccctaacccctgatctaccactttagacccccttacactgaattgtgcctggcttcccccagacttggccatttgaactggccttgcctgggtacagaattccaggtatctctgcaacatgccaggatccacctcagggagggttctcctccctccagatctctgccccagccagctgcctgatgagatgccctctctatggggcctgatttggggtcagcatcctattatagataactcaagggtacaacatcagtctctcccacacatggatgggattctgttctagtgcccgtgggcaatggagtgggggtacgggggactaacgcaggagacctgaagtgggggcgcctgtcccatccaccccagagacagctgcccttgccactgtcgaggccacacctgcccaagagcctcaagggcctcctaatcagcaagctcacccacagccaccaggcttggcacgtccttgacccagactgcccagataggctggggacatttcccattcccaactgctctgtgacctctctttggcctctgtctccctcccagtaaagtgaaagggatagaggacctccaggccccaaactctgatgctgggtgactctctgatccttgaaggctgtcattgcatctccctaaggtgggtgcagacttcacagagtctttccaggctactagagctgattgcctacaggcaaggagaggggaaagtgcttgggagtcccatcccccaggggcagcccttggccaatgtctgactgctgtgcatctgtggaagtgagcttccctgcctctcattgggacaaacaggattcattttcattctggagcttcctgggatcagtccaacattgagactgtgcctgaaatcacacctttgcttagcttcttcctcttcctttcctacttccccttctctcttctggttgtttttcgcttgggcagttttttaaacagccacctgcacacaaaacattgtctcagctctgcttctgggaagccactttcaagagtaaatgaaaacagtctattgaaagcaagagactgaaggtctgagggaaaagtcagttttatttcagcccaccaagtgccctccctgtgctgttctgggctttgatggggacagtggaggggaaggccctgcgcagccccccaaccccaggagctttgagtctgggggatggaggaggaggaggagactctgggccagccctcctgcggtctgcaggaggccacaggaggtggtggggggttctctgaatgtgtgtttattgtggcctttctgtgtcctgtgatggccccacggaatggaggactgagagttgcagagcaggaaggggtggcagccttgttctttcctggtcaatgtgccaggctcccaaaatattcagtgatcagattttaacctcaaatagcagtgccccaaccgcccctgaatcttgctatggaaagagcctttggtaagtgttttgaagcaggaagactccctctgcccacagagcagtgcacagcagtttgggggaggggctagctcctgggacccaagcgggcctcaagagatgaggcgggaggcgggttgcagtgtgatgggaggggagacacagaaattgccaagggccatgaggaagagaggaagccacaaccccaggctcccaaggagggtgtcttcctgcaggaagccctgtcagatggcagcctgcggcccaaaagccccaactcaacctgcaaactggcttcttctaaggccacagcacccaagggcctcaagacacacatctagcccattcccctaccattgcatgggtggaaacctagaaggagagagggcaaggagttgcttaagaccacttagagagtttgtgaagctggagtgagctttcaggttgtggagctccaagcccagtgtggtctgccccactttgcactgccccacatttttcctaagaccaaggtagaattattcctcctgttttccacctcaacagtaaaagtgcctctcttctctgccatgggactgggagacatgttcaggatgtgaagtcatatagggacatctttgagttcataaacatctcctgttcataaatatccgactaaagactgaagcttccactgctcccaaaatagctttggatcccagcacaggcatttccaagaacagatttttatcctttcaagaattccgtgaaagagctgggtgcgatgtgtgcctctaggcacagctacttgggaggatgaggcaggaggatcacttgagcccaggatttgaggccagctggacaatacagtttgatcctcagcccaaataaataaataagtataaaaataaatcaatcgatccaagaattctgtgaaagcaaagaatcctctggtttgtatgcctaccagagtttcctgaagttggtcacacacactgccctgaccctgactgtgatctcagactgtggatatagattggtctaaactccagataaggaagtatctagtatggtccattataatcctggtcattctcatttcaattcattttgatacaatattaggctactctgaacatgcaattccccaatccttctatttaaaagggatttcttgcttgtagtgagccttgggattgactcctctatagccatatcagggccagataattattctgaaccaatcagtttcatccccttcaccagtgactggttcagagataaacagtcctatgacaataggtgtcaagacccaggggagaggctgtggcttcggaaaagagaagcctgtctttctaacccactagtctgttaacattacgtttgtggctgggcacagtggcttacacctgtaattttcagcactttgggaggctgaggcggaaggatcacttgaggtcaagagtttgagaccagcctagccaacatggtgaaaccctgtctctactaaaaatacaaaaactagcggggtgtggtggcacgcacctgtaatccaagcaactcgggaggccgaggcaggagaatcacttgaacccaggaagtggaggttgcagtgagccaaaattgtgccaccgcacttcagcctgagtaacaagagtgagactccatctaaaaagaaaaaaaaacaaaaaacacaataggtatgtttccttggtggctccggaagccctccagtgacaccaaggcaccaagggacccagtccttgggctggaagccctattaagggtggcagaggggagagatgaaagaacttgcaactgctgatgtcactgagccgctgaatcaacagccgggaagccagccttgcttcctgctttgtgagacgatacacttaatactttccatccttgggggtgggaatcttgttatttgccgatggaaatattacacatcatccccagcccccactcccctgcctcacccggccctaccctttaccatggcaagtcctgccacggaggagctggctgcctcagaaaatctcttggggaaaccagtcctgcctgaattggggtgggattgccaagcattttgcatcccgccccccttacttgttttttggtgtttttttgttttgttttttgttttcgtttttgtttttgttttgagacagagtctcactctgttgcccaggctggagtgcagtggtgtgatcatggcttatggctgcctcgacctcctgggctcaagcgatcctctggtctcagtctccctccagagtagctgggaccacagttgtgtgccaccacgcccaactaatttaaaaaaaatgtagagatgaggtctgactatgttgcccaagctggtcttaaactcctgggctcaaatattccttctatcttggcatcccaaagtgctgggattacaggcatgagccatcttgctcagccatgttcccctttgaatgcaggagtatcgcctcttccaggcaggagttcctcttattcagtgagacaagcacagacccagataattacatgagctgccactggaagagctgctgttaattttgatggcaataaaaggccttgccagtacgttaagctaatttcatgaaaatgctgggaggagggtcatgggctggatcccagattattaataatgtcgagcttcatttgaaccattcagaaaattcctctcagttgcctccagcaaactgcaacaggttgctactttcctctgaaatcaacagtcttctcataggcaaatgtggatttttttgtttttccctagaaaataattaaagtcacaaagtccaataaatacttaaacagaatgtagttttaattaaaaaccttccaccaagtctgcagttgcgggtctctctttgcaaacaggcatgctgacaagcatcagtctaagtatctgaaactagaaacctttacaaataataatagtaaatctggtttctacatatacccatggtgtgtgtgtgtgcaaagggggtggtggtggtgaagaggtctgggggcagagccaaggtgctcccctgtggaggaggcaggacacaagcctgtaggggtgtgtgcagcagaaccttttatcaaacttgtgtcccactctgcaaggcaataataatggctaattcagctattatataaaaaacgtatctcaagtactgagcactaagtgtcaggtactaagtgctttgcgtacattgattcatttaatcctcaaggtgaccgaaaagcataggtatttttttttttttttttttttttttgagacagagtctcgctctgtcgcccaggccggaatgcagtggcactatctcggctcactgcaacctctgcctcccgagattctcctgcctcagcctcctgagtagctgggattacaggcatgcaccaccacgcccggctaatttttgtatttttagcagagacgaggtttcaccatgttggtcaggctggtctcgaactcctgaccttgtgatccgcccgcctgggcctcccaaagtgctgggattattacaggtgtgagccaccgcgcctggtcagtactcttatttatgcctttttttcttgaggcacagagaggttaaatagcttggctaaggacacacagtcagtacataatggagtctgacgctaggacctgcccgcctgacgactacatagaacctgtacaaggaaaggccggaggagggagtataaacagggcctggcttccctgaggagtgatctttcgactggaaattagaaaaggaaagcagcttcttgagggtgtggggctggagagaacatttgtgtgtgtgtgtgtgtgtgtgtgtgtgtgtgtgtgtgtgtgtgtgtgtgtgtgtgtctgtgcgcgcagaagctgaaagatgggaagtagtgagtgttcaggggcttctgactggagggcagccttggggaaggtctccgcagccttaaccggctgctatgctggggatgtttgatgcccatctgggccccggctttcttattctcagaggcccttcccacatctttaggcaagtccattaaatcctccgcgtgccacattaaaatacaagggcaagtacaactctgagtgcagttgcaacagaatcgtttgcacaatgtcgcatgtcttaaacattcaatcaaacatcgattacttccaattttgcagttttctttgcccctgttagcgccaacagatttttttttccagatctcagacatttattttaataggcccctgacaaagtcataagactcagagagaagggagagtgggagaggtgtataggaaggttttgtgccagggactagtcgctcaagaattaggagacgccctgggcactggaaactacgcagcgcgaagtagggacagcgcctgtgttgtgtagtggaccagaggttgctgatacctgggacatagactgggtgggcacgggaagtaaagcctcgggactttggttaagcgcgccccactggcgtatcgcgccgcgggactgcagagccgtgagcagcggtcgccttggtgcagggttccagccacatcttcctcgcccagccagcaccctctgccgttgacccgcctctgcgcccggcaagcggcttccagcagggggcgcgcgcggaccaggcttgggccctagaacagcgcggatggagtcgctggagcaagtccccagatccaaccggtttcaaccctccccaccctcccgacgctccgggttcgcgacgttgaagttaagggtcgatccgcagaaagcggccaggggctccagctctccattcctgggtctgtctggggtcggctccagcctggttagaagccttagtctggattcggcagattctgaatctgggaccctctgcgctagcggcttggaaccttgtcaccctcccctcccccacccctacttccacacacctgattagttgtctgtttctttaatgatcaaagacgtgggcggcggcgggatgaggtcttggttcccggctccacagccctccctaactgtcattattaacgttataaacattagacccgcttctgcgcgccggacggcgccggacgaggtgcgcgcagtcttctagctgagctcggaggcagatccagaagtcgcggctcccaccccaggcctcggcggactctgcctggggcgactcgggctccagccctgcccgggcgggcactgggctctccagggtcgaaggcaggggtaaggggcgtctttcccccagggcagcctccgggaacaaaagcatttgctgtagagtgagctagagcctccgggcccgcgggagtcagctcccgcccaggggtggtcaccgcgtccttaaccaccccaggagccccgtctccctgccgaactccttggcttctgcaaccctgtcaagacagcaaggaaagggggtcttccctggtcctcgggccccgaagtttcggggttgcttataggacgggttcctgcagtccagggaagctctgggcagatagcgagcccattctcccttccattacccagattctgcctccctgcggaaggcaaaaaagaaagaaagaaaataggtaaaaaccggcggagggccttgagcctccccgcctggcgcccctcactcagtcccgaaaagtcccctggacacgccatgccggaccggactcagctcccgctgctgggcccctgcctccaaatatccttcccaggcacaggctcccaagaccgccccctcagggttcccaacacccggacaactgcccaagacgccgctccccgcccccacccccaccttgttcggcagacaaagaagggtgtgctggccccgccgtctgcctccttctcccgaccccacaaggcctagaaacctcagggactcaccccgggctagggacccaatcctggctgtcccaccacaggatccccggcagggacgggtcacagtgctctcacccctcgaccattttcgaagacaccttccctgaaaggcgccttgcgccctccccatgggtcggcggggggggactccaggcccgagcaggcggtgtgaagttctgtgttctgaactggggctgagcaagatgcgatggtctcagcccgctgggccgcccgtagcgacggcaggagtaggggagagggagggacgcttggagtgtgagcgcaccagtctgttcatatttaatttacaaagcagcctcggaaccccgggccgggtggtctctttagacgctgcgctcttagcctgtctctcttccccaccccctcccctagctcattaagatgctcaacactcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaactgggctcggtgactttttgtcaggggacagagggaggaggcctgggcgatgaaggaggaaaccgcggaaggaaggagcccccccagagcctcccgttggaatcttttgagtgatttcctgtttgcgtgaccatcctgtgatttttttgccaggtgtttgcacccagccctgctcttagtgtctccaactccagggtggggtgacaaaaaacgagggcaggctgcaagtgagtagggggaggttgcaggaaaggaaggcgggtgtctgcagaccctgaacacagggagtctgagtgtgcgtgcaagtatatttgcactcaagggtgtgcggcaccctctttcacttgagactgtctgtgtagtggggtgtggctgtatatggtgtcacactgcccagtttctgtgtctccacatcagcctttgagttccctgagaagccggtgggaagaggatgggattcatagggacaagaccgctgtggcttgcacaagagaagtcacaaataacacaaagtacagagcgggcaaatgatgtaaagcaggaaagggggagaacctggccaggccgattgcccagagcgagccggcacgtttggcctgggagccaagtgtgtgcgttgtgtgggtgggtggggagcactcagtgaatgatgcatgcacaaccgtcagggtgtgccaagggggtgcacctggggaatcagggttgaaaacacactgatttcatagtcctagaaaggggctttcttgggtgaggaacaggagagacagggggatcaagaaaggagactgtgctcctggccagcctaaaacacacgggttgggctgctgtgtgtctcagctgaatccccctaagatgggaagaggcggggaagagagatggaagaggaaagcaacagaaatgggaagcagataaagattctctctctcccctcccttcttcctgcttccaatttcttgtcctcttttgctgtctctgtgggtcttcctaattggaccagtccaggctggcaacaggcccaagttccaatgctcagggtcctaccccagcctcaggtctgtcctctggcataggtggtggctgtgacacttcttggggcctgagcccagattcccttcccagaccagcaaagctgttttctttcttttttttttatttttttatttttaaaatagatcagttttattctgctagttccataaaaacaatgtaaacacaagcgttctgtacatcttcttggtgaattcacataatgctttgttccctgatcctttaacctcctcgtcttcttccagtcattttctgtttggaccactggccacaggagtggagtggggttggggcttaggagagagcaatgtggctttttcgtatgacttgttttattgcttgccctctcagcacactcctgttactcctaacacaaagtctgagatttaagcccttaaacctgtaggtttcaccatcagctttttctttttcttttctctttttttttttttttttttttgcataggcattactagggatgtgaatgggagactggtatagaaagtggtgaggagccgaagccaagaaattgctttaaacacaagatgaaaacgctctgttctgtacacaaagaatcacctaatactggtgtgaggcatctcacttagctgtggagaagtccttggaattagatctcagaaagacagttccagctttaagacagtaaaacctttaggcaatgggctaattgccttaaaggaaagaagagttctacttgaaagagcttgcaggtgagaaattgtcctacaaagattcttagaaatgttagcggagataactgacatgggtagctgtgggccaaccaagaactgtcaacagcccgatctcatagcaaagctgttttcaagaaaaattcccttctgagggccacagcctgagccctgctcctggtcacagcccaacactgcagtccaccccactgcctgggacacaactcaagaatattatctcttaggaagacacctgttttgttctacctgcaaatcctaccgctgagcacggggcaaggactggcccaattcctagggcctgtttaggaatccagccacgtgattgcttctgggaacaggcctggctgggccagtgagtgctcagcagttttggtgcaactcaatcatctggtcatgggtctcttgtgggaagacaggccccttcctttccctccctgtcctaagaattgggggccctcctcgagaccctctaggatcctgagtgccactagggcaggtggagaggaggtgaaagctctgcccctctttgtccagggccacgtatcctaatggatgagcaaatactactcagctagaccttgtgccttctgggcttggccaggcccaaaggctccaaccacaggtaggaatgaatacgtgttggaggccaaggaccagggtgctgggacactctgccaactgcccactgaaatcccagccctctcaggaaaactctagtttctgtccaaatgtttggccaatgcacagaatggtccccagcctctggccttccttcctacctctttttaaatgtaattaatttaacttatttaattacattaaaataaaatgtcttcctttcatttcctctccctcattcctctctgttcttttttgaattgttccagttcaactaccaatttgaggttgaattcattttcacagtgtccccatcaggtggttgtaaaactctggcttatacttatccagagatggggagctcacattccactccccgcttccagggaatcagttgtttagcagtttaaaatgtgtctctgcctgggttccacccctcaggcctgactgccactggcaagttctctgggagaacctaccaggtgtggaggtgtaatcttcacctctgaccctctctccctggctccaaggctttccattcaatgcaacttttttgagcctttcctgtatgcttcatgtgctgtgctagcttcaatctctccagtgtgtcttgctgtaaaacttatttggatactacatgggaatggagtctaacggcttgaggagtgtgtgtgtgtgtgtgtgtgtgtgtgtgtgtgtgtgtgtgtgtgtgtgtcttgagagacctggaaaatggtcggagaatgcaatatgacagcagtagcctcagaactcagagcaatttatcaggagcagtaattctctgagttacagaaaccagatggccaggatgtggccttgaatcagatcagaaacctgtctaaagaaaggttatttgaaaggagtgcctcctccccctaaatgtttcctaaagatcagctgaaatgagaaccatcttgaagatcattaaagtccattaatataaaagaacaaaggaaggcagggcttctttgagaaagaagcagctggggtagggtcctctggtcccagatcttgtgtctggaatgcagccctccacccatgacatcaaaataacaaccacaactaaagctaacatctccaaagattcgttgtcagtacatatatggcctgtgacttcctggtagacatctcagtttttcctccttgatctcagggaaatgcattttggtaggtagagggaaaggagtggcatcttgctatgactaccctgccccacatttgttaacagagccccagttatgagacattccatagggaaaaagggacctgctctctgcacaacaggaggtgtcgcctgcaaagaaaggaccatgactatgtaagcacagagcaagggaaactgggggatctcctttctctgcagaaatccaagcctgtattctgcagaaagccaagccctagtaccaggacataagaaaggccccttgttgaggctataaattgccaagtctgacctaacaaatacctttaccttatacatttccaacataaaggtatagataagagaaatcctgctgggcagttcggaggaagcaagtggagccatttcagttgtaatgtgtcaattcattgattacatttgaaatgtagccacccacacctatctgttcaatgataagattttgccttaggactcaatagagaataacattatattgaaaatgaaagatctgctgtgactggcatatagaagagattaaattttaaaatgttttgcaatattcgcattttgttcaaaatatgaccagtgttcctaatgagacttgatatggattttttaaaaagccatccaaaggccccatgatgggcacaaaaacaaaaccaacttgttgggttaaattagttggaaagactttgtatcattccattgttgaataagtaatttatgggatttaaagacaggacgattttgaaaattgtgctaattgtgtgtgctttgtttgaacatgtgaatgtaagtttaataattaagtttaagtccacatagaacaaggagagaaaaagtgtttgtatttttatcaactgtttactgcttacatgtattcccttgtgtattaggagttaatttggttttggcaaattaaatgcattttctcccagcaacattctcaaactgtttcttaaattgaatctaaaagccattcaaggcatccagccatttgagagaaaaatttctatgattatataaattaccgaggaacttcgtaagaattgatcattgtcgaaatggggagagaataggaatggagaattaattatcaaatgcgtcttaataatagaggcttgtcacacatctagactaagaatgctaatagtcaccacctaatattagtataaatactaataataccaatagtggctaacatttattgaactcttactatatttcaggcacatactatggatcttacaagcattattttgtcattccttatagtgatcctgtgaggtaatattattattctaatttacaggcaaagaaaccaaagagcacagagggttagtagtttgttgaagatcacacagctggcaatttgcagggttgaagtttgtccttttgttatctgactccaatgccagagatcttagtcaccaagccaaacctcctcctgaagcctctacaaaccagtgaagtatagaataacatattttctatatggttaaatttgcggctaattacagagtttgtctagaaaaaggatttctcttgctgtttctcttatttctcaaaatagcatttttttttttcctgattataaaagtagtgcaggccaggcgcagtggctcatgcctataatcccagcactttggcaggccaaggtgggcaggtcacttgtgatcaggagtttgagaccagcttggccaacatggtggtctcaaactactatttcatgtctctactaaaaatacgaagaaattaggcaggtgttgtggtgtgcgcctgtaatcccagctactctggaggttgaggcaggagaattgcttgaacccgggagttggaggttgcagtaagcggagatcaggtcactgcattccaacctgggcaacagaacaagactctgtctcaaaaaacaaaaaaaagaaaaaagaaaaagaaaaaaagaaaagaaagaaagaaagaaaagaaacaaatataaaaataaaagtaatgcatgcttcaactagaattgtctttggttgccattgggaatgtaaatgggcatagccactttggagaaatatttggcaatctagaaacattaaagatacacatacgtctgactcagtaatctcactcttgggtatatactcaatagaaatgaatgtttacatccatcaaaagacagaagagtcctttggtggatgcaagtgcaacgatgttcatagcagttttatttgtaatagccccaaattggaaacaacctaaatatccaacagtagaatggaggaagtaacctgtagtatattcataccctggaataccacagagcaatgaagaacaaactgcagctacacacaacatggatgtcatcacagtgagtgaaagaagaaagacacaaaagattatggaatgagtgatttaatttaaaggaagttcacatacaggcaagactaatttttggtggaaaaagttggaaggtactaaccgggattaggagaaggctcaagggagacttctgagattctagaaatgttctataccttgatctggatggtggctacatgggtgtatgcatatgtagaaatccatgggctacacacttgagttgtatactttattgaatttgttatacctcaatttgtgtgtgtgtgtgtgtgagtatgtgtgtgatggagtttcactcttgtcgcccaggctggagtgcaatggcgtgacttcggctcactgcaacctccagctccctggttcaagtgattctcctgcctcagcctcctgagtagctgggattacaggcacctgccaccacacccagctaatttttgtatgtttagtagagatgggctttcgccatgttagccaggctggtctcaaactcctgacctcaggtgatctgcctgcctcggcctaccaaagtgctgagattacaggcatgagccacggtgcccagcccttattatacctcaatttttaaaaatggaaaaataacccttggaaatcaggcaccaaagtaatacgtgctccttattgaatagcactgtccgatactagccactagccacatgtggttatttacattttaattttaattaaggtgaaataaattttaaaacttgttcctcaatcccactagccacattttaagtactaggcacattgctaacagcaattgtttatttggacagcagagctatagaaaatttccatcctaatggaaagttctattgctagtgttgttataggaaattgaaaaatatagaagtgtattaaaaaaacaatttattatttataattccctcatccaaaaaataatgtattaacattttatgttaacttctaatttctttctaaaataaattttattaaattacaagagtaacatatgaatgcattcttgtcctaagataattaaatattgataaactgaaactctctttgaccattgcctgcaatcctagagctctccccagtggtaaccactcttactagcgtactatgtacctttttattttttttgagatggaatttcgctctctcgcccaggctggagtgcaatggcgctatcttggcccactgcaatctctgcctcctgggttcaagcaatcctcctgcctcagcctcctgagtagctgggattacaggcatgtgccaccaagcccagctaatttttttgtatttttagtagagacggattttctccatgttgatcagctggtctcgaactcccaacctcagatgatgcgctcgcctcggcctcccaaagtgctggggttacagatgtgagccaccacgccctgcctggtaccatgtatcttttcagaccattttcgcaggtacttataaacatgatgtctgtgtatggaaatacacagcagagccattaacatcaccctgactcaaggagcttccacctggttcagttcagtctcccgaagtgcacaggaagggtgttatccccatcatccacatcccacccagtgtctagggctctcttcctattcatctcgagctgctgtggtcctgggatattgtgagaggggacgtcacatggggcaagtcagatggtcactaggtacagtcacactgcagaactggcaatgccactcctgttgggtgttcctagggcaaggtgtaactgtaaatccaggggagccatcactccacactgtctgtatgaagagctagcctgtggtgcagctctctagcctgaaggtggtgcttcctaaggtagagtctaggaggtctgcaggcatgactcagctccctctgggtcctctcgcagaggtcctttgctgctttcatgaatgccacactggagcatggaacccttttgtgaagctgccccagatccccttggtaccaacatcatcattttctctctggtataaggcacaggctccgtctgactcagaccaatgcacctctcagtgtttaccttttgagttcaattctgaattcacgaatttttaaactttcttcattttaatgtatgcatttacagctattaatgtcctcctaagtactgttttaacagtattccccaagttttaataggtagtgtttacattgccatttagttttaaatattttatttctgtgagatttgttccttgactcatgaattatttagacatgggctgttacattttcaaatgtatgtgtttttttttctgacacttttgtttttgataccacttgcattacctcgttgtcagaatacagactgggtgatgctgattatttggtaattattaaaacttgcttggaggaataggatgtagtcaattttttgcaaatgtttatataagtttgaaaagaatatttattcttgaattattgggttatgatttttatattttaattagatcaggcttgttaatattattgattacatattctctatttcctcacttaattttttgtttgcttgttttattaatttctgagagaggcatgttaaaaatctcttatgattttagacttgtcaattatttcttgtaattctgctcatattgcattgtatatttttgaggccatgtcataaggtgtatacctttttggttaaatttttgttgaagtctaacacacgttcaggaaagtactttcataaagagaaaatacctcttatgaccagtacccatatcaagaaaagaaaattaccagcactcctgcagcatcttcatgctccctcggagtcactcctccatccccactctcctgacttctaatatcatagattagttttgcctgtattgaaacctcatatattccaggagtcttcaaaatgtacacgaaaaatgcatattatgaaaaaactaaccatgatttcaaaatgttttcactaacttgtactaacttgttataacatgtctgaacaggatctagtttgaggctctaagaaggataagatatgagtttgaaaagaacctccattacagcaacatgagttctgctaaaatcaaagcaagaatgaaaatcaaatttatggtgaagcttgggtggaagaattatgaaatcattgataccttaggaaaagcttatggagacaatgccccaaagaaatcagcagtttacaaatggataacttttcttaagaaggaataagaatatattgaggatgaagcccacagcagcagaccatccatgtcaatttttgaagaaaaaaatcttttttttttttttttttttttttttgagacatggtctcactcctgttgtccaggctggagtgcaatgatgtgatctcagctcactgctcccttgacttcccaagctcaggtgatcctcccatctcagcctccaagcaagtagctgggactgcaggtgcgtgccaccacgcctggcgaattttttgtatttttagtagaggtaggatttcaccatgttgcccaggctggtctcaacttcctgggctcaagcgatccatctgcatcagcctcccaatatgctaggattacaggcatgagtcactgtgctggccaaaaattaatcttgtttgttccctaattgaagaggactgacaatagcacaaaaaatatccaatgccgtagacatgtcagttggttcagcttatacacttcttactgaaaaattaaagttgagcaaactttccactcactgggtgctgaaaccattgctcctagatcagctacagacaaaagcagagctttcaatggaaattttaaacaagtgggattaagatccctgttgcattcttcaaagaattgcaacaggagatgaaacatggctttaccagtaccatcctgaagacaaagcacaatcaaagcaatggctaccaagatgtggaagtggtccagacaatgacaacagatgtttgggatgctcaaggcattttgcttgttgactttctggagggccaaagaataataacatctgcttattatgagagtgttttgagaaagttggtcaaagctttggcagaaaaatgcccaggaaagcctcaccagagagtccttctccaccacaatgctcctgctcattcccctcatcaaagtgggcaatttgcaagagtttcaatgggaaatcattagccatccaccttacagttctgatttggctccttttgacttctttttgtttcctaaccttaagaaaaatattttaaaacacccatttttctttagttaacaatatttaaaagatggcatcgacatggttaaattcccaggaccctctgttctttagaggtggactaaatagctggtatcatcagttacaaaagtgtctagaacttcgtggtgcttatgttgagacatagagtttatatttcttatttttatcttttaattccatttttccacaaatggtttgaagtcttgtcatatgctcagctttggtagatactgccaaacagtttttcaacatgtaccaatttacacttgcaccagccgtgagagtcctcatcaaactcagtattatctgtttttggttttagacattctgttgggtgtgtagtggtattgcattgtgtttttaattggcattaccctgacaattaattaagttgaatactgttgtttcctgtccatttgaaaatcctcttatgtaaactgtctttctctctttttcattgggttgtctttttcttattgatttgtagaaattcttcatatattctgggtatgagctttctgtacagaatgtcttccctctctcttcagcttctcttttcacactttttgtagtgtctttttatgaagagctgtttttagttataatgtgctccaatttatcaattttttctttatggttagaactctttaggaccatatttaagaaatctttgcccaccctaagatgatgaaaatattctcctatgatttcttgtgaaaaacattatgattttaccttttttatttccatctacaatgcatgtggaagttacttttgtataaggagtgaggtggggccaagattcatttttttcccatgtgaatatccagttgacctaacaccttttattgaaaagattatcttttcccccactgtaagtaaggccttagcacctttgtcatcagtgaggtgaccatatatgtatgcattgtttttccccttgcagtccggactcggcttctgtcatcacatctctttgtctgactctctttgctgtgtctctcttccacttttaaggatcctagtgatcacattgagtccacccagataagccaggataatttccccattttaaagccagctgaatcacaactttaattctgtctgaagcctgaattctcttttgccatgtaacctaacatattctcaggtttgggggatttttttaccattgatttttgagagttctttatgtattctagatactagagagttctttatatattcttcttttctttttttttcactcttgttgcccaggctggagtgcaatggcatgatctcagctcactgcaacctccacctcccaggttcaaggaattctgcctcagcctcccgagtagctgggattacaggtgcacgccaccacgcctgcctaattttgtatttttagtagagttggggtttcaccatattggtcgggctgatctcaaacttctgacctcaggtgatctgcccgcttcagcccctacagagtgctggattacaggcatgagtcactgtgcctggccaagagttctttatacattctagatactagtcctttgctggatatgtgatttgcaaatgttttcttctattctgtagcctgtattttcatcctcatcagggtctttcacagaggaagacttttaaaaactttttgatgaggtcaaatttatcaagttttccttttatggatcatacatttgatgtcgtctaagaactctttgcctagtcctagatcctgaagattttcccctatgtttttgtctgaaaacatagttatatgttttatagttgcacatatatagttttatagttgcaagttatactttttcagttaatttttgtataaggtgtgaggtttagatgaacccattgtctgtagatgtccaatgtttccagcaccatttgttaagactatccttcctttgttgaattgctattgcacctttgttaaaaaatcagttgggcatgcttgggtgggtctatttctgggttttctattcaattccattgatttttgtatctgtgcctccaccaataacacactgtgttgattattgtaaccacatagtaggacttaatatcaggtagagtcgttccgcctacttttttttttttttttttgtaagattgttttagttattctaggggctatgtctttccatataaattttagaataagcaaatctatgtttacaaaagaaagacaaagacattgcattaaacccataaacatttttacaatgttgaaccttttaatctgtgagcacatgatattgtctctctacttctttaggttgtctttgacttttttaatcagcattttgtaatttttagcttgcagatcctgtatgaattttattatgtttggccgggcgcggtgactcacacctgtaatcccagcactttgggaggccgaggcgggcggatcacgaggtcaggagatcgagaccatcctggctaacatggtgaaaccccatctctactaaaaatacaaaaaaaaaaaaaatagccgggcgtggtggcgggtgcctttagtcgtagctactcaggaggctgaggcaggagaatggcatgaacccgggaggcagagctcgcagtgagccgagattgcaacactgcactccagcctgggagacagagcgacactctgtctcaaaaaaaaaaaaaattgttatgtcccaatttctttgggggtgttcattattagtatataaaaagtgatgatttttgtgttgatcttttttttttttttttttttttttttttttgaaacggagtctcgctctttcgcccaggctggactgcagtggcgctgtcttggctcactgcaagctccgcctcccgggttcaggccattctcctgcctcagcctccctagtagctgggactacaggcgcgcgctaccacacccggctaatttttttttttgtatttttagtagagacggggtttcaccgtgttagccaggatggtctcgaccgcctgacctcgtgatccacccgcctcggcctcccaaagtgctgggattacaggcgtgagccactgcgcctggccttgtgttgatcttatatctgcaaccttgctgaactaactattggttttaagaatttttagtattttccttgggattctctaggtgaattattttattttattttattttattttattttattttattttattttattttatttgttttattttattagacacagggtctcactacgttgagaccaggctggtctcgaactcctgggctcaagttatcctcccacttttgcctcccaaagtgctgggattacaagtgagaggcaccacaccaagcaagatgttttaaatgttatttttataaccaatccttatttttatttattcacatgatcatgtcttcattatcactcctaatgttgttttttatgtctcctctctttttttctgttaagattcccaagctgtggtcttttcacaaaacacctagcttttatttttattaatcaactctacatctttttctgtctagttcattaaatttttttttttttttttgagactagtcttgcttggtcacccaggcaggagtgcagtggcgcaatcatagctcactgcaacctccaccttccaggttcaagcgattctcctgcctcattcggcctcccaagtacctaggattacaggtgtgcacctctacatccagctaatttttgtatttttagtagagttggggtttcaccctgttggccaggctggtcttgaactcctgacctcaattgatccaatcgcctcagcctcccaaagtgctgagattatgggtgtgagccactgcatccatcctagttcattaatctctgatttttatctttaccagtatttttatttctactttctttggatttatttatttttcttttttctagctttttgagttgagaccttagttaattttttaaacatttattgcttttgggtgaatccattggttatagatcccctgcatattgttttggatgaatactgcaagttttactatgtaatgttttaagtgttcttgtaaaagtttgcatctcagtatgatgatgaaaaagttctagagatggatggatggatgattaactacaatatgaatgaatgtaatgccactgaactgtacacttaaaagtggtgaaaatgttatgttacgtatattttaccacaatgaaaagtttgtaattcttgtttgagttatttctttaacccaataatatttatatacatatttaaaacttttcaggatcattttgtggttgctgttgctgttgctcttgttttatttgactattcttttttttgttttgttttgtttttgttgttgttgtttttgacggagtctcgctctgttgctcaggctggagtgcagtggtgtgattttggctcactgcaacctccgcctcctgggttcaagcaattctcctgcctcagcctcctaagtagctgggagtacaggagcgtgccaccttgcccaactaatttttgtatttctagtagagtcggggtttcactctgttggccaggctgatctcgaactcctgacctcatgatccacccgcctcggcctcccaaagtgctgggattacaggcgtgagccactgcacctggcctattcttttttcagccctaattttattacatgtgacttgtgaaggtgtcatgtatgacttctgttttttgagttttattgatttcttttgtgagctagtacatgtttaatttttttttgaaaattttgtgtgtgcttgaagagaatatgtattttcttattgggtaagatattttagattacttttaagatcaagttccttaatttttatcaaaccattcatatccttacttattttctatctgacctgtggacttctgagaggtgtattagaaatctcctaatttgatttgagatttgttttctctttatatttctgtcaaagctatattagtagatgcatgaatgtttgtgcctattatatcttcttggtgaactatcctatgttttaatatgagtagcctccttgttcttgttctttttattgtgttttgccttgactttctcttttttctttttttttttgagacaggatctcactctgtcacccaggctggagtatagtggcataatctcagctcactacaacctctgcctcccaggctcatttgatcctcctgcctcaacctctcaagtagttagaagtacagacatgcaccaccatgcctggctaaattttgttgcggtttttgtagagatgaggtttcaccatgttgtccaggctggtcttgaactcccagactcaagtgatcctcccgcctcagtctcccaaagtgctgggattacaggcctaagccaccacacccggtcctgaatttatttttctaatattaatattctcactcccactttctttttaaaaatatattcctaatatatctttttctagtgttagaattcatttttaattaataattctctaaggtttataatgagaaaacagtcccatactttatctctgattccagttcctagtgctttcccttccactttgaactttttcagttttttctgctgtttcctaccatattaaaaaataacatgctttcctgttattttttcaattttatgtatcacctattgacttcctatggaggttgaataaattcgttctttcacaaagacacaaacacactcaactttcctttcatccttccaatatgattaaattgcaacttttgctgaaatgattgttccaatgtttacattataataattatgcaaacacagttcacagctgatccatgtactgaattctgtttttatttcttttctcatacaacctttcttctcccgcggttgataattaccttgttttttgtttttttgtttttttatttgttattttcttagtttctattacgatatcctaaaatttattgcagaagtataaatttcccctcaatatgttttaaaaattagatatttgatcagtttctttttctttcttggagacactcccagagctccccatccttctgctcccatcctggctgctgaaggcctgatgcacagctgtcatcctgggacttccgtgcaccatcatccctgtttccggatcctctgtcttcctcttcttggtttattctctctttttgatggagcacattctctagagaagcaagagaggatcttgatcttgtgaggcctaaaattatgcaattatacagaatcacaaatggaaaattagacatcaaagaaatgtgggaaaagaaatcacaacaaactgcagtttttgaaaatggtgacaattaccacaaaccacaaaatccaggaaagtagtcgaacattaaactacatgacattgctttataatgattttctcctgaacttttagttgtatctctgaagacctttgtatcagttgaccttcaatcaaaagcagaagcagatcctgctagaaggatatgtttctctctctctctctctctctctctctctctctccctctctttaaatggatttgctgtagggcttcaacattacacaattgtggaagctgactaagcatgctttgtaaggctgttaccttgcatctgatgctggagtttgaagtctgcagggcaggcagggtggaaaggaagagggaaataaaactccagggagagcaagaacaagctagagtccaagaacatgaggtggaacctataaggacagagcagaactgtctccaaccttgatgatgtgggtgtcttgtgggagaagctggtgccctgcctcgcagagcttaacacacacctgggccaggagtcagagcaactgaaagaggatcaggagaagttggaggaggtacaagcccagctgctgccccatgcccaagaggtcagccagcaggtaagcaaccaaatggctgctgcctgtcttccaccctctaaatcaccttcaaaaatgtctctgtggctgggcgcggtggctcacgcttgtaatcccagcaccttgggaggccgaggagggcggattgcttgaggtcaggagtttgagaccagcctggccaacatggcaaaaccccgtctctgctaaaaatacgaaaatcagccaggcatggtgatgcacacctgtagtcccagctactcaggaggctgaggcacgagaattgctcgaacctgggaggcggaggttgcagtgagccaagatcaagccctgcactcgagcctgagccacaagatgggactccatccccaaaaaaaaaaaaaaaaaaaaaaaaaagaaatatcgtgtggccaccctacttggaaacattccagaaaggcaattctgaaaaaaacagttcagcctagccaagttaacatagtacaaagccactgtgcttcttcttaatggtaatggtttgtaataatttccagaaagaaaaataaaaagacaattcagtattttcttcagtatgtttgatcaaaatttgttttttattattggtgatcttgaagttataatactattgcagttttgtgtcccacagacatagggattctgataaattcgatttcatgtgattctcactcaaaaataaaaaaaaaaagtgccctgacaattaatagttttgctggacgtagaattctaggtttgaaactattttcccttagaatgttgaaggtgttggtctattttgcaatgttgaatacattattgacaggagagactgctggctttgactaaacgttaatgagaactgagtactctcctcgcaaatttctatatctaatgggaagggttttccctagccaagctttttggctctgtacatctcaaaatttgttttttctctactacccagctgcttcattgccaaatgccttagaacaagttcatttttgttttgttttgtttttgagacaaggtcttgctctgttgtcctggctggagtacagtgacatgaacacagctgactacagcctcgacctcccagtctcaagcaatcctcctgcctcagccttccaagtagctaggactacaggtgcacgccaccacacctacctaatttttgtattttttgtagagatgaggtcttactatgttgttcaagctggtttcttaacgcctggcctcaagtgatcctcccaccttggcctcccaaagtgctgggattatagatgtgagccaccatgccagcccaagttcatattgtgatacatttgaccctgacctttcatgtcacaatgcctgtgagtcagcccagtggacagcaagagtattcctaaatggtcatttttacaataggacaactaccacatggaagagaactgaggcgccccagtcaagacaattactgacccccagacatgcacgggggacatcctggagtctccagctctggctgagctgtcagctgacagcaaccacatgagtgctcccaacaagatcagcagaagaaccacacagataccagcctacaggactatgaaaaatgatcaatcatcttcatcttaaaccattaagttttagagtggtttgtcatgtagcaatagataactgaacacttgtaaatcatctaactggattttcaaaaacccaatttgaatgtctttcctttaatttataacaacttattcataatttcttatacttaatgatatgtttgggttgattcctgacactttgagttttctatcggccatgcttttttgcctcccacccccatttgtgccctttgttagataggtcaggttttatttatggtatttttcttcttacagtcaggaagttataaatcctatttccattcttcgggcttttctattcaagaaacaaaggaatatatctgtttcttcatctttctttggcgattgggtgtgcttcgggtttaattaggttgaattttacccatcagaaggaagctactgttcgtggcctagaaaacgataaagtatagagtaaggcaatcaaaatcaccacaggaaaggagccctgtgggtctgtctgtgtgtggatgtgtgagcggatggttattagaaaatggttgaggaatgcagctcatcagctgaggctcggtgctcatcagccacccatctgacactcatcaaaagcatcggttgctggagattgaccaggtgtccgcagcggcctgtttcttaccgtctgctttggcttggccaaggtttaggcagcttctctctttcctccaggcttctgaggtctgctttcctccaagcctgagcaagcataacagaaagtggattgtgaccccttatcagctcctcctgggaatcggctgaccctgtctttcctaggcacactcccgccagaccccaccccttgtgtggccagcttcccttccaaacgtttgcttacctctgcttgtcctctctttaccctgtgaaagaaaaagttatttctgtttgattttgagacactcacagatttctgagatgggagagttctccatattgcaatcgtctttctaattaaagcctctccctccctctctaattctggatttgtttttatttgacaaaatatagtcaccattttctggggatgaaaacttagtcaatatcagaaacctgactgcagtcaggaatagagctcattcacctttcttccctagaacttagactgtgcttgaggcatagtgggtacttctttatgtgttttatgaatgaatgaatgaatgaacgaacagatgctgaactcaggagacagagaaggaagctgggagagctggtgtctggcctctgcttgctccaggagctatgttctccctgttcacagctatagctgccagggattctggaaacacatcctgctgccatggaaatgaatgcagtcacagagtgggaacagttaagttacttttctgagagagttacatcatttagaagcagatctctaaaagtccttgctcctgcaggagttggtgactgagtggcagtaattgtgttcacatggttaactatgacagtgtcacatgaagctcaaataatgggttggaaacgcacaaatgattgctagttgcttgagctctctgctagcccttgccttgctctctccatatttactttctccagcttgcaactggatatacagacgtgtctctgcagcagcctggcccaccctattgactgaggcaggaagttgatctgcgggttgcagctgctcttgaggaagctgagtctactaaaatctgttcaccctttccctgacactgctgctgaggccggtccccatccccggcagcttcgctgggccttgtttatcttttcatcactcttgactggctctggcctatttctggatctcatgtctgtcctctgacaaaccctgcctctctgccagctttctggaatctgtcaatctgagaggcatgggaaaacgacattgcccaacagaaccagcatctcaatgtggcaaaaatagactcatccaaagcaatctgggcatacactaatgtccccagcactgaacatccccaatcactggtttcccccatctgattaattttttccccatagagaggttttgcaaacatttatgcatctttaagcattttagtgatctgattttcttaattttgatggatttttctttttttctttacctaaaaatatcatttgaatccattttcagctgattattcctttttttctgtttgtaatagcaacgagctagaaacaaggtaattatccaacaataaaagacattttccctccactttgtgtgctctttgatgctcatgctgcaggccgagggtcacttatatcctcccactggccttattgctggctaacccgtgacccggtagcctagccctctgtctttcctgggaatctcttccaaccagctgacctctgcctggtccttcttagtttgacagagcacctgtttgttcctagggtgccgaatggagcactgtccttctcctggataactgatgacaaagatgcatccaacctgcacacgcaacatgctccctcttccatgaatgccggttgcacccgatgatctgcgcctgctcactctacctgcctccctgcccagggcagagaactgaggatgttatgttagtgaaatcctcagatcactcacagcgcagaacactccccaacttctctccatcatgtgtcaggcccagaagcagttacaatcattacaacatcacctcccacctttccatctacacggttgaacagctgtgcattagtctagaaaagtcaccctgaaaactggctctagtttggggaggtgacatgctcttgctttgtccccagagatgttcttctgttgtccttgcagtgcagggagtacctcctgggctgtgtgcagcagccctgcctgaggtaggggagtgctgttcactaatatagatctgaatctcaccagtctaggaggggacaggtacttctaagtcaatcaatcaatcaatcaatcatcagtcaatcaatctttcaagttttctcatcttccaaaaagacactaatgcccagttgaaagtggtagccactcaattcacctgggcttatcacacaaacaaactctcgttatcatattttttccttgatgctgtatgaaactgagtgaagtcacatttcctgattcagaagttgcaactgaaatggcccaagtgggaacaaaaggggaaattttgataacagatgggttgaccctttatggtatagagctgattctgagaactactccaacaagcatgcattctaaactctatcaagcaatgtgtggaatcacggcaacaaaaacatgttctccctagctcttaagtattttttatttggaaaatggagtttcaagttgttttcctgacttctatgaagattgtgatgaaattgcagaatatataaaacaaaagattgttgatattgtgttcaaatgcaaactagactgctcatctatctgcatatttggcaaatggtgcaaatgtaaatattggaaaattccattcagtctataaacttaccaaaggaaattttaaaaatttcctgctaaacgtcctgacccctctgtaccttttacataacactgctaaaaagaggtatgatttgcctactgtgacattgacagtttcataatgacatttttggttagttttcagtttcctcaaagcatgcagaggcgctttatgagatttttgatttttatgggcgtggtaggagatagccttcttagacatgcctacaagatgtcttgcagaaaagatgttagcatgttggcctactataaaatcatattttcaaagtgtaggatgagaagaatgtccttcactactttggaaatacattgaggatgagaacagagaaaaggattactgtaaaatggaaatttatatgccgtttctccaagactgtttcataatctttaaaaaagctacagaaaaggatgaactaagtgcatctaactcgttccatttaggtgtaggttgtgacaaaaactcatctagtgaacaaatgactcatttcttggaaataagactgctttgaaacttaaaaaattatcactaggaaaggacagccaagttaaacaggattttctcaatttctttactaaaactgtaacttatttggaatccagcttcaatttcacaagttcaaagtacctccctgctttgaaaccattttttccagagaaaagaggcttaccttatgatgacatccaatgtgctttgaagtgttttagaatgacagacattttagacatcgatagcctgtgtgattaatttattgaagcaaaagaactgattgacgaacagctggcctaccaaaacaagcccatagatacaggggatggacatttatggagaggtggaaattaactcctacaagtctaaaaacctgctgttgctagtaaataaaagcctaggtactccatgccctcacacagtattgttgagaagctatttagcattgtgttatcacatcagactgacactagaaatcagtgtaatgtgggcttgagaagagcagagccgcaggccaaagtgaatgttatacttatctccattcagttttatcattgcataaaagaaaggatgggtgtcataaatgccacaggcaattcagagaactattattaagacaggaagctgaaagaataaaaggcatcttactgtagcatgggacagaaggaaactgacattaaggcatcttactttagcatgggacaggaggaaactgacatttttaaaaaatcaaatatatgaaatacctgtttcatcattcctattctattttcattttcctttttaattttttgccttccttttttttattcttttccaacttttaagtttaggggttcatgtgcaggatgttcaggtttgttacacaggtaaacgtttgtcatggtggtttgctgcactgatcatcccatcatctcagtattaagccagcccagcatctattagctattcttcctgatgttctcctttctcccacccctaccctctgacaggccccattgtgtgttgttcccccgatgtttccatgtgttcccatcattcagctcccacttataagtgagaacatgcagtgtttggttttctgctcctgtgttagtttgctgaggataaaggcttccaataccatccatgaccctgcaaaggacatgatctcattcctttttatggctgcatagtattccatggtctatatgtgccacattttctttatccagtctatcattgatgggtatttaggttgattccatgtctttgctatcgtgaatagttacgttttcctttttagaagtcttatgtttatatatcttaataatataaaataaatagcctataaaccttaaatattcaataaggacttttaaaaagttaaaaacaaattgccatatacaaggataaaaacagtgtaaaaatattgttttattttttcacacatatttaattggtcttactattaattgtcactacttgttattaactagtcctattgtctggtttaaataacatttatataacagaaaggtaaataaatcagaatatataatttcaaataagcacctatcttccatattttatggtaatattttaaaatcaatggcacatccgtgtataattatttattatatatggtattatggcttttgtattcgtctggcatggcatggcatggctgtgtcccgggttgtctttctaaaatattggtgatcctgtctgtcacttgcatcatgtttcttttttcttcatcatcttcttctttttttttttgagatggagtctctctctgagcccaggttggagtgcaatggggcaatcttggctcactgcaacctccgcctccgaggttcaagcaattctcctgcctcagcctcccaagtagctgggattacaaacatcccccactattcctggctaatttttgtatttttagtagagaaggggttttgtcatattggccaggctggtctcaaactcctgacctcaggtgatccacccacctcggcctcccaaagtgctgggattacaggtgtgagccaccacgcctggcccggcatcatgtatctatggttccatccacatggctgtcgtgcatatcagtagctcaatcctttagactgccgagtggtgttccattgtatggatacaatgagcccctggtggtggtggtggtggtggtgtttttatccattcactagctgatggatatttgggttgtttccagttcttggtgattataaacatgtgcataaaggttcttgtgtgcacatttttatttttcttgggtaactgcctaagtgcagaattcgtgggttatattatgaatgtatgttttactatgtgaggaactcccaattatcttcccaagtggctgaaccatttttgcattcccaccagcagtgtatgagctgctttgcatgctagttagcacttgataatttgtttcatttttaaaaattttcagctattctaatagatgtgtagtggtattttcttattttaaaattttatagcagtcattttgattggcattcacaactgcctcagagggaaccaagacaaaaagaaaacataaagaaagaaaattctgcctgtggagcggaagaatgggaacaggtgcggaaagggtcccaggaatgggtatgacattgagcatattctgggtaaaaaatcagctttggctgaggaaaagtgccccagggaggtggggggttatgtcaaccagactgccccctctcccagagctcagacccagggctctgagagtcctcaggtcttcgtgtctcaagaggaaaaaaggagttggggtggggggagggcagaaagagttctgccctttattatttattatttatttatttatttatttatttatttatttatttatttgagacagggtcttgctctgttgcccaggctggagtgcagagacatgatcatggctcactgcagcctgaaactccctggctcaatcgatcctcccacctcagcctcctaagtagctgggactacaggcatgtgccaccacgcccagcaaattttttattttttgtagagatgggcttttgccatgttgcctagaccaatcttgaactcctaggctcgagcaatcctcctgcctcagcctcccaaagtactgggattacaggtgtgagccaccacacctgacccagaaagcttatttttgatgggcagtgtccacgtcaccatactgtgagctccatgaaggcaacccatcgtcactcttgtcccctgctctgttcccacacctggcttactgcctgtctcatggttggagcccaggaggtacttatggagtggatggaataatgaatatttctagaccgctgaagctgctttagtgaacgtcacacagaacagtgactgcactctttctgccagtctagtgaaagccccctttgcttgccctaggcccagtttatgacccatcttgtcatttcttcaccacctctcacacctgttcactttactaccccttccctcaccactgcttcttctctgggctgttgacatagcctccttacaactctcacagcctcccccagtcctcttctgtcccccagtttctaatctgtcttatctttgccagatgttggattcataagccttgctcttatcctgacctgtcacatcaaagcccctgtactggctcttgatatccacaaaagaagagccaacaggaaactggccccagctcccttcctatatcccagctcccattggccctctggagggctcttgattttggtcaaagtctatctgcatgtttgttgttgttttttgtttgtttgtttgtttgttttttgagacggaatctcgccccgatgcccagctggattgcaatggcacgatcttggctcacagcaacctccacctcccaggttcaagcgattcttctgcctcagcctcctgtgtagctaggattacaggtgcaaccacaccctgctaactttttgtatctttagtagagacggggtttcaccatgttggctaggctggtcttgaactcccgacctcatgatccgcccatctcggcctcccaaagtgctgggattacaggcatgagccactgcgcccagctgccttcatgtttttaaaactgccctttcctgctgaaaccgaacctatcctgtctgcatggcctctcaaaagaacgaaagaaccagggcttcgggatcagagagatgtgggttcaaactctagtcacctatttcctaaccaaggggacattgaaaaattccttaacctgagtctcagtgctcttttctctagatgggcaataaaaagtacctacctttacttgggaggctgagacaggaggatcctttgggtccaggaagttgaggctgcagtgagctatgaagcaccactatgctccaacccgagtgacaaagggagacctcatctctaaaacaaaacaaaacaaaaaagtacctaccctgggtttgtgtaaggagatggtatgtataaagggggcctggcatatactaacaatgtaggaatttaaaacatagtagatatgatttttggtaattcctgcctaaagaaaaaaaggctaaaaataagggtataattaattaattgttttctaattctttcccagccgtaacactgaaggttgcttccctagggagggaattacctgggtagagattaagtgtgggtgctgctgcccccagcctaatgggtcacatgccctaaagagaagctggtcagtcacaatgctccctccagctcctctctaccttgggatagaggcctcatgggttaaaagaccaaccaaacaacaacaggacacaatagagaaaatagccagtgagggagaactttttcatcctttcccacagacatatgggatcatttcatgtgtgaacatcatgaaggaggaagacaaagacaaacagaaagtggtcctcctaactgggtgctccctgagggagaggcatgagcctgatgatgattggagattgctatggtttgtataatagtgtctcctctgaaattcatgttgaaacagaatgccccatgcaacagtattaagaagtgtggtcttgaggtcgtgattgagtcacgagggctccataatcataaacggatagggttagggggttagggctcttataaaaagacttgacaggccaggtgtggtggctcacgcctgtaatcccagcactttgggaggccggggcaggtggatcacctgaggtcaggagtttgagaccagcctggccaacatggtgaaaccgtctttactaaaaatacaaaaattagccgggcatggtggcaaatgcctgtaattccggctacttgggaggctgaggcaggagaatcacttgaacccaggaggcagaggttgcagtgagcagaaatcatgccactgaactccagcctgggcaacaagagtgaaacaccatctcaaaaaaaaaaaaaaaaaaaaagacttgacagatggagttcactcttttactgcccttccatcccttctgctacttgagaccatggcattccttccctctggaggatgcagcaacaaggtgccatcttggaagcagggaacagccctcagcagacataaccaaacctgctggtgccttgctcttggactttccagcctccagaactgcgagaaaattaatttctcttttttataaatgacccaatctcaggtattttgttatagcaacaaaaatgaactaagacagagttgctccaagaagaagacgcttaaaacctttccaaagcaaatgggtctccttggagtagaaagctccccaacatcaatgagattctagagggaacattatgatcacatatcagggaagagagtgaagcttcaaatgggctctgattagatgctctctaaagcccagcttcattctgggttctgcaactgaagaggctttagggttaaaagggcttccagttgcttgaaaagcaaaaataaaaagaagaagctcatatgtcaataaggtaagtcattaagaaagtaggtgcttttaataccaggtaatgtcagcataagaatatgtatacaaaggtgggttatttttagtattggttgaaggcacattattcttttgacaattagaataaagaaagcaattagaaactccaggaaaatgaaaagctgtgcagaaaaagctgtagcccaaatataaagcaaatgaaatgtggcatgtctttgagcagctgatggagcataagaaaattgaatacatttgaccttgatgctaaggaccccttctgagcagcctgggcatcatgacattggatcagaaaggaaagaaatgtaattcttggatattccttggctcagcggtgacagtgaactgtactcacacaggcatgagaatgtaatattggtttattgattttttcagagtcaatttatggacaaaatgcagctgttataataatgacttcagaatagtatctaaatgttatcatcatttaaaatgtaaaagtaagactattaaagacttgagagatagaggagagatagaagtcggtttcttattttacatagtgggaagtcattcgattgtatcttcactctatggagtaggatgtaggtctattacttagagctcaaaggtaaccagtggaagaaccaagaatattttaactcgcaaaaaccaggaggaatgaagagtgatgaaagggagccatgcgtatgaactaaaaccttgtttttcccagcagagtgaatgagtttcctaggactgccataacaaagtatcaaaaacagtgtgactcggccgggcgtggtggctcacacctgcaatcccagcattttgggaggccaaggcgggcaaatcatctgagatcaggagttcaagaccagcctggtcaatgtagtgaaaccctgtctccactaaaaatacaaaaattagccaggcttggtggcaggagcctgtaatcccaactactcaggaggctgaggcaggagaatcgcttgaacttgggaggtggaggttgcggtgagccacatcgcaccactgtattccagcctgggtgacagagcaagacttcattaaaaataaataaataaataaataaaaataaaaaacagtgtgactcaaacaacaaaaatttatcatctcacagttctggaggctgaggttgaaatcaaggtgtcagcagggttggtttctgcaggggaggatctgttccaggcctctctactaggatctgttgcttgctggcgatctctggtgcttgcagatgcacggctccaccagctgctttcatctccattttatgttctccctgtgtcttcaccttgtcttccttctgtatccaaatttctcctctttatgaggacaccaagaattctaaattttgaatttggccttccacgtagttattaagacacatttgtcatggattggagaacagaacatattaaatcttttgtagaatttataactttaaaatatttacacatatggccagatgtggtgtctcatgcctgtaatcccagcattttgggaggccaaggcagacggatcacctgagatcaggagttcaagtccagcctggccaacatggccaaaccccgtctctacaaaaatacaaaaattaaccaggcgtggtgatgggcacctgtaatgccagctacttgggaggctgaggcaagagaatcacttgaacccaggaggcggaggttgcaatgagccaagatcatgccactgcattccagcctgggcgacagacccaatctcaggtattttgttatagcaagacaagagtgagactctgtctcaaaaaaaaaaaaagaaaagaaaagaaaagaaaataggccaggcgaagtggctcacacctgcaatcccagcactttgggaggccgaggcgggtggatcacatgaggtcaggagtttgaggccagcctgaccaacatggagaaaccctgtctctactaaaaatacaaaaatagctgggcgtggtggtgcgtgcctgtaatcccagctgctcaggaggctgaggaaggagaatcacctgaacctgggaggcagaggttgcagtgagccgagatcgcaccattgcactccaacctgggcaagaagagtgaaactccatctcaaaaataaataaataaataaataaataaaatatttacacatatggtatatgggcctccaattattcttttgtcacaggccctgcaaatgttatgggcaggcctgacgtgtgtaaccacagccgaagaagaaccagaaaccatcagttgttgctctggagagtgcataagagaaggcgagggtgggagaaggaggatcgtagtgttttgttagaggcctctctgtcaatgtgatgctctgttttgccatttgcatgcttcacttcaataaaacttatgaaaattatccaagttctcacctcctcccttgagtcttcctgatccgcagctctcacctctcttctctcagcttctacaaccctcagcagctgtgccgccttctgtcctgcttggcctgctctcccagaggcccctgaagacaataccacctccccaggcccactggccacctgtcttcttgtctcccccgagaggttccctgggctgaggtcagcacagcctgcttgccctgcctcctcttggtcagcattctctgccagagcttctctcctccctccatctctagcctggtgctcccacctgtacctcctggtagcccctcagggttgggagaaggccaagctctgcccacagtctctgtctggtggctgggggtgggtggggaggtgttgcatggaacagcgctgcagcctcacctcttcgtgagaagcaggtgtctgccaagccagatgggtttctgctgtcagtgagaggctccaccttcctcctgactgtcccaggcctttgccaccactgttctctttatgtctcagtctccctccctcccccttccctcaccctcgctttctgctgggtccccccgtttctccttttctctctctctgcattaccctccaagccctttaccctcaattccatcttcccctggagcagagggattattgtgactcccccattccagaccccagatcctgcttcatcctcagggttaaactaaccctgccccacccactcaacctgcacccgcgtctaatccagacccttcatgctgacccctaacaaatggcccttggcccattcctagtgccccacagctaacagagggtcgtgatcctgaccctatagcactggttccaatctagaactttaaactgaacactcactgtcattcataacactccccagtcccacccctaccctttgggaagggctggggctgaaaactcgaggtctgtgatgtatcctgggggtgcggccaagttctgcattcctggaaactgggactggcttggggaaaaacaaaaataattcctatgaagtatgcttcaattggtgctactgctgaaaatagtccctgaggatgaacatgaaggtcaggagagagcagtgggaatggtgccaggagaggggaccagaaaagtggctggagatggccctgagtggaagggcagtgacagtcagcagggagggcttaggaggccctgggcagacggaggagggaggagagaggggggcaaaggctccagctggaaggtcaaggttattgttcattcattcctttgttcagcaactatttgttaagcacctactaagtggcaggccctttgctgggcactagggggatagcagtggacagaacgaagtacccacctgtgtggagctcacattcagattgcggagatagacaggaaacacactaacagagatgtcaggggaggggagggaagaaggacaagtaaggcaaggtgaggagacagcaagggacaaagactgtttatatagagtggcctgggaaggcctttctggggagctggcatttgaacaaacctcaaaagacaagaggaagggagccctgcaggtgtggacagactttgtccagttagaggaaatagtaggagcagcagccccaaggtgggagcagggcacacgtggggctgcacacagtgagcagggccagagcaaaggggggtgaggccagggaaagtggccaggttgcccaccaaggctcacctgggttcctaggtcagagatcctgagaagaggggagaagccctcatgcccaagtggtgggaaggggtggaggagaatggggaggaaatgggagtgaggccaccccaggtaaggtcagctgcaacctctgggctagggtgacgccagaagagaagatagggcctgcagtgcctctcccccatccacagccctgggtgcacatgccacgagctcctgctcactccacctcacatccccacacttgtgcatgaacaacacacacacatggagaatagtcacaggctcacctttcacatgcatgcacacagaaattgtgcatgaacacacgcatgcacacgggccccttgtgttagtgtagacatttttgagaattctaaacaggcagaatataggggccaaaggactttagaccaactctcacgtatgacagaggcactaaggcctagaaaaaggaagcctcataatttggtgacctaggcagatcactctatgtccccccatgcatgtgcatgttgtgtgtgtgtgcgcgcgcacacacacacacacacacatgcacgcacgcagtcccaccagctgtccaaagctccttccataaccctatcttctcaacagcctctctctcccaggacacccacaggcttaaccaagtcccaccaggagtgccccgagtttcctcccagctattccagcaggctgctggggggaatacagtgtcgggaccaagatagactctgcccctcttggtgggatggctacagcccacaaccacagctgaccacagcagcccccgactgcctctctcctctcagagcctgtttccgggttcagaccttcttcctccatctctctttctgggtctttctcccttgcttcctttctctacctccagaaaggaggctgtgattctctgtttttccctctctttcctggtgtctctctcatttctctgtttctctccagttttctgtctctgctgggcttgtccctctcgctccatcttctcatcaggatctttttttttgccttccaggaaaagctgacgtggtgcccctggtcagtgggagtgaggccttctggggtgggggagtcctggttgagcagccacagctggggtgcggctggcgccctggctaggggcagcaggagcaggagcagagcgagaggcagcggaatgggaggagagagggctggacctctgcaggcaggaaggggagcagggggaaagaaaaactgtgggagggagtgagcccccctcccctgctagggtgaccaactgtactggtttgctgagactgtctcgattttagcatggaaagtcccatgtcccagaaaacccatcagttccaggtgaaccaggactgttggctggtcaccctacaagctgccagggacccacaggagacagggccaggactcacaggaggggctcccaagcttggcctcctagttctggggacagtcagggccgcacatactcaccaagggtccccatctcaggcctgagcccaatttagaggaggccaggagaggggagatggcagcccagacagcccacaggaagctcccagcctgaaaagatcagggagcccgacttctgacttgtctccctgcctgctggcatgatctcctgtgaggtgggctttacagaaagaacttgagctctgacagcaagagaagagcagaggggcaacccaggaggtcatacgccccatcctcagaggcctgcacaactgctcctgggctctgctgaggagcaggcccacctgtcccactgtgagacaccttggagagtcaatagtccttggctgagatcctggcggccttattgtccttcctggtggaagcgggtatggccacaccttgcaggcagtggcaggacctgagcagaccaggaagatacatcagtgaccagcacgcacagtctcatttctgcccaggtgggctggtccctcccacttttcccgccctcagccccccacatctgttttgaggtgggagtctgagcttagtgtttggctgtcattaaggtcttaggtagggaatgaggggacagactccctgcccccagaaggctgctgacatactcacccacccaacagagcatgggtctcctacactgtatgaaatattctctaaaatgtcttgggcatgccccttccctagcctgggcccaaaggccctatctgtaagttgatgaggagatgaagtgggtgagctctaaaatgcttccttctgatgaccacccaacttgtccatcatgccatgaagggggcgcttacagagtgtcttccctgtgctggagatcaatagcacctgggaagttaaggcctctgccctcagtgggcttcctctctagtaaggggtcgcacattaagcacgcatgaataaataatcacagcttataggaggagctatgaagaaaagtcaggaatgtctgagagaacagtcactgggaactgagggctgaggaggtgcttgtactctgaccctgatgtgcttgcaaggagggaggtggggtgggaactatgagctcctcagagcaccctggaggtaaagctggtggcacagactttgtgcaggtgagggtgtgtgtatgggctgtgcagaacatagtgaagccccctccaccaggaagccctccctgactgacactgaggtcactgagtctcccctctggtttactgaaccctggatgtgtttcttgcagcctctggttggcccaccaaattcaggactttcctagaaattctccagcacagtcaggatgatgcaagagagggcttcctctgcaggggaaagagagggtgctctccattggaccataataatatcctcagcatcagactcgggtgttttgcaggcagcatgctggggacttctgtggccttgcttggtgacagggaatggggtgtgatgagctggggcaggcttcctggggatgctttcagccaaagatgagccctgtctgcccttggccctgctgagagggtaagttgagtcatgagcagaattcaaccagttatcagatggaaggccaaggaagcttggggagggctactgaggggatacggtaggcttgtctgtggagagcaaaattcttcagtctacaaagttcttttctgggctccttcatctttcggtttctcttccagctccctcgttttgggcctcttttgtttccccattcccctcccctgggccttcccgtttggaaaaggggtcacatatcctcaccctggaggcgtctgccccttccacacagttggtgttggaacagtggagctcagagaggccgatgctgaccgcgtagatgtccagcaccaacagtgggattttgggccctgtgggggacacagagagaactctccgggagtgcggccccttggcctcccctctgggtgcccagtgggcagtgggcctgggtggctcagaatcccagccaggagcactgaaggtcaacaggctcccgccctgagttttctgagccaggcctccctgtttcctccccagccagtggggagcgcagtgaggggcggggcctggagtcttgggagctccctggacaacaacatgcatttagcgcagctcagtctcagagccagcaggatatgttttcttaaaaaaaaaaaaaatgcctaacatcttggctttcaccgaagggttggtatctgctttgtacactttggccttcttggcttttcactgaaacacacacacatggatgcacactcacttccacacacaaacccacaccaagacagacacacacacacactcacacacaaactcatgtacatggtttcatacccacatccatgcaaacacacatacaaatccagaaatacgcaccctcacacccacaaacttgtacacacacacacacgtatacacaccaacacacatacaaccctggcttggacaaaagcttcccgttttttcttgtttgaagtggaaatctcccaccttccatgagattcaatttctcgcccttcccccgctaaaatcctcctggccccatcatttcttgggtcctttccagacagtgctgtgtctttaaggaagttgaagctgctaaaagtgagtgagagagagagaaaaaacacaacccaaaaaaatttggcatctcttcccccctcaagtttctggtgtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggccaaggcaaagcatacctatggggggctccggtgggagggactgcggccaggatgtgggagggcagggggaggttctgcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcccctccgtgtctgcctggaattttgtctggatctaggagcctctgctgggagataggatcaggagctgaagagtcagggcagccagcctgcctgcccacagtggcaggggcctctgagactccaacagactgtggaggcacaggagtgctggcccgatgctgtgtcaggggctgggccttgcggtgagctgagctgcagatgttcccttcctccaaaccatcccacaggacagctgggggcaggagcctggggtggctggcgaccctgagcagcgcctgatgtcagcagtggcttcaagagaggcattttggaaaggcgcaaggaaatggaagtgcctgggtggtagctcctcttccctgtcctgctcctggaagagatgttaggaatgaagaggaaagaggggacaggtggggcaagatggaggagacagatgaggagaaggggacacaggacagaggaggagaaagccccagagagactgggaataagagaacatatttacatatttgagggagaaaccaggggggaaacaaatcgtacttatctttctcccaaagaagaaatggtattccaagaggaaagtccaaatgaggactgcagattccctgtaggaatctttccccacagagcaagtggatcagtaactggcctgggccgtgtgtgtgtgtgtgtgtgtgtgtgtgtgtgtgtgtgtacagcaacctgagcggtgcgtgtgtgtgtgtgtacagcaaccttcagcctctccagtgcatgtgtgtgtgtgtgtgtacagcaaccttcagcctctccagatgaggagcataaggatgaggtcctaacctggagactctgcacaacctcctatctgtgccaggtaggatatatgtcttcctactgcctctatcccatccctttcaagatcgaggatgctgcatgcagagacaatggcctgggggagaggctctgtggcctttctccagagctcccagaactgctgagctcagcaaagtggaggcaggatgctaaggagtctggggtagcagctgtgagccttggctgctggccagccccattccctccctccaggtccacatacagcacctccccctgcccactctcccctcatcaacttgcagctcctgctgagctgatgtcaccagcagcatgtatcaagaatgactcctaatctaaaataaaagttgaaaaaaatgactcacgtctggtggaaaacagcaggatggagccaaattccatgcgctaggccaccttgggtaagtcattgcccacgtctgggcttcagttgcctcaaaaaccaaatgacatggtaggactaggtgctacttcatggtccaatagactctgattgcctaaggcttgatattcccagcctgacttggacatccctggctccattcctagctgagtggcttggcttcttggagtaggacatggacctaagacctaacacagggaatggctgtgccttgagtggactagctgctcccctgctttaaggtcttccgtggtccccactgccctccaggtaaagcctgaattccccacttagagcctctctgacctgctcctccaacaagcgcacccttccttcctcttcttggaacagctatttaattgttcccttaatgttccatggtgtgccatcctctgcacctttgcttatactgttccctccgcccaggcaccctttccctgttcttcatttggctaagtcagtctttgagagtgggctctggcatcaccacctccagaaagccttcctggatgttcccccatccccaatgtgaacaggccccctttctctgggaacctggattctcctcccctgagaccctgttagttgctgaaacaaggtcaggaagcctttttcaacgggctgcagtgggatcacagtgtgccctctttggcctcctcggggcagccttgaaagtgggtttcaggtccctgaccccacccctggctttacaggtatttgaggctgtagcaggaacctgagcttggggcaggggactgttgatctccactaactgtgcaggcatttctcaaggccctgctgacctagatctgtagggtggccacatcttcctaccctctgtagcccccagcccctcagtggacccagggcatgttctttattcatataccccgccctccacctccaccaagcccccagtagggaaaagaccccagtctgtctccaccctcctttcccctccgtattctcattctcctcccatcaggacagcctacgctatgtccccccatgtgacacgccccttcctacctccacacctggagtcacactgcttccccagcattcctgaagtcgcttctcctccccagatcctgccccttcttcaagacccagaataagtcccacttccaaagccagcattcacatggctcaggggtggcatcatagggtccccagtctctttgccacccaaaaggatgcagctatgggttctgccttccacccagtgtctggcccagcatgtgaccagaacaccccaagccccatccccatcaatgcacagtgttcctgacagtgtaggcggggttttccctgcatacccctcccgctatgaggacagtttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatctgctcctcccggaaggcagctccccccttctccagtctggctctgcccctcctcctgccctcacagacctcccgcccttgattccgggatcagaggaacccaccccacccccatctccagctcaggcacagagcaggggctggggccccacacaacacacagggcggcttgtctccagcggtatagcctctccacacccccaaaccgtttgctcgaaacttgatctccttggccctcagagtcacctcagtggagaagcctgcacagggctttgatggctgagtttccccagatgtggccttagagaagctgaggaaccccctacttacctccatttgtccccatccatcactcccagggggccactgcctgatgaattgccagaggggaaccaccagctcggctcttaataaccggatctgcatcctgctgctgcccagctgggctgagggccctgaccacagctaaggggagtcatcacagggcttcagggctggaattccaggtatgatctattcccaggggaagtgaaaaaggccccctcggagctttctcttctatttctcacttctcacagacaggctggggttctggagtcctgctcttcaccccaagtacatgcctgcaacctccaacgctgctggacagtcggctgcatcccccctcacctgagcacaggctctccctacccctccctccccttcctagagggggtatcctgcagggatgcagacaagactggggaaggaaatggtgctcagagggtgctccacctaggtgctgtggcaagcagggcagggagagagtagataaaggccgggccaagaagcggggccctaaattctcaggagaagggccctggagaggcagtctcttccttgaaggagaaagggagtgccatctataaaaaggtgggaccacaggcttttgtatgtgagattggcttccaatgatagtaaaagaccctggaagagagaaggacaatgccagagccaggcctgcccaggagaggcagggagagagggagagagagagcagctcaagccgagaaagggaagcagccagccagcttggatctgatcaccatcttgtccatggagaagaggatttttagttccaaagggttaaacccacataaagagaaaattaacctttggcacacttttaggaatccattcccaaggaatgcctgcatgcatatatatggagacaaaattcccaaggccgtttgtaatggcaaaaataattggcaacaaccccaatatccatccatcaatgctgataagttgacacactgaagtactattttgctgataaaaagaatgaggtaattctctggactgacgtggcagaacctccaagacatattgccaagtaacagtaaccaagaaagcaagttgctgaacaatacataaatcgtgatctcattttatgcttctttaactaggtagacatatgtgtatgtatgtgtgtacacataaaaagtgaatctggcagacacacagcaaactgttcacagtggtcacacttgggggaggggtgaattttggagaatgaagcaggatttttcacttgtttgaaatgcatattttaaaactcatactgcatgtgtaattctttttaaataagcctgctgtgagtaaggagctgtgaaggcatcactgagctgtgtgaatttgattccgtccccagcccaatattgcacacttcccagtctcccttgaagctagatgtagcccttagactaggtattggccagtgacttggaaaaagagtgttgagcacaattcccaggttgtgttctcaaaaagagaggtgttctctttaccccctcctccttctagctgggtgaaaaacagttgtgatagctggatctcaggcagccatcttggactatgagatagaagtcatgagttaagtagaatagagcagtaagttactggcaaagacagagccttagctaaggccagattataaggctgaaggagactcctgctgtaccccagactccaacacatccaaaagaaacttaagcccagagaggccacatgatgtgccagggtcagtgactgacctaggggaagttttgccagagattcccccccaccactacgcacgcacacgcacacacacacacacacacacacacacacctcactgctttttcccccaagaacattccttcctagagcttggactccgtttcattctatggctgggagactccttctgggattgagggaaggccccaagtgttgattaagccaaattgcaggattgggacacacctctcaatactctgtctgataacacagcagaacccctgcctactgctgggtctctctgtcaatatctgcccctggcttttttttttttttttttttttttgagatggagtttggctcttgttgcccaggctggagtgcaatggtgctatctcagtccactgcaacctccgcctcctgggttcaagcgattctcctgcttcggcctcccgagtagctcggattacaggcatgcaccaccatgcccggctgaatttttttgtatttttagtagagatgaggtttctccatgttggtcaggctggtctcgaactcctaacctcaggtgatctgcccacctcggcctcccaaagtgctgggattacaggtatgagtcacggtgctcagcccctttctctctttctatctggttgtcctcctgtctgcctttctgcccctgtccatcagtctctctgcctgtccctggtatgccactctctgtttcaccctctctgtgtctgactcagtctccctcctttccttctgtctctctctactttccttctgtctctcctcctccttctttctctgtctaactctgtgttttctctctatcactctctctgttgtttcctttttgtttctctctcctgctctttgttttgctccccactccccagtctggctgtgaagtttgtgtctctcctcctaaaggttttaggcagtaccttttctaagctagcctgggccatgcctaaatctctgatcttgggccttgtcttgtgctgactcagtgctgcccctgccatctcctgccctctttcccgccttacctgctctgtctgtccccagtgctgcaggatgagtggcgctggtctcgggatccgcagagtctacagggccctgggcttggacaccgtctcaggggtttgtgccttcagagcctggtggagcagccaagcaactgggcacatgaagacaaaggtcagtgctgctgagcagtaaggctaccttctccctcccgccagaccaagaactttagcccctccaaggcaagtctggcagaggggggctgtcagggcaagcccagggatcactgatgctgccctagctcccctcctccagctcctgctcagctggaggtcagagcaaaaggacttgagggatgacccaagactttcctgacagtgcttggtgctggagcccggagcaggaggccaagagaggaacggagtgccatccaatggcactggcgtggcagacaggatcacagttactactcatggcagaaagcttcaaagtagccaggcccctcggtggaaggaagagacgaggcttctaattttgtttttactacttactagctgagtgaccacaaatgcagcctgttggaactcagaaaataacacccgaaaatgaaagcctcagaagcaaaagtgaccttctagccttctcctgccctcctgtgtctcaggcccgttttcccccaaggacggacatagaaaagagaatccctcctcctcaaggcgggttatagaaatcaaaaccccttttccccaaagctagccataaagcctacaaactctaactttccccaatttctgtgtaaaaactggccacaaataaattctcaggcctaggtggggcatggtggctcacacctataatcccagcactttgggaggccgagtcgggtgtatcatttgaggtcaggagttcaagaccagcatggccgacattatgaaaccccgtctctattaaaaatacaaaaattagccaggcagtagtggtgtacacttgtaatcccagctacttgggaggctgaggcaggagaatcgcttcaacctggaagacggaggttacagtgagccgagaacgctccactgcacaccaatctgggcgagagagcgagactctgtctctaaaaaaaaaaaaaacaaaaaaaattctcaggcctaccttgtttgattgtaggtcagacctccattccagaaagtcctgccccatacccacacccagaaggaagaaatgcatgctcagaggggccaggaagaaatccagagagacaggccttgctgggtgtccccactccgtctattcacattcgatcattgccctttttgtccagtcatatcgctacacagctgtccatgtgtccttgaaactcagcataaaagtggacaattttccctgtatctctgggtccttgttctgaaggctcctgtgtacatgttaataaggtgtacacctttcctcctattcacctgcctcttgttggtgatttctagccaaccttcagagggtggtggggaagctttcccctggccgctgcaagcccctccgtgttcggggttccagttttcccatttgtgtgacggagggagactggctgccattcttccctttgctggtctgagcctgtgatcctgttgccctgtgggcctctggcactgtggacttgaagggaagggagtgggaagtgggcctggggtgacgtacccctgcgggggaagggaggctgctgcagggggctgggtgctgaaggcccagggtggagcagtgatgatcgcatgatcacctaatcgcagtggcccaggagtcaggagatcagaggtctatcccttcactagccacgtgctctctctgcacctcagattctgcgcctgtggaaggagatgagtcccagccccagatccttggctccagagaactcatgggctccctgcttgccaggattcagctctgcctagaggaaggaagtaaagtgggggtggggagggagttggaggtggatcgttgaagataggggtctcagagccctcaggggccatgggggtgtgtcagcgggggaggttgaaaggagccattgtgggaagcaggaagggggccctctggggtgggctaattataggccctggctcttccaaacaaagccagcggcctctgagtggccattctttgggggaagaaagaagactggagggccccattaaggtctttcacgctgggactttggaaggtggcttggaagttcgccttccaaggctgctcccttcctgcctccctccactcaccccagcccacatcccttaccccttcttgaacccctctggggaaccaggccctgccccccagagacagtctcacctggagtttaaactttttgaaaaccgtgggaggctgaatcagggaggcagccaggagtagagagaaccctgagaagggaggagggatctggtgctgccctgcggccctgggctcagtttcttcatctgtaaaatgggcttgccgtctagccctgacttgctgaaattcactgatgtttccagatttctacatagaactgaggccagactcagagatgcctgagcatcagggtttctgcctcctgtcctatttactaccctccaacactggtaccctccctcctcaccacctgcttgcccactgaggcaccaggttgcatctctgagtctaaatttgactcaaaagcccaaatggtctttgcttgtcacagatggactccaaatgaaatagccaaaagaactcttattcctttctgcataagtagaagctgggttgaatttcttcatcacttcattcattcatgcattcattcatttattcatccataatgctttaaccatttcccaggcacctatccctcgcccagcgtgggcacacaaacatgattcctgaaacaacattcagggcaatgaatgatgacttgtgtgggcaagtcatcatttgagacaggagaggaaaatgcaaaatgggatggaggagggagtcactaacccgggtcacaggggaggaggcttttagccagtctgcaggatgagtagggctgctgtcgggtggagctgggcagtttgggtagtggaaatcacaccagcaagggtagggaggtgagaaagggcagacctggcctggagcaaaagggaaccttccccaggacattatgttaagtgaaataagccatttgtgaaaagacaaatactgtaagattccaattctatgaagcactgagtattcaaattcacagagacggaaagtagaatggtggttgccaggagctggggggaggtggaagaagttgttgtttaatgggtgtagagtttcagttttgcaagatgaaaagagttctggagattggttgcacaacaatgtaaatttatttaacaccactgagctgcacatttcaaagtggttaggatggtacattttatgttatgtgtatttgactacaatttttttttaaaaagtaactgtacacacacaccaaaaaaaagtaccttccccagagataatgggagaggggaggcaagaaataggagtgggtgtggacattaggtggtggaggatcctaaaaccttgctaaggccaacagagccacctcagattctttgtagaaagttggagggaggttagccgggcgtggtggcgcatgcctgtaatcccggctactgaagaaggctgaggcaggagaatcgcttgaacccgggaggcagaggttgcagtgagccgagatctcgccactgcactccagcctgggcaacaagagcaaaactcgatctcaccaaaaaaaaaaaaaaagaaagaaagaaagaaagaaagaaaaaaagttggagggagggaaagaagggagagcaaggggtatgtgggaagtattgaagggactcgggataaaccggcgtgattctgagcgtgggccctgcttgcaggggatggggccaggatacgtgcacaaaggttggccctagggcagaagcaactggactcctatcttgtaacatttctgctggtcacttcaaatatgcaagggaagagagctgctattactgagtcactaagctccaagacctcagacctggcagaggtacaccaccgcctccagacccacactggttggccatgcccagccgctgaggcaaaggtttccaggtagtctctgccacctaccctctccccaaaatggccatactgtggtctttcccgacatgaattatagaatttcagactatcagagctgagagatgacttatctgccccactaccccaatcatacagatgggcacactgacacccaaacagaagggatctcctgaatttcacttacaagtcaggcgactagaactctttgtctcagcttctccctgggggatctgaagaaactgaattttaatcattgcagaggaagcctgctgtatacattgggacctgtagctgggctggccaataccactttttttttttttcccgagatggagtttcgctcttgttgccaggctggagtgcaatggtgcaatcttggctcactgcactccagcctgggtgacaaagtaagactccatctcaaaaaaaaaaaaggtaaactaagggcttgctccctgagaatagacactgtctcccttcccttgagactcccctacaccccaagtcaagaactcttgagaaagaataggcatatgaacaggctctcccagaatgggaagttctggataccacgtacccatgagctccccacaccagaatcttcttccttgtccctgctctaattttttccatagaacttaacatcttctagcatacattataatttacttattttccatatttagtgtttatttttgtctgtctctacccacctcccccactagaagataagcttcagagggctggagttattgtttggttcactgctggattccaaatgcctaaaatagtatctggcacacagtaggtgttcaagaaatatttgttgaaggaacaaatgctaaaaggaagggatcgatggaaaaaaacttccctgggtcaggcccagcttcctgccttgttacctggtttctcctcaaacaaacagaggtgggtggggagtgtccctgagcacccagcctgcaggctttcagactgggtccaggctgggctgtgggtgagagggtgcagtgctcagcctggcagttggtctctcagtggccatggcattcagggggcctgaaccctgggtctctgcatccctgctgagacagaggctgaaggccgaggagaagacgctggatctggagttcgaagttttgagcgtggggtttaatgaggcgggtagatacgccctgagactgtcagcagagaaccccctgcaggtgggctctggggctggggtgcagttgcaagtgaatgatggggaccccttccctgcctgctctgctatcactgatgtcattgagcagcaggagcctggccagagcctcaccctcaccaggagcaagtttatctttactttgcccaaaggtatgaagtaggggtggggtttgggggagagaaagaccctggaactcctgcctgagtccctttctgggaccccagagagcctcaggagaactgggagggtggggtcagagctccagactgcatcccaaagctctgccggtgtgaccttgggcaaattctgggcctttgtaacccgtgcctccttcagtgtggcatggggacactggtgcctgtcacgcaaggtcaggtgagaaggaaatagaagggcagatgagagatggctttgtaaatgtaaaagtgctgagcacacagtgggtttgggggccagtcctgagcagtggacattacaccgagtaatattatactcagccctgtgtgcctgtccctgagccccactagattgtgggtatgttggggtggacagaaatgaggggacctgggccctgccttctggaacttccagagcaggtggagaggaaggaactccaagcagagaaaagtaaagtgagctggaatgagaaggaaatccatgcctagactaaggccaccctggcaggctgcctggaggaggagggatgtgagggaacagggaaaccaagtcccagactttaaatggctataaatcaggggcaggctgaactcttccccagtctaggagtctatggtggtggcaggacctaggatcatcccacaggctaagccctcccttcctcacccctgcccggtgggcttggattgggcatcagcaaagggagggagccatgggtggggcctaggagggagtcgcctaccagggaaatcttagccaagactgcttggctttgactcaaagtctgggcagcccaggtttccccagggccctgcctgtcctcctagtcacctggcagatgcagagaaacctgagaccatctctgagccctgtgttccctcatccaggtttctgcaagaatgacgggcagcatgatgctcagctgcatgtggaggcactgaggctggacgaacccttgggacgggcagcccagcgggtgggtgaggccatcttccccatctacccgaggccagaccaaccccgcatgaacccaaaggctcaggatcacgaggacctgtaccgctactgtggcaacctggctctgctccgggctagcacggaccccacagcccgacactgtgggagcctggcctacagtgtggccttccacgtccaccggggccctcagcctccagtctcagacagccctcccagggctggccagccagaactgatgtcaccatgcccagagccccagctccccatactgcaggtgggtgcttccctggtcccagttcaggttctgggctcaccgggtacaagacccagcctccgtgataagccaggctaccccctgtcctgagctgagctgagcagagcagcagagctcccaaggctgccatgttcagtctgaggaacgtgcagtctgaggatggacatgggagtcccagttacaatgggcagacagaaaatggggcaaaggccacacagagcagggagccaaccaagtggggtttcttttgccctgtgggttagtgtcccctgagacccttcagttcccaacctcgttctcaccagtttttgtgggaggccccgagtgaccaggggacagaagcctcctctgtgtgcccaccctcaagcccatctagcatccaccctgaccaggaggggctcaaccccaacccaggacccaggtgagagagtctagtccttatccgaaatataggaggcttctcccctatgaccatgttctgtgaccagacagcatgtctagtaggcctcacgccagcacagatagaagctggtagagcaagtagtagcccatttgacaggtggagaaacaggcccaaggtatgcttgatgccatttaatgtcaacaacatttcctggaaaccttagtgtataatagtgcacagaatccaaaagtgacagcacctaagctcagggtgtcgcctggcttgaagacagttgggtatagtgagggtatcatctatggtcctgtagggcatgcctggcaggagagttctggtgagggattgtacatgtcagattttggtgactaggaacggcttcttggaagagggtttatttgaggtgaatcttcccattcattccttcatttacccttttatccattcattcatccatcagacatttgttaaatgctaactccgccgactgcctgccaagtgggtaagacttagggatagcaatactgggctttggggagggtattccaggaggagggaccatgatacactggctaagaggaagggagaggttccgctggcagtagaagatgagcagagattggagccagaagttgacaaccaaaggctcttggcccatctgcggtgcttctctccctgcagtgcattggtctggtgctgaagtggagcccaggtggtggactgtcaggctgggagagggcctggggatgggagaaagtggagggagtcgagggcaccaggaagagcagaggtggatgttcatttcaggaggcagtggggaacaccagaggggtttgtgcagggtttgtgcgggagaaagaccagatctgagctgtggtttaggccaagtgatagggcagcatgtaccaggataactacgaggatgaccaaggacgcagggacccagggaccagcttctcttgcccagtcactcagcctgttgacatggcccactatggcctctgtccattaattcattcatcagtcaatcaacacatacttttgaccacttcctgcacacccagctctgtgctgagtgctgatcttgtaaaataaaatgcatgtcacctgcattcctaggtgacattctgttcccttagactgcaagctccctgacttcagggcctggtgtcctacagtttgtcacaggactaggcacacaaaagctgtgaactcggaagaagctgtcccctgctctccaggtcccagagtgccctggccacctgagccacaggccacgtggacgatgctcttcaggctgcagttctgaatgtgtgcgagggaggggaaaggggactggcgagatggctgagtcgaactcggcagctctaatttctgttatttaaagccatcatctccccaccatgctccctcttaaagtgtcagatgtctgcttctgccaagacaagaaaatggctttcaagggagaggaaaatcgcttccctgggggagagtggggggagagtcagcaatcataaccctgacgacagggccaggaagcacaagggagcagacaatgaagacaggtccttcagagaatacaggggctgtttcagctccagataacttgctctagcagttcaggctaaggaaggcaggcacctttctggtgctgctacttggaggctcaaaggcacagctggaaggacagcagcaagagtgggctgtcagcgagcaatattcagatcaaagctacggatggatttctggctccagatgcaaatgtctaggctcaaagtcacctcttccaggaagccttcccagcattgattttatccctcccaagttatcctcagtcctgactgtgatcaggcatttcaacaattgaatctattcaattcagaacttggttgtaggctcacaagttgttctccagtttgtgtagtgtgtggcactggtttttttttttttttttttttttttttcaccagaactgatgatggtcatggggggcagtggagcaggggcaggagagcaggatgagcaggaatgcaataatcaagatgatccagaatgagaaggaagcggaagacaaggctcagtgtgagaccagggtcagagctcagcaaacttccacgactggctttgaatcagaatcattttgcttctcagccacggcccctgggttacacagccttaaatggccctgccaatgctggtcacagcattccctagtcctggagactcgggaactaaaacaatcaattcccctgagcaataaaattatggacagtgaacaccttcgcttctccagtccccaagcttcctgctctgtgtgggtggggaggtgatggtgggagggactgtcctccatgaatatttccagcatgcacaatcacagctccaagatagaggtcactccctgagcccttgacccaaggatggggatgctgggagcatgcaggcaggggctgcagagggaatttacccacctagagggctaactatttccaggttcctgccagccagagcagcagcccttcccagaggctcagggtgcttcctttctgggtagagctccactacactcgtcccaccccctcagcgctgcctcctgtcacctcttggcaggtttgagaccatagagctatgcctctccagctcccagagcctctccttccccggggtaagggggagttcatcagaccagatgagggtggcctgttcggtgctggacagagcaccccggggtgaggaaagcagcaaggtgcaacccaaagccggcaaaaaggccatcagatgtgactcggctggacatttttaggggaaaatgatgactcttggagggctggaaagggcgggggagaccacaacagctgtgggcctggggctgggctctcagaggccacaacgcttctggtacctcactgccctctccaagagatccctgaaagtctactgacagtctcccactggcatagctgttcaagagggaaactggaaattcccagagatataatttctggaaacgcaaattttaaggttccttgtttgtagctctgggagccatcctgggggctccctcgctagaaggccgggaactccctcccacacagctctgagctctggaaggagaaggaggggtgcactgctcctccctcccccagcatttacctcttcccaacaatcgcagttttgtttcatagaaacgatttcgtttcccaggagccttttaaatgacactttcaaggttgttttttttttctttttcttttctttttttttttaattccttccgtttaaaacacctttttttcccccaaggggaaaaaaaggagaagaaaagctaataaagcaatcaccaaacgccaagcacctggctctaagcctgtggattctgattgtgaatttggcacccactggctagggggctttcattaaggagaagtggaggggaaaggagagcggccacggagctgttgtgaacggctttcctagcgtcccctcggccacccctacccccatcccaccccactcccccgacccccgccgcctgcatgtctctggtcccagttctagttggagctccaggccggcgctctcccagccccaggcatcctcttgcctttaaggcccaagcactccgtcctcactccccccgcccccatggcctgcttttaaattcattatgccttttattgctcgcgattgcatacactatttctattgccctggagactggaatggttcaagcagggagaggcacatgatgtggatttcattaactttactctttactgcccgtttaatctcaggggtgcagcacgggggtgtgagtgggggctggcgtggctggggaactgggcacctcttcgttcatgccccatcccctcagtgctggacccttgggttagctggtttccctcatcttctgaagcctccccttctgccactccctctgctctcctggtgaggggagttgtcactggcccatttcacaggtggggaaagagaggctctagaaagcaatgcttgggctgctaccaacaaagtggtgggaggtggggaaggtgagaacaggttagatcaggactgccagcccctcccaggctgatgtcccagcccttgggtactggggttccccctcctcctcctttcctgcgcttcaccaaacacagaggactggaggccagtcagctcctccttgcaaatgaggcagttttatgggctttagaaaaacactccaattgttccctcaattaccctggagcggattgaatatattaatctctctcttaactcgagttagagactctgctgccacccctcccccagccaccagtgcccctctacaggcacgtgccagagattgactcccagcccccaccctctgggcctcaggcccgagcaggtcagccccgtccaggcagcatgcttctgctgaggctgtgcccaccgccagcatacacacacacacacacacacacacacacacacacacacacacgcaagcatgcacacacacacacacacacacagcagacagcagacagctgctttacatttctccatcaatttacattgattttctcctctgccactatttggaagagccttttccttgagtaaacacgatcatgggggctcccccttgagtagggggtgggaaggggactgcaggcagctcccccttctcctcctttgacaactgcctccagcttaaacacactctgccccaggcagctgagccccgttaaaagctacctgaggtttccctttgtagctcgattttcttttatttcaggggaacaaaggcactgtcatggcgttctcagagaatgctgtcacccacgcagggaggggtgcagaccggcaccatggcggagagagaggtggggcaggcaggtgctggccctggggaggctggggtggggggcacttccagcccccacttcacccctgcacctcccaccctgtcagggagagaggccaggggctaaatacatcgtgatcaccctgcaggcagcctgctggctccccttcctcctctgggtgcgttgaaacactctccattcatggggtccctgaaggagagcccagaggtcctgggcagcatggacgagactcaaaattgcacagtttgagggagtcccatatttgtgtccttgcccaagcctgtccctccacccctgtgcttccagatttccatgtcatctgtatatgcttttagggtcctaacagggtctgtgcctggaactcagcagagtagaggatgggagggatttgggattcaaccagcttagggtgagaggcaggtgcatggaagtcaggaggacctggatgctgattgggctctggcattgatttagcagcgtttgacctggtgcaggttatataacttccctcagcctccacttccacgtctgtaaaatgggagagagcaatttctgtgccctttattgctggcaagatgaaatgagctagtgtacagttagccttgccctgcagtaagtggttaataaattcctgctgttctagtaatgatttgggatgtctgtattgggcaaagaggatgtgtctgggccttggtttctgcacctagaaaataggattgctccttcttgcccagccagtctcccaagggaggggtgttaggagcttgtgagtctcactgtgtctgggcccagattccaggttgcagggtggagaaggccagcccagcctgggtgctagtctgggaagagcctccattagcagattgttgtaaccgaacacaccagatggccctgctgtcctccttcatctctgcctttcctcaccccagccaggggctgacgctgactcacacctcctggaggcgtgtgtgtgtgtgtgtgtgtgtgtgtgtgtgtgtgtgtgacagagaatgatgtggggggagatggagaggaaggggttgcctgcctctgatgtcttcccaaccagaccagccccagccccagtgagcagctgatgggctccagggaagggaaatgtggtggccttctcatctccagaaattatcttcacagtgaaggaagcgggcataatgtgcaggaaggcccagtgacgatggccttttcttaaccttacacccatggaaagcggatgtgcccccaactcctgaacaccctccacccacccccaactccatccaccctcatggatgctgcgacacacaaggacacatacacatgcacacatacgtgaatatacacagacctccagcatcctcaacatgcagagacccccctaccctccacctccatctcaatgatagattcaccccgagacaccaatggacatgcctgggaagcgcacatcctcccacacacagactcgcacctccctggatctcctgcgtctccctggttccatctctgtacaacaaccccaagtgcagcaccaggtgagaaagggacttggggacatggcatatgtgatatatgaggtgagattaaaaccctgcgtgaaacccatctttaatatacctctgacagtggattagggtggggagcagcagggtaggaaggctgacagcacccagtgagcccaccctggccctggtgaggggtagggctgttaggccagcccagccacccccagcctgggtcctgggctagttctgcagagtcctggggtcaggagcagctgaggccagcaggtaccaggccccgtcccagggaagatggagaatgcgtgtgggacgtccttcctccacctggacctgacagcctgccctgggctccaaaggtccaacctccctcagcctgaggtgatgatcattcattcattcattcattcactttcccaagcagtaaactgggttgctgtatgtccagccttcagggagctgccaggctgggcagggagaggaaataggaggagttgaggaacaatcactttccaagccgattgtggaggaagtggtgggcatgagctgggtggtcgtcaaggactcagtctgttggaggaagacagttctgctggcagtcagaagacttagtttagaacctcatttcccagttgcatatgagcagttatgacttggagcaggtcccttacctccctgggcctcaaattcctcatctgtacgatggacagagtcctatctactaacaaggaagttatgaggctcaagtgaggaagagattgggaaattgcgtggtgctaacaacccatcccacaaatgtcagggagacagttgcaccctgcctctatggtggggtgggattccagcagagagtggggagaatggttttcaagggtgagccaggcacggtggctctcgcctgtaatcccagcactttgggaggtcaaggcaggcagatcacaaggtcaagagttccagaccagcctgaccaacatggtgaaaccccgtctctactgaaaaatacaaaaattagcccgtcgtggtggcatgtgcctgtagtcccagctactcgggaggctgaggcaggagaatcgcttgaacctgggaggcagaggttgcggtgagccaagatcacaccactgcactctagcttgggcaatagagcgagactccatctcaaaaaaaaaaaaaaaaggtggaggacagtgtgagcaaaggcgtggaggtattcgagggacaagcaagtaggggggaaacaggaggtggagagagctggttcgtaggatggaggtggtagggagttgcaggggatgccaatggaatgcacaggaggtgccatctctgagtacttcgagctctgtactatcccctctgtaccagaggctgctctgggccaggctggcagaggtggaacttatatcacatttggcagcctgcagagcccattggagcatcatactggtcttgggaggtaggcagggtaaccttgatagagcccattttctgaagcaagaaactgagcccctagaggagatagacagcttgcccaaggcagtcagtagcaaggtcaagctggaatccagatcaccatatattttggtctttctgagccagtagtcagcacacaggtgggaatgactaacagcatcctttcccagggagactcacactttgcaagctgttccttagcccatttgcaagctgttcctcagcccatgcagcactaatgctgggctttctgggcacgtgaaaggatcacggggaagcactttgagggaggagatttcttcctggtggccccaaatcacaccgagtcctgccaagacaggttacttggtattacgctggccccaacaatgagtgctcatttattgcactgaatggtttgggagcaaggctggggatggagttggggctgtcagtggctcagagtcccagagcaaactccctgaaccactgctgttggctaatgacacttagaaaaaagtgttgcataagtagccctggcccataattaaggcctttccaccctgtctgagaagtgacagtgagttacagtcaagaaggttcagtagacaaactttggactcaggcttgagttcaggttcctggtctgccttgcaataggtgttcctgagcaagtcattttacttctctgactattttctcatctgtaaaagggggataatgatgtctacttggcaatgtggttgtgacaattaaataacattctagcctcagtgcagtccaagaggtctcggaggagagggggttccaaagacttccagaacacaggcagcctggaagccaccctgattcacagccttggaggcgggggtggggggatgggccacccatctccaccccattacctctgcagagaggtgttactgattcctccatgcaggaagcatttgttgaaccctgattctatgccaggcctggcctctcagagctcttggaaagacaggagcaccacagggagagcactgcagtccctgggtatagaaggggaagcagctggacccaccttgtggaggctgaaggcgcagtagaggggtggaaagtatttgatcagggcagaaaggcagagaggagagtagtgatgggctctggtttcaatccttctctgccccctccagctgtgggacttcacctctctgcacctcctttcctcatctgtaaaatgaggatgataacaacactcgccagcaggactgttgaattcaatgtgtagtaaatttaaagactatagccaatgctcacaaaacgctggccattctcgtgacgccgagtgaatggcagcttgccaggtaggcaagggttggacggaaaagcttgaataaagacccaggggctggagagactgtggcttctttggggaacttggaagctctctggggagccagtgattgtgggagcagttgaggggctgggccatggggcccccactccttaccccacccggaagcctggtcttgagtcactattgggccagtggagctcacggatgggcatgggagcgaggaggttgtagacattattttaatcttcctcttaaagcataattgctttttgtcggcgggtgttcctggagacgcctccccgtgggattgttttccaggctcctctcttccaggagacaggcaggggccgggccagctccacgctgcattaatacgctgcaaatgcgatttcatggcctcaaatgagattagggccagaggctctgctctctggtagagatggcgggtggtgtgagcgaagggtggcgggcgctgagcagggaatctgagagggagggagcccgggctgacttggcctgagtgagcagtttcctgtaattggagcccctcggacttgctggcgcatcccggctgcagagccaaccctgaggccctgtccagtgggcgaggtacccaaggctgtcacccccacccccaggctccccacaagcacctcagtaaggagagtgctgtgattaaggccacagtctctgcagctaggtggcctaagtctgaagcttgcctccattttcttatctttaaaatggggacaacaagctgggggcggtggctcacgtctgtaatcccagcactttgggagaccgaggcaggcagaacacttgaggtcaggagttcgagaccagcctggccaacatggtgaaacccagtctctactaaaaatacaaaaattagccaggcgtaatggcaggcacctgtaatcccagctacttgggaggccaaggcgggggaatcgcttgaacttgggaagcggaggttgcagtgagccaagatcccaccactgcactccagcctgggtgacaattgagacaccgtctcaaaaaaatagaaataaaaataaaataaagtggggacaatagtagcacctacctcatatgtcattgtgaggactgagttaacgtatgtaaaacacacagaatattgctcactgttagctattattatgaggttcctatacacacccgtgcatgccctagcaaggcgagaaggcactgggggcttggactgtggagagggagggtttgggggagcaggcatcactgtcccaggctgaagtagcaggaaggaggaagatacttgacacaaatgtcatccctcactcatacatcaagcacccatctggtgccaattctgcaccaggcaacatgctgggccctggggacatggtccccgcccttggggaagatagatcctgtcccagagaagcccacagtggatcatgagccagggcaggggaggcccatgggctgtggatctgatgtccctgaggtcgggtgggggaaggttgcagcgaatctttgtgcaggttgtgcacaattcaattgtgtcttgaattattcaggctggctggggaagagggatggcccaggcacatggaacagtaaaggtgaaggcctgaaggctggagagaccactgctccttcacagggaccacaggcatgtcatgagtgtgggtgtgagggcctggggtgagcagaccaggaggctggcaggggtcccctgcagtgatggggtcctactaaggtgttttttgaagcagaggagggccttggtcagatttggaggttggaagagttggggtgaggggacacaggtttgctggaaacaggttgagcctattgtccccaccccaaggcctctctgccctctgagtagaccccccacccaaccttggcagagcactgcttctgcccctcctgatggaaggaaatggcaggcagcttcattgctcactcctttattcagtcccttgttacacgagttattgatttttcaaaagaaaaatgcccaaaagcaacgttgcatctttagcaaagtgatttatgacatgatggagggagctgggccgccccaaatgagagctgtggttgccaaatgccaagaggaatccttcaacatggcaatccataaacgtgcctgctaagcaaatggaagccgcgttgtccaacaacgagaacatcacactctactcgtcacccccaagtctcctgttgccaaagcttgggccagaggtgctccatcttggcatacattggtgtaagtgtgagggaaagctcactgtggggctgcctaccatgtgaaggcatccattctcttatctaatcctcgccaccaccctgcacagagcctgctggtagacctgctctgcagatgaggaatgggaggctctgagggatcagggggtttgcccaaaccctcactccggtgcctggcagaaccagggttagagccaggcctgacagattccaagtcatcatgctttttttctttgctgccaaatctttttgcctatttggtggtgaccagagcccacaagaactaggtgcagcaagagagggtcaggactatcacaaagtctgctctgagacaaaacacagatacacaagggtttagcccagtagccgtttactgagctgatagaagtcacctctgcacggcaagcaaccagggaaaggtcagaagggcaggcccccagagcctccaggatcccaccctggcccactcagcaagcagaccctaaagacagcagcctgcatctaacaggcttagctggaaatgggagcgagctacattagtgatagagtcacagtctggggtgttatgaccccaccagccctcataatcaaacagccctgcagcccctctgtgctggatagaagtgatgtcctccaggccccctggctctgcccttgcttatgggggccggccagccatgcccagctgagcctctggggcacaccacctcaatctcctttgacaccagtgtctgcaggctgcactgccgcagagccattggtctggcctcattcaaaaggccaggtgttttcatctctggtcttgaatttttcatgctgccccagtttctggagagaggaaaggagagctgcgactcctttcccagagtgaaaggaaaaggcagcgtggtttggtggtaatgatctcggactttggagccagcaggcctggagtcaaatcccagctgtgccgcctcaaagccgtgtgaccttgggcaagtccattccctcagagcatttgtgtcctcaccttaaaaatggactctggccaggtgcggtggttcacgcctgtaatcccagcaatttgggaggctgaggcgggtggatcacttgaggtcaggagttcgagaccagcctgatcaacatgggaaaccttgtctctactgaaaatacaaaaaattagccgggcgtggtggcatgcctataatcccagctattggggaggctgaggcaggagaatcacttgaacccaggaggcggaggttgcagttagctgagattatgccactgcactccagcctgggagacagaatgagaccctgtctcaaaaagaaaaaagaaaagactcacagcaataactccgggagcgtaaatgtgaggatgaaatgacatggcgcaggtcaactcttggcatgagacctggcacacagtaagtgctcactaaaagttgggggtgtgaaggggctggtggtgacgatgacagcagtaataccaggacatcaggcggggcgagagattgggccatggagaggggctcacacagcaggtatatcagccagggtcctgccaggaaaaagaaggcattcaaattcaggagcttgaggggagtttaataaagggactatttacaatactgagggtggggtttaggaaaaacaagagggagactacagcgccttgggggctggaacctgtgagaagccttccctgactcctaggtttgaagagacaagagggaacaatgaccataacctggaaaggcacttgtatggagagagttggctgccaggcagagtccaggaaagtgtgcctctctcccagagcccccacacttggccttctcttttcctgactcttgccccttcccccatatctccctatcactctttctccattgcttttgggcagctgagttggatgaggtgggaaatgtaggcagtgtgattttatagcaaatggcagctcatagctgtgtgatcttgggcaaaatgttaaccctctctgagctttggttcccgtccttatccagtgggagaatcaggactgctctgagggccgaatgagaccatgaaggtaaagctcttaacgcggacagtgaagtcccccagacgtgcttgcttttttccctgctaaccaactttggacttggtgagttctcccccactggaatgggccagagaagtgagaaatggccatggggtgaagtctgcatgtctccaccagcgcttgagccttcacacccacccagaccagatatcatcccaggcccacttgccctcttctctatcccctctctgttcccggcttccaggcccacgcccatggccgcacctttctcaggtagcccttcaacagaaatgtcccctttcctacctaaatccaatgtgttctcagggtcctgctcaaggcccttcatcccggaggccttcctcgacccctttatctcctgctctgaacgtgtgtgcagtcctcctggtccacagcaacacctcctgtgtgtgtgctgcttctggagctgcaagttcactcctggtatgtaagaaacatgaggcaggggcgtgggaccagggcaagtccctgcccctcctttgattattttgactgttgtctactgaagcatttcctttagagggtctctatgctcccactgccacgcaccctcggccccagtggtgtagacagcaggtcttcacttgttggctgaaggatggaaaactctgagagggctccccgctctgaatccaccggctgctggccaggaccttcgagggctgctctgacctcatataagttatgaggctcagcctcaggagtttctgcagagagattggagagctggctttgccctgtgcttccacaagggctctaactgggccccttgaggccagttcacaccccaccccttaaggtgctgagctgggtttaaactgaagtcactgccacccagagctgcactagagagaacttgccaagcccaaggttggttagcagggaaaagcgagcatgcctggagctcataaccatccgtgttaagagctttacctgcgtggtctcattcagcccacagagcagccctgattgcctcactgaataaggatgggaaccaaagctcagaaagggttaacattttgcccaagatcacacagctttgagctgccatttgctacaaaatcacactgcctacatttcccacctcatccaactcagctgcccaaatgtgggggtgggacaggactcacagggaaggaaaggccaagtcaggaggcgggggcgtctctggaagacagacacactcccctgagtctcattgcatgggtagtttgtcctcacaggctgcttcctcagactccaggccccagacatggcatgaggaagcagggctgactatgagccacatctgtctacccagattcttcttgctgtccagccagcaagatccctccttccccaagagccagccccagatccagcctcaggggcttgcccctcccagaactatgggctctctagtggccacatttaacccctggcccctcctagtgatatagctccaagtgctgtctcctgtgggtagggggtgggcacagttatctattagctgtgagattaatcattccctgctctccctcaccctggaatctccctgaatcatcacagcttggggctggcccctggacatttgaggagcaagcccacttctctgggctggggatatagagctcaccttgctggaggaaggggaggagaaggtagagcagctgggctcatgctgctaaggccttctcacaggcaaggaggaagcagctctcgggggaggttaggacaggcacaggagctggtgtctcaggggtccttggtctggggaggtgaacaaccagcaagtcaggaggtagaagggccctactggtggctgctgagtgcacagggcccacttgcaccctggagccagacggcctggaaccagtgcccaatcgcattatcttcccaggcaggaagatggcaggggcgtggctgcagaggcagaaagctcagatgccaaggagggtagctgggtgagagccccgagccccggggactgaggcagagctgcagggcagggcaaggaccacagtgaggcaggcaaggtggccagggcacaaaatgtgaggctctgtgtcgggagcggagcgctcgcacagccctgagaatgagtgcttcattaaagtttgcttcctaggcacctggcttgcatcttcagtcctgctgctagagaaggagcaatggctccccaccccctgaacctgctgccctagcctcctagactaagcaggcctgagaggttgggggagatgcgctctagagagactgggggagcagccactgagacctttccacacatacacactgtgctgggacatgttggcccacaagggagataaagcacagtgctcacagccaggccattcctggtcaggcccccagccccagagccccaggagtaccactcttggcaggcctagacggggagaaaattaggagtggggttcctgactaccatcccccaccagtgtctgggtgaccttggctggtcctttcagttctaatcaaaagcaaagcctcagtttttctgtctctaaactggggagaaccacatccttgctgctgctctctctggagtgggggtagagagggaggctgggaggcctctgcaaagccggagtctcctgcctcctggctgccaggctggtcctgctcttcggccagattaaaagaatctccaacttggggcccaaaataggtagaaatgaggcaggccacaggggccccccaaacacttctgaacactgcccagtaccccaaatccctcctcttctagcccaggatttctgatcattcttcgaagcccagttcagacctcacctctctatagagcaaccccccaccccaggccaaggactagtctctcttcattctgccatctcacctcaccaaaagcacttaggaccctgcctggcgtgcagcaaatgctctttgtctttgtaataatttcttgcagtgctcagaactgaaccataatctttggttcgtactctagtgccatcactgacccatcatggctttctttaattgtttaattataatttattttcaataatgtaatgaatttccattaactgaccacccaatctaaaaacccaaaagtttagaatgtatgctcttaccctcttctctccccgatcttcccacccaccctccaagaagaaaccatcctcttgaagtttgtgtttattattatcaaataaatggaagactataggtacccaaagaggcacgatggctggtagattcttcaacagaagtagctgttttaccgatcaagctgcaacactcttgagagcagtgtctgcttcctcttttgctgcagcttgagcagcatggggctggccacaccacagggttggtggagactacttgaggcaccaagagcaggaagggtggggcctgagtgccaggcggcaggtggaacacagctccaggaatagggaaaagggcttcgcgttctagctcactgcacctggacaggtgcctgtgtgacttcggccctgccctgtgacatcacacagtgttgcccaggtgacccagctaggtggaagagcttattgttttccaggcctgggcagagacagggcccccctgccccatctctccaccgtcctaggtgtgccaagagtcaattgcctcattgctgaccctgtccagctggccatggccctcaacccccaaggcccttccacccacagaccatctcgctgctgagagatccaggacctgctcccacctggccaccctccccctccccccacatccaggccccagggctggtgtgtggcacccctgagaccacattgacctccatactgtctactacccataaggactccaagacgcccaggccagctgtctgggcaggactgattcctgatcacccactgataccaagtactcatccccaagattgttaaacaaggccagacactcctggcctcaagaggatgggactgaaaaacaaaaaggtaaggccaggggcatgggccatgcacctgcatgaatccgtccctccttcaaagtccttccttcaaagttttgtttgctccttaatcatgacaaaagcttcccttccctgggtctcagttttcacagctgtgaaatggggagtgaggtggtctctgtggctctcccaggttagctgccctatactcttgggccacacgggaactggaatgcagtgtacttgcaggtgttgtcaatgctgaccacccttacctggttgtttctgcactcttattgctggggtcacacagtctgagagcccactgagatggttcattacccctgtccaagatctcccaggagattcccaggctgctggcttggcagccctgatgcccccattgcccccatgctctccaatccctggccctgattttctggggcctaggcccctgtcctggaacacagatgcttgggtctctgaagagaagggatttttgtgtgttttgttgatcaccgtatccccagcactcagaacagtgcctggcacatagtgggtgcttaataaaaagctgtggcccagcagcagggctctgtcaggaagggactagaatctcagtgtgatgagatgtaaacagttgaatgtaagggaccccttaccttcctctcactagcaaggctgagcccctgccctagatggtgttaacccacagggatagcagaaggagctgagaccaaaggcacacagatacttgcaaatgggggataccctctttgtagttacactcaggttgaataagccaaatagctgggggtgcccaggccctagtgtgatttccacttcattactcttgattttgatgtctctggttcctgatgttctctgcccacagctgccccccaccccctgcagactctgccctccccattaagcctctttctgtaatgccacacactcagaaccggtcaccaggttgacctggcaccctaagctgccagctggtccccacctgccccacagagctggatttggggatctggggagtgtgcgtgggagtcctgaggaggagccaaggttgctttgattagtagctttgagaagcgcttttgatagctgggtagaatcgcctataaggatgctcatcatggccgggggtggtggctcacgcctgtaatcccagcacttggcgaggccgaggcaggagtttgagaccagcctggccaacatggtgaaaccccatctctactaaaaatacaaaaattagctgggtgtgttggtgcacgtctgtaatcccagttactcaggatgctgaggcaggagaatcgcttgaacctgggaggcagatgttgcagtgagccgagatcacgccactgccctccagcctgggcaacagtgtgagattctgcctcaaaaataaaaggacgttggccaggcctggtgtctcactcctgtaatcccagcactttgggaggccaaggcagaagttcgagaccagtctggccaacatggtgaaaccccgtctgtactaaaaatacaaaaattaaccaggcgtggtagcgggcacctgtaatcccagctactcgggaggctgagacaggagaattgcttgaacccaggaggcggaggttgcagtgagccgagatagcaccacagcactccagcctgagcaacaaagagcaaaactccatctcaaaaaaaaaaaaaaaaaggatgctcatcatgtatatataatacatatttgtgtttcttcttttgtgaatccccagttcatgttttttaaattggataatgtttataggtttcagtgctctttgtatactagggatattaatccttttttaaatatgcagcaaacattttctcctttttttcttttctttgtattgcagggcattttggaccattatagaagttagtatagatttttaaaatgtaatcaaacctatccctttttaatgatttctgacttttgtgtcatcttttggaatgcttctctgctccaaagaacataattcctcttgctgccaccaatggatactcagattatgagttcaggggggcatccactgtggagcagagaagggatccacatccaaggaagcatggttagagcacagcagagacagcaagagtgtggggtcagacagacccagcttccagttccagccctggcctcactagctaagctgtgtgctttcatacaagaggtttactttctctgagtgtgcttcctcacctgtgaaagagctttcccctggccgccataactctcaggcaagtttagatgttgaaactagaaggaacatgggggaccatttttaactgaaagtccttgtgaaactgctgggaaatagccccactgcagtcaagtaacttgcccaaatgacagatccgggcagccaggcaccctgcctcccagcccagccccgctccagctagtgtgacttttcagacacacggcccttctagagggcagaactgggctcagctcctcaggcctcccaggctgctggaggatagggaggagtgggtggaagagtttgtctccttccatctctctccccaccagaaccaagttaagcaccccccaacccacccgcgggagctgaattcaaggaccattaactccctgttgttcctacctcctcctctcaccctagcccttccccccagcacatggatccaaaaatgccctaagtgatgggcagtcctagttcccctgcaacatctgctggctaatcctggcctattgagggcaaggctgcctgtctgtttggataagggcactggagttagcagcttccaatcttgccaggcccagtggagtagctgagagtgctgagctttggaatcaggcttgcttcggtgctcacagcccagcctctcatccactggctgtgtggccttgggcaggtaaactggccaaacccctgcctggaaaagctgcctgctgatctctgcaccctagcagtgttgggtgggttaagtgagagggagcctgagaagctgatggtgagcatccagctttgctcccagccaagaggaggcatgaattccctccccagggctcaccacacccctacagatgagtttgtgcaaactgagagttacggggggggtaccccatcacccccagttccctaccactcatgtaacccagtatatgcattttctgttccctcatcaatcctctagtgcaggccaggggtaacagatgggtcgaggacattggttctgatgcaggacatctctgagggaagcctgcagattcccatccagacatgggaataaaaaagggatagcaggaggttagcagccctggcccaccatcccccttctggccttacccttggccccaagcctccctggccctgggcccagcctgcccagcgggcacatgcctgcaagcctcaccaggaggcgccagcctggcagttggcctcatgcccagaactgaaacacaatagttctcgccaaacttcctgcaagctttattcccagaagggaaggctgtccccgaggggaggtgcaggggagatagaggaggagccggtgtgactcctggccaggtctgcagatgcctagttgggctctggggctgccagggagccaatgagagcccctggacaatggtcttactcctgggccctccctttcatggccctagggagctcatgagaggccctgtgccctcacagcaaggtgaatccatctaggaacatgaatcacccctcccagcctcactgcaggaacttcaggcacagtaaccactggaaaggctgaatcacaaactattccagacattcccattggccaggtgggaaaatcaaggctcagggaggtggtacagagaggtagggccagagctgagctgaaacctaggtcttttttttgttgttgttgttggagtctcactctatcacccaggctggagtaccatcttggctcactgcaacctccgcctcctaggttcaagcaattcttctgcctcagcctcccgaatagctgggattacagcctcatgccaccgcacctggctgatttttgtatttttagtagagatggggtttcaccatgttggcccggctggtctcgatctcccagcctccagtgatttgcccgcctcggcctcccaaagtgctgggattacaggcgtgagccaccacacccggccaagttgaaacctaggtctttttgccctgaggctgccagccttactcctgtgccactaaaccaggagagcaaggctgctggggagtgggggggtcatggtggcctgcatgagggtggatatgggaggaagctgcctacccaggagggcagggaacagcactctggctgctcctcctccttcacctccaggcaggggcatcttcccctcccctcattctcccctgacaggagcatgggggagagaaggaggggcaaccctcatcaacacctctgtagatggtgacaggccctgctgggtcctggaagagggtgggggtggcctcctcagtcagaggaaggagaggggggcctctctgcaggactggcacttctgatctggggggcatgtattctcacctcctaattagccatcttgctaggcaaggaccacagcctgcaccaggcaagccaagggaagtaggggagcaaggcacagggatgacagttctggagtgacacccagggtggagcagaggaaacagctagggcagaggcggggaggcaggagggagcttggtaggtgtgagaaacagccaggaggccagtgtggctggagcggagtgacccacagggcccgtgggacaagatgaggtcagttttctgggccagctcctggagggccccacgggccattgcaaggctctgagagaagcagcaagctacttcagggttctgagcagaggagagagagggtctgggtccaatctgtaaaggctcactctggcgattggatggggtggacggagagtcggagaggaaacagaactccatcagaggcgagtcgggacatacaggtgtctgggacctgagtgctgacctgaggatgctgagaagggtcagagtccagatatagtttgaaggtggagctgacaggatctgctgaagaactggataagggatgtagaggaagagagggaagaatcaggaaggactccaagatgtggggcttgaacaactagaacaatggcatcgccattaactcattaacgagttggggcagacagcaggaggaggggtttgaaggggagtccagagttcgttagctttgagaggccagtagacccccaaggggagctgttgagggggtgtgtggctccgattggtgggcaccccacgctaccgtgagaaatggatgaaataacgttcctaaaactcctcggggcagagcagagcctcaggcactgtgcccttttctttctgtctgcctgaggcttccaggagccaaggctcaaggtaggagcagagcagcttccagataggtcggtccaagtcctcatctccccactggggaaactgactctcagaacatggctggctttggggcccagcatggtgagaggcagagctggtttaaacctacctctcctgacactcagggctcctcaggagccggccattctgagccaaggacccagcctgccgaggctgccaccaaaaccagagcccgtccagggcccaggtccttgctcctgtctgggcctcaatttcctctctatgtaataggacattgttctcaaccccacccaaccagggcctgccctggaatgcagggtctgacaggctgagctttccagagatgaggaacagcctgccagtggcccctcagggccctgcctccaccctgaggaggtccattgctcctctcccagagccaggagtgcccctctatggcccctcatatcagctggagggacaaagggtaggcaagacctcctaccacgggaggcctatcaagggttaatctgtgtcagattaactggaagtggtgagtcagccagccggccagtggaggaccagggccagggaggacaaggacacccctgagccacagcagcctcatggccacacccctccccaccccaccgcgtttatatgcccagctctgccgtcttctctgagtccccactgcctccccagtcaaactgagccacctctgggccttggaaagctctgccccttcccgcttgctgccttcgctccagtgttctgctcctggcctgtcctccctgactccactcctgcaccttctcccaaccctttaaggcctcctcctccctgctgtcttccctgaccgcctcagccggccagggctttgtcttctctcagcagctctcgttaagatggtcctttgggccatgaatccacaagttactaagctgctgagtccctgcttggggcaactggtgtaggaagccccctgcatgggcaggcacctcttcctccctagtccgcaagtttcctgggtagaagacaggtggggcatctgggacagacacatgcattcacctccacgtaatgcactgaatgcccccatgaacgtggagaagctttgtcagctgtaaagtgctgtgcacaggagggacctgaggtgatgggtgagctgaggtgaggttacaagatagactgaagaaggtggcccattgttaggactgcaaaagcaggtgggatttaggaattacagacgaggacacctgcgaaagctaaggcttagaagtgggaccagacttgaaaggtgaggtggcctgtctcatcctgcaggaagggtaggatccaggactagaggagaggcactgagagagacgtgggatggggacagaagtagggagaaaatggggccaaggcgactgccttgcagagtgggcggaagggtgacagagggaggcaggcacttgacggaagctgtgagtggctagtgctagagggtggcagtgaagggaggtgccgcagcagaggaggccactcagggccaggtgcagtaactcatgcctataatcccagcactctgggaggccgaggcaggcagatcacctgaggtcaggagtttgagaccatggggaaatcccgtctctactaaaaatacaaaaattagttggatgtggtggcacatgcctgtaatcccagctactgtggaggctgaggcaggagaattgcttgaacctgggaggtagaggctgcagtgagccaagatggcaccactgcactccagcctgggcaacagagcaagactctgtctcaaaaaaaaaaaaaaacactcagccctggctctccccacagaacactgaagacccagaggagcccctgatcgcctcccagagcacggaacctgagatcggtcacctgtctccctctaagaaggagaccatcatggtcaccctccatggggctaccaacctgcctgcctgcaaggatggctccgagccgtggccctatgtggtggtgtaagtagctgcgtgagagtgggggcaggggatgggttgggctgtgagcagaaaccaggggacagctatttggaatactagcacccaaaggcccaggactgggactgtcatacccagaggggaggagctgctgtgggcactacctggcatctccgctgctgcatgggaagctgctcaccagggctggggaagacagggtgccaacggatccagagagtcacccctccccaccccacaccagtggggcagggattggtcacagctcagctccagtggggcaggttccttgtatgcaaaagtctgggctgggctcatgggcatgatggtcagattggggaaggggaagatttgggacctgcctctcctgacttctgggtgccccaccccaccatacccagccctggggtagggtcctcataaccaccctcccctcctcccctccttctccagtcacttctattatggggactcccctagttctgggcctttaatgcaccccacacaccccctccagccagctgctgtcagggtacacacttccccagcctggcaccaaggcctgccacgccacgtctatgcccacctcacgggtctcacttcttccagaaaggcgccaaggggcaacacaatctccatccagccaaccttcgctggggacactgaatatttgctcaatctttattataaagcaccctccaaggagcatgtcacccctagaccttctatagacagacggcgggagccttggtggcctcccaccaagccaccctatacttcccctcccccaccaatactggcaccattcagttcctgccaagagtctgttgcccacatttccttttggggagtgcctgccccagcccactcaccaatgcctgctgaaatcctgccttcaaagcctcctcctccaggcagccaccagagttgagctctccctcttctggagctccacagcagtggtgaccctggtctgaagcactttatatcaacatggtttatgcactcctctggggctccctgaggacggatctcctcctccatttccctcaacaatgcatccaacataggcctgagcccaaacttaggagccaaggagtgactgaggccaacacctggttactatgataagtccctgcccccccagggcccccactgtgaaaggggggtagaagctgtgccgagagcaacaggtgaaacacttgccttaaaagccccatttgtgccagcccagctcctcggccatccctcccccaactccatttccgtggtgagggaagcacaggtggtgggagcaggcttggcagggaggctggtttctagcggggagctcgccttctccgctcagctatttccataaaccaattatcgccgatcatctcgggagattgaggccctgactgtcaccaatccggcctgggcggcggggcggggagctgggtggctgtgtggctcctaggcaggcaccgcgacccgcgccatcacccggttgccatgggaacgcgcggcaggagcctaggcgacacgagcctgggtgggggttcggagagccgggcacaccccgagtcctcctgcaccctccctgtggctgcggcacgtggggcgggagggtggggacagagaacgcggggaggggggaggggaaagcacttcgctgcacccttctccagctgggagcagcgcccgggccaggctgcagcctgcgtcccagggctccagacaggcgaagctgccaccagctcgaggtggtgctaatgagatgcaaatgatgggagaaggaagggcttctgagaatgtgaaggccgagctgtcaggacctgaagggggctttcagtgctcacccccagccccaggcagaaaccccagagggaggatccagaccctcagaggccatagaacctggaaagaatttatatccctgcacatctgattacaaataaacaagtaacaaagcacacaataggcataagaaagttcatgaaagttttcgttttgttcatgatgaatatttcaatgctttttaaaaatatgtatttgtgaagacttcaatgtaagacctgcaactgtaacacccctagaagaaaacacaggggaaaggctcctttacattggtcttggcaattaatcttcggatatgacaccggaagtacaggcaacagaatcaaaaataagtgagactgcatcaaactgaaaagcttctgcgcagcaaagggaataatccacaaaacaaaaaggcagcctatggtatgggagaaaatatttgcaaaacatgtatcggataaggagttaatatccaaaatatatgagtaactcatacaactcaatagcaaaaagacaagtaacccaatttaaaaaatgagaaaaagacccgaatagacatttttccaacaaagaaatacaaatggccaacaggcacatgaaaaggtgcacatcgctaatcatcagggaagtgcaaatcaaagccacaaggagatagcacctcacacctgttaggatggctgttctcaaaaacacaagagataagtgttggtgcgggtgtggagaaaagagaacgcttgtacactgttggtgggaatacgcagtaaaatggtgcagccattatggagcacagcacggaggttcctcaagaaattgaaaataaaactaccatatgatcccgcaatctcactactgggtatatatccaaaggaaacaaaatcagtattttgaaaagatatcgggccgggcgcagtggctcacgcctgtaatcccagcactttgcggggccgaggtgggcggatcacagggtcaggagttcaagaccaccctggccaatatggtgaaaccccatctctactaaaaatacaaaaattagccgagcgtggtagcaggcacctgtaatcctagctactaggaaggctgaggcaggagaatttcttgaacctgggaggcagaggttgcagtgagccaagattgcgccactgcactccagcctgggcaacagagcgagactcccatctcaaaaaaaaaaagtaaaagaaaaagaaaagaaaagatatctgggcctggtgcagtggctcatgcctgtaatcccagaactttggaggctgaggcaggtggatcatctgaggtcaagagtacccctatattcattgcagaattattcacaatagccaagatataggatcaacctaagtgtttgttgatgaatgaatggataaagaaaaaatgtcatatatatatatatacacacacacacacacacacacacacgtcatatacatatatttgtatatacttgtgtcatatatacacacacaattatatattgtatacatatatatccacatatagacaacatatacacaatgtaatattattcagccataaaagggaggacattctgccatttgcgataatgcagatgagcctggaggacgttatgctagatgaaataagctagacacagaaagacaaatactgcataatcccacttaatggaatctaagataaactcatagatgcagagagtagaatggtggctgtcaggggctggggatgagggaaatgaggaaatgttggccaaaggatacaaactctcagttttgggatgagtaattctggggatttaatatgcagcaggtgactctagttaatgatactatattgtggctgggcacggtggctcatgcctgtaatcccagcattttgggaggccaagacaggtggatcacctgaggtcaggagtttgagaccagcctggccaacatagtgaaaccccatctctattaaaaatacaaaaactagcttggcgtggtggtgggcacatgtaatcccagctacttgggaggctgaggcaggagaatcacttgaatctgggaggtggaggttgcgctgagccgagactgtgccagtgcactccagcctgggcgacagagtgagactccgtctaaaaaaaaaaagatattatattatgtatttgaaatgtgctaagagtagattttaagtgttttcaccacatacacgaaaggtaactgtgaggtgatagatgtgttaactaacttgatcatgatgatcactgcggaaagtatatgtgtatcaaatcatcactgtgtacattttaaatacatctaaattttattttttatttgtcaattatgcctcaataaaacagcgaaaatatgtatatatattatatatattatatataagtttacattctttccaagcattttttctcatctttttgctgcccctgttttttggtaccctgagcttagtctcctggcttggtttcctgccctctgccatcccatcttctctcacctgaggttggggatggatatcctgggaatccctgtctcagcctggattctgtccttctctctgggtttgttgcatccctagcaggcaggaccacagttgcagggatcggggcaggggaagtagtgaagcacagacctgagagtgccccagaactgttcgttcattcatccccttagtggggagctgaagagggttcaggcccaaagatggtgcttctcttgtttggggcatggccatttcaccccttaaggaggcaccaggcttgagcccatatagtaataggcacatcctccagccaaaactattccagaccagcaggcacttggctcatcttgggggtcagcctgtcttcatctaagccactggttggcttccaatctgaccccacttctccaccaatatagcttctctgtagtcaccagtgaccaccatctctgaccctgcatccaacgggcatctcatcttttgcgatctctcaggtaaaggaaataatgtatacagtggtccattgccaagacaaagtgccttaaatcagcttagatcagcaaactacagaagaaaccggatatatactaggcccctgcttggatagccaacgcctgcttgtcggcagccccccaccctccctgcttagtcgccctcaccagaacaagaagtttagtctaaaatgaaagtttattagtctgcaaaatagctcattttgtctgtttttatcagcccgcccagctgcttaggtcataagccaaatacttgaggccgggtgcagcggctcacacctgtaatcccagcactttgggaggccgaggcggatggatcatgaggtcaggagatcgagatcatcctagctaacacagtgaaaccccgtctctactaaaaatacaaaaaaaattagccgggtgtggtggcgggtgcctgtagtcccagctactcgggaggctgaggcaggagaatggcgtaaatccaggaggtggagcttgcagtgagctgagatcaagcaactgcactccagcctgggtgacagagcgaggctccgtctaaaaaaaataataaaaaaataaaaacaacttgaatagcccctgagctaactaggattgcagtgcattgtgggctgcaaaaaatgcaataagacaacccaaaaacaaacaaacaaacaaacttaaagctaacaatcaataggtgacatctgggaaaactgtgaccccgcagtattcaccctatgaggaaccgggggagagacccgtgcactaggggtaaattgcttattgaaactgtgctgggtgtgcctgcctatcagacacccaatcttgcaagacccgtgttaaaagtctcaatttcgctgttccctgggtctctgagtccattctttgggtttggacgggtgaatttgtttattacacagaggcagcagcccctccagacaactcagtctctttgaagccctttctccccctccaagttaccccactctcccaccttcccctatggccacatctcttgatctcgtctacctgaccttaaatgttagcctgtctcaggtttctgccctatgtggctcttctttctctagcctgtactctttttccatgtgatcccaccccatcctggtgtcaggaatcacattcttccctcatccaatccatcaccaagtcatgtccatgtctcccggtctctcggattgagctgcttctctccaccagctccaccaccgacttaggccaccgcactatttctccaactgctcttggttcctctactcttgctccctgaagatcccttcaaaggcaggttaccattgggtactgtggtgccatagtaccaaaggaactcagtggcttcccattgttcccaaagtaaagaggattccaggctcagcacggttgggtctttgccggcccctccagctccccagcaacaggacctccacctccctctctttgctccagccacactggacatctctccgttctctgagcaaaccctgttccctcccaccctaggcattctcagaaacattctgagaaacattcccagaaacattctcccttccccttttcccatctcagctgtcctcactgatctcccagatgaggccaaatcctccctcattacatgttttcatgcgactctgtaccaggatatgtgcttatgcactttatgtgattatgtgcgtactctttgccagtgcctccccatcccgcctccactgtgccccactagttccgtggacaaccaccaggtctgctttgctcaccattttattcctatcatgaaacacagtatctggaacataggaagctgtcactaaataatcgtcgaatgaatctggccctgtttctagcttgctgtatgactgtgggaaagttactttgtctttcaatgcctgaaaacctcacctgggaacctgtctcaaagggctatagagatggtggtgctagacagtgtgagatgctgcgggtctaaagctctacagggggaagggggagtcctgagcaggctcacagtgggcactgagacctatcataagaaagccacaggacagtggaaagaagccaggctgggtacaggaagacctagcatctggcccactgcccctgactccctgtatgaactcaggccagtccttgccttctctgagcctcagtcttcccatggccaggatgtaagctttggcctgcatgctgctgcaggcctgcctggctggcttgtgttctggcctgggaaacactctcagttctttagagaaaacaagaaccccagctctgccacccgagacagattctgtgcccaggtctactgggccagtctccaggcccagggtgtcccatgactggtctaggcctggctcagtgccctggggcttgaacagtacccagcacctgtcacccagcctgacacagagagacctgccagtcagagcacagcagggaccaggaagacagtggcactgacaggcacggggtgccccagtggacaggatgagatatggaaaaggggctagccaggagatggcctgtggggttctgacccttggccaaaggctgcatgtcagggctgccagcattggcagctgcttcttcggctgcctgctgcccagagctaatgagtggggacagagccaggactcgaaggggaaggcgctgcttcctctgtgcatgtggggcaggcttgggatggcacaggggaggtggcacagatcagggccagctagagtcatactcagaggatccttggttttcttagataagcctgagagccctgaccctggccctacactgagcttgaccttgattgtagactgagctcagccctgaccctggtcacagactgaggctggccttggtcacaggatgagctctgactctggtgactaattgaagaagatgttaaaagtaggacaattgtttgaaatcctggcaagaggggggataaagaaggttacagttatcaaatactcaccatacccctgagaaataagctaggagtgtattgtgtgtttcatacagtttaatcgccacccagtcctataattgaggtataatattatcattaaacctcattttacagatgaggttcctgaggctcaaagcatttccatgacttgcccaaggtcacagaactagttagtacccaaaggaggatgcaggatccaggatttcaaaatctaaaagctccctccacctcattctttgccttgatatttcatgccgtggttaccccttttggaaggggggttgttgagacaggatgctaacccagacttccagagaagatgcagtgactagtgtggagacccatcctgggatctggagttctccttcctccctgtctggctgggggccttcagtcaaggacccctgaaggcagggatctgggcagagtgggtggaggctcacaatgactcacaggtgacccatgggcttgtctcagcagccagagggttgggctcagcaaaaataacaataacacagtgacagtgatcatgggatagtcccaggaataaggcagccctcacttgctgatgatgttccactcgaagctcactgcgagctcggctatttacaccctctggttctaacggtgcagtcctggaagcaggctgcgttattcccatgtgatagtggaggaggccaaggcccaggggagaatgtggatgtgtctgaggtcacatggctggccagtgggagtggagcagatgaagatgactattcccatctggccgctggctcctacagaagccaaggctccttctcttccagcaggatccccatgggaaaaaagacaagggtggggagcaggcctggggtgaggcctgggaaccagggtcttcatctaccctgcagggcccccacaccatggtttgattttccacccacacctgccccccatgacatcagttcctggagactcagaacctcagaatttttgttcagtgagaacttccctttgtcccagggttataaacacagctggtgtcagtggttgaaggatggttggcctgagaaccatccccagccagaccgaagccataaggattctttccagatgttctcccatctctgccacctggggcccctaaggtgttctcatgcctgaaacccccattcagactcaagaagcatgagttctcccccacaggcttcttctggaatcctgcataacagcctcagagggcattcatgggggagatttggggccatgaggcaggccagagggggccttcctggtgtcctcattgcatcctgcatgggctgtctcctctgcttactcctgagcatgggcagagcggctgacagcctcctcctccctccctggtcatcatgagcagccaggaggcttggtgatccctccagactttatgtagcttccctctccctagcctggcccccgtgggtcccagggtcacatgccacagggtctagcttgtagtggagtgagggaggccattgagcaggggctggggctctgggcaccgattaggctcctcctacccctgtgtattccctgattctgtcatccttccatgcacacacttaagtttccagcagaaggagctgccctggaatcccgttgatctcctcgttccccccctccttctctgaggctccccctatccatccagaaacctgtgagatactgaacaccattatcagggagaagctgagctcagagatgcttaggggatgtgccacacagtcagcagcagtggagccgggagccagaattcaaagtcaatgtcttcagggccaatctacttatgcaaatcctgtagttcctggcatgtgatgcaatagagagaggaagcaactgtggcaaaccagagagcacctggctcattcagaggagtagcccctgcccgtcctactgatctctacatggaagaatgagggcatgggttgtcaaccctcttcatttttgtttatgtttaattattaggtttttttaatgtgtagagatggggtttcactgtgttgcccaggctggttcaaactcccggcctcaagtgatcctcccaccttggcctcacaaagtgctgacattacaggtgtgagccaccctggccagcctctctcaattttatttattttatttttttattttttgagatggagtctcactctgttgcctgggctggagtgcagtggtgtgatctcagctcactgcaacctctgcctcccaggttcaagagactctcctgcctcaacctcttgagtagctgggattacaggcgcgcgccaccactcccagctaatttttgtatttttagtagagatggggtttcaccatgtttgtcaggctggtctcgaactcctgacttcatgatctgcccgcctcagcctcccaaagtgctgggattacaggcgtgagccactgcgcccggacgcctctctcaatttttaaagagaaaccagaaatccaaatgtttgtgtaaaatcagccaagttttactttcaggccaaacacctctggtcagtgaggatctctgggcccctcattgttcctctcctgaaccctcaacccaactcggacaccaccggtgcctccagctttgctgactggtccccctctgccaggggagtgacctcccaatggctgtgcatcctccacacatgtataagtaggcattctcctttcttgaagccccttctttcctcgcctccaggacaactccctctcctgattttctaccctgtctctggccactccactgtgggatactctttgtcccagtaccctgcgaatgtcaatgctcctggctcagtccttggcctctcctctgcatctctaccctccttcttttttttttttttttttttgagacggagtttcactcttgtcacccaggctggtgtgcaatgatgtgatctcggctcactgcaacctccacctctggggttcaagcaattctcctgcctcagcctcctgagtagctgggattacaggcgtgtgccaacacacccggctaattattgtatttttagtagagacggtgttttgccatgttggccaagctggtctcgaactcctgattgcaggtgatccacctgcctcggcctcccaaaatgctggaattacaggtgtgagccaccacgcctggcctctatactttttaagagatcccccctcacctaggcatccccctttccccccatcctgaaagccccagaatccctggatccagccctctcctgagctccagttccatagacccacctgccaatatacgtctccactcagactcagccttcctcattgatctcctcatcctccctccttctcgaaacctgtgagatactgagcgctgttatcagggaggagctgagctcagagatgcttaggggatgtgccacacagtcagcagcggtgagccaggagccaggactcaagcccacgactggtgagcctgaacacaaagctgtctctctggtcttcagcaagcctggcctgggaatgctcaggaggccctggggttttatccctgggagggcaggctgtggcctaccccttccctgttcccatacaaaggtggggacagaggagcaactggccctgagtgaggagaggagctagtgggcatggccccctccctctcctgtcgacttcccagcggtgtgctcctgcggtgccctgtggcgttggaggagtggggcctagggactagccggggactgtggcagggactctcaggatggtcagtgtggctaacaaaaccagacctcgatccctccacagcaccctggaatgggacagagagaccaggggccaggctggaccgaggcgctcagtgccccctgggcctggagggagcccagttcccccactttccccccacagctgggttctgcttccccactttggggacacgctcttgggacaggacttgggatctgaaccctcctcccagccaagagctatttccaggacagttctgaggagctgccactggctcagcagcctgggccagtgagttggcctggcagagcttgaaaggaggggctgccactgtcccacctgattttccagtggtctgtcccttcttctttctttcagcaaacacctgctgggccccactttgcccaggcagtgggaactgagctccagcagcgacaagacaggtccctgcccttgaggggtgaacagtctagtagtggtggtgagggtggggaggcgccaggaatcataatgctgtccccactcactcatcctttgcccacagtctcccaggaaggcggccatccaggctccagtcgccagcactagggtatcggagcccctcaggaggctgggctctgtgtctgagccagggagtggccccagacctcaaaacgtggactgaacaccacacgagttaagcagggaatgagaatcagaatgacaggaatcagaagagtccggtgatttctgtgaggtcaggaagttcgactttatgtctggcccacgttcctcctgccctaaggctgcgtacgggagaaagggggtactcgaaagagtggctgttcagagtgaccgaaccattgagaggattccacgtcctggcaagtcctgctgggttgctcatccaggcccacaccttccaaggggactgtcattgcctccccataggactgtgatggtgactgacaggtccacccattgcggcccaagaaggtggctcccagggcccctcaccagctatgccacaggacaggacacggcatgacactccaaaggctgacagatggtgcagacagcggcccttcctgaccctgcatcgcctccagcctcaaaaagagcaaaaaagtatctctggaaaacaaggaaatccccttcccagaagagggtagaaggtgcaacaatgcccagaacaccggcacttaagcctgactttgggccatcacaaagctctgtgggctgtggctttctccttgtccgccatgggtggaaaggaggggtacccacacttttggatgaagtgtgagtagtggtggggtggaggagcagcatccttgtttgacaggaagatctttgcctttgctagagtgcttctcagagtttctcggaaggtgccctttctttttcccagagcagcccccatgccctgcaggcaagggcaggggaagagctgggccctcagggactgggagctgctggcctccagttggtgccctccttactccagagtcagttattctgtaaactgaggcccacctgcagtgttgtagcaccatcaggaattagtgatgcttcattagagtccaattaataaatgaaacccaggatgagagtccctcgcgttgctgagaataacagccctgctcatgccttaagtggcagcctcctggggctcaaaacccacaaggaccagctgccctgccgtcagcatggggctgggggaggcggcagcacagactgggggccttgtcaaggctgttgtctggtgaagcgggggcgagaagagaagggagcttcagcactgactccctgcctcagatctcagctcctcctttgaggagtccctgggcacaaccccctgcccagcaatcccaggggagcttggctaaggccagaggtgtgagggctggggctcttccctcctgcctgcctggcttcagaagacactgattgtggccacggcaaaaaggggccttgagagggactcgggggagaaccacagcctccctctcctgactcccccaacccatgctccgaagtcagcacctgcatcagccaaacagcccccctcaagcctcaccttctctcctctaagtggaaagatcctccaatctatctgttcaagccctgccttctccaggtttagggtcagaaacacaggaacccagactttggccaccccattcagatgactgtctctgcagaagccaactccacacctcctgttgcataagactgggctcctggattgggaagaggtcactgggtttttcagagcttccaggagtggaggcaggcctagcctatggcctgggagtctggcagcctcttggacttctggaggatgggggaggcaggcctccctggctcagaagttggcatggaggaagcaggttgaggagaattgccctaccttctcaggaaagattgagacccaaccattacaccttgacagctggcctgcaggactgccagttccctcacctccctctcagtttcccaggtgagccagcaatgggttgtgatgggccaggtcaaaggtgcccaatacctcctattccaccatccatccacttaaaggtctgctccttatccactattcccagtgcctgcctgacttccccagtgccaggggcttctgggaacatcactctagtctctcaggatttacaagcctgcccagccaagaccccagcagccacagcagatctgagtcagggccctcccctttcctttgctctcttggtggctgtcctgggattggcactcaaaacaaaccaggccgcctgtgccccagcttctaaagctctgcccaggaggcggccaggtcttgactattgttcatgatttgaggctttgagggagccagaggccaacaggacaggcagggcaggtgggggaggtgggctcaggtgtgaatagaagaccccagaggcagcctgaggactgggtaacaagagtgggtacagtatggtactcacacctctctgggcagcctttgtgcacgtgcatgtgtgcatgtatgtgtgtgtgcatgcatttgtgcgcatgtgtgtgcatgtgtgtgtatgtatgtgtggatgtgtgtgtgtgtctcctggagtgagggggaaagcggctcatgagcactcttgctttctgtccatcaaatcccatgcttttccgatgctcatttcttccactcacagctgcagcccccgggaaccagatgacatattttcccttagtcatgaccttgcagaaggaaagcaaagtccttgttccctcccactcacagctgtgcttgagcctggcccccttacaccctgctggggtgggggccccaggaatgcctagctggggactggagtttgtcaaagacacacacacccttccagcagcctggagggtaggccaggttgagggaggtttatgttttcctgcagcttggtctcagggctgctgcactctaaacccaactccagtcctatcctggcatggctgcccatgctgtggctggattaaatctggccccgagacagcaggcaccacccactagctcctcctggccctggatgcctggagccaacgggtccaagtcaacagggcaggtctttggggggacagggaggggggtctctccttgcagacagcctgtggagaggcctagggaagcaggtcttggtgaggtcccctgggttctaagactgcattgggagccccgagagagcctggggacctggaactcagccacgtgcccatctgcggggtgcagaatggggctgggagcagggagtgagctcatcccctgctcctattctgtgaagaatcagaggcccttcttgctctccagattctagaatagcatcaagacccggaggagtcagctgtgccaggaaaagccattaccccgagagcctccctccacctgctaaaagcctcccccttcccctggggcctccccctcccacccagttgctttatctgcactcacctagccctgatgaccttcatattagatggggcagggaggtggggaaaatagttgcttaactctttctctgctggaggaaagtcagcacctgctcccttgccttgccccgtcacctttacccacctctttgcacctgggaattcctcctgccaccctcccaggagggttgggaggatacgaggacagtagaagacaggctggcatggggttcaatctgaatcctgtcactatgttgcctgtgacttcacaccttcatttgtgtcttctctgtgcacacagagccacatgaagatccctgggaatcccccaggaatgtgtccatgcaggtgcagttttgtgtccagctctggggttgacatctgggtgcagaaggactgacttcttcctgacacacccttggcgcttctgcttttctgctgtttctgtgcaggtccctgaggagggaggctgtgaggccttattgtgcactaactatatatctataagtagcagatcgggtggctgggtagcacagggaggctgctgagagcctgaggtctctgactttgctggggcagctgtcaggagcgggagcctaggcacagagcgtcatgggaggtacttagattgcaccccttggtcaagcatggtcacagagccggagggaaaaagggacccgagggtggagggagcaagctgagcgccacgttcctgccaggcttctgccttccctctctagcctggcagcctcccacacaccactttgcgggtgtgaggagtccattctgcagagcctgcaggggtgtgtctggatggacgctcatctgagaaggactccggctctctgggagatgccccttctcaccccagcttgtactcagtgctccttccccttcatgctgccctcaggcaggtcctcttgcaaaaacacccaagctgttttgtatcacaaatgagggaataacatgaactggggctttctggatgccaggagctgaacatgctttctttccagtccttataacactctctcagggcggtactattgaaaaaggaggaacttagtaggtgcagaggggagatgatctcgccaggataaacgcgggctccaaacccagctctgaatcattcccaagcctgtgctctttccaggattccacaccttggcccgagcagccagacattcccaattgtagacccagaactgggggcatgatggggaaaaatcacgccacggcaaaggggctggtcacaggagggtcaataaggctaagctctctggtgctatggggtaataacaggaatcatatttatattttaataatttaaggtactaagaattattaacactttcttggtacttagcaatgtgccaggcactacacatattcattcgtttccttcccacaaccgccctgcaggctgggcaccgttagcatctctgttttatagatgaagaaaataaggcaccacaggttctgtaccttgcctaacatcacacagctggcacggggtagagctgggatttggaacccaaaatgcccagctgcagggtccttcttacaatcactgtgtcatactgcctcagtcaaagcacagcaggagtcctcagttgacccctggaacttggagatggaactcctgcaagcatggtcacccacagaagaagggctcctgcaagcatggttacccacaggagcagggctgtgatgagtgggagcaaggagccaggtcacagcgtcacttaagtctaaagggcagagggaacagtgagggccgggggactccagagggcttcttggaggagaggaacaagctgggctgggaagaaccatgttggtattgctaatgcacagagaaggtggggtctgagccaactggcctgccccacactccctttggggtccttgagggtgaaacaagggctggtggggatgacgtctttgttcccatcctggggtaccattagtgcgtcttgcctccctccgcaaggtgtgtggtgtggctccccctgctacaggatctctgggatgattcctcagcccatgactgctgcagttaatggagcagcgctggggatggccctggcctagtaacctcttctacagaagaagtattcactctctccctgagccgtttgacggctctggatctccgatatctgtggggtgcactgggatgcagagggcccaagcttacctctcaccttatacagcctggtcctgaacaatctgagtgcttgagggctggaaagccctttccaccaccccctgcccccaggcctggacccagctccaggtttccagctccaggggcccagcccaaggccctgcacacagcaggcatctcagaaggcagcaggatgtgcgtgcttcattgcaagcatttagaactgggattgccgggtggagcctggaaatctgggccagaagtttagggaaataaggtgaagaagagaggacagccaggcggggcatcgcacagccactctgcccagaggattcctcccaccgaaacagaacctagagaagagggaggccatgcacacgggctcctgctggagagccctccctggcaagggctaggaagtcaggcgggcaaagcatctaccctctacccccatccctacccctgccctgagcctctctaagtgagaggcttgtgactaagtgaaggcctcagtagtggccagcgagacagtgtggtcacctgggctggcaggagagctgggggagaggcctgggatgacacaagtgtctatgcatgggacagagctctccatattctgtccacctttcactcagatttatggacagtggagcctgggatggggacaagcagcagacagaacccctccctttgactcaccctgcccctgctctccccaggaaaagcacatctgaggaaaagaacaatcagagctccaaggcagtcacatctgtgacctcagagcccaccagagcccctatctggggggacacggtgaatgtggagatccaagctgaggatgcagggcaagaaggtaagcaggggctgggcagggccggcatgtgcaggcagggtgtgaacacagccaaggacttagagcaagaagcaggctccctctcactgcagctggtagccacctgaacacctccttgggctcagttaaaagcacttagaaaaaatcataatactgtcacgcctcatctccccatcctgctcgaaaaatgagttgttccacataaatgaattttccagacaatgcaagcttatcttttttatgactgttgttattattttcatggctgttattagcgctgtctcctactgaaacaggacattacagcttcctggcacgtccccacacatcactcattggagtcaccacctcccaggaggagcaatgctgctcccattgcttaagagaacatcgaggttcagggaatttaactggcttaagcttaagaccaaggaccaaggactcagcattgcatgttcttactgcagctccagggttcccgctgcttccatttgattttttaaaaaatatttgaaatgtccctagaatggatccctattcctgcctagtcctccccaggtgtcagcctgagccacgaggtgcccatgtacacacatgcatgtgcacacttatatttactttcacactgtgggtctgttggatttccattctcctgggggagctcaggctggacacaagggaatactgattggctgatgcccgggtaggggggcatcgcatctggcactgccagcacagactggaggtgcctggcgatgtctctgatcttatctagtcaggacctcagacttgcttcttgcaggtggtctctccctgagaggacaggctttgcctctcccccttgaaatcttgccaggacctagacagatctccttgttctcctcacacagagcagaaagccagctgaagactatgggagaggagaaaggaaacaggaaggggagcctccgtaaaaggggaaggagctagttctaggtcaagccagataatttttcttttctgcctgtaaagggataggtggagctgttgggatgctttaagaagatgcaaaagaggaggaaaaattgacctaggatttcatgcagaggcacatgcgtgcctgtgtgtgcatgtctttgtgaatgcctgcatgctggttcatgcgcatgtgtgaatgtggtgtgtgctgtgtctgtacttgtaggcatgcatgtctgtgtgtcttatgtgtgtgtgcgcgtgggtgtgtctagctgcaacagtgtggttatatgtgtgtctggatgaatctggatggtggtgtatgccttgcagtgcacaagtatgtatagatcgtgtgtgtggctctgtgtgtatgcatgcatgtatttatgtggctggtgggaagttagaggttatgatgagtggacctgagctgggatcctgccctgggctctacatacttggggtaacagaggaaaaaatgtaataaggtcagtgaccccagggcccatctgtgcagcagagagaggggcaggactaactgcaggagggacaagagagtggggaggcctcatgggcaggcagggaatattggcaggcatctcattgcagattgaagtagctggatgcttgttggaaccggttgctgtggtgatgtctgcggtgggggtgggggagatggaggccaggccaagaggcgggggaagggtgggaggtagctcaaggatgtgttaatgaaaagcaaaggggagtttcagaccctgtgtcagggccaaagcaggcgggtggcagaaatagcttgttggccacacaaagggaacggtgggaggccggaagggcacaatgcccagagaggaagctgatgaagtgtgtttgtagcatggagacaggagcagggaggagtggctgtccattacccccaattccagctcatctgctggctgcccacacagagctccaggaatagcgggtggggaaaatgtacggcactcacctctcgttcaaccttggcaaatcccaactggatctggggactcttggtccatggcgagttggcataaggggcttcagcctgcacagctcctcgtggtgctttggctgggagcactggaatctcccagttgaatttcctcaggtctgcctacatcagggtttgtgtttggagagctgcagatgcttaaagagaaggaaaatagtgacaaccacgaggagcatttgcacagaatgttacagcttgaaaacacactcttctccctacaacaacccaaggggagagacaaggctttttattaaagtgttgacattttgaagagcagaaacatgaagttcagagaggttaaattacttgctaacagtcacagagcaagttagtattctggtactagaacccaggtctgctgacttcatatcccttacctcaatctcccttcttcaagccaacctcaacaccttcagtgccctctcccccttctttcctttgagcatggatcccatatgacaagctcttgagataccttggcaagtgttcagggtcgctgtggggaagacagagaaagaagaatacttaataaagccctcagcttccttctccaccccaacatccaaatgacccatccagttccaaatgacccatccagttccaaatgacccagcggctgagcccgctgaacctgctgagccctcaagggccagctgctgtccctggtgctgaaaccccttgtctcaagagaagcagagggcaagggtctccccaagtgtttccctcaggcacacccctccgccccatcctccctttcctgttctctgttttgtatcctttcttacctcatctctctcattctttctccatccctcctctatccttctcctccttttctccctccccatctcttcttcctcctgaaatcatagacttccagaatataaagatgcctcaagtgtcaccaaattcaacccttcctatcatctactttctagatgtgttatgttgatcaagttatataaccctctgagctccattgttcatattttaagaacagagatgatgatacctacccggggggttgtggtgagaatttgttggaatcatggctgagacatgcctggcacatagtagatactcactaaataatcatgacagtcccgctcactaaacaggactgtcatgattatttataggacattggtgttcttcttaaagtttttaccggccgggtgcggtggcccatgcctgtaatcccagcactttgggagtctgaggcgggtggatcacttgaagtcagaagtttgaggccagcctggccaacatggcaaaaccttgtctctactaaaaatacaaaacttggctgggtgtggtggcgggcacctgtaatcccagctacttgggaggctgaggcaggagactctcttgaacctggaaggcagaggttgtagtgagctgagatcatgccaccacactccagcctgggtgacaaagtgagacgctgtctcaaaagaaaaagtttataccaatattcatgccattttatgagaaaatatagtctctttggagggtgtttactaagtggtgcattattcttagtatttagactagttttcccttacttgtagtagacttttattgatagctgtattaaaggatttccttgagcagatcactttttcttactgaaattcagtttccccacctgcaacatgtgtgagataatctctccccatcctgcctcaagagctggcataagtgtttgtgaccaagggaaagagtcttattcctggaaagaggtgctatgcctgcttgcctgtgtatctcagtgtgtgcacatgtgtgtctgttgccacaggggactggactcagttctgtgtgtgtctatctctgacctgggagtttctagaccatgggagaaaattgcatgttggggtcctaacagctgccggcatggagctttgccctgtgcaggggctcagactgtgcttgtgggtttgtgtgcacaggggtgatccacacatgtgtgtgcatgttgattcctcagtgtggcccctgctccctactctcaacaatgtctctcacctctcactgtctctccttactgggagagaaagggatccatttaaaaataaacctgggctcattttttctctttccagatgtgatcctcaaggtggtggacaacagaaagaaacaggagttgttgtcctacaaaatccccatcaagtacctgcgtgtcttccacccctaccactttgagctggtgaaggtgagtcagaggcctggggaagtgccgggagagcaggtgggaaccaccttgaatgtccccagctattccctcggagcagccctgagcatcccacacccacccacagcatgacaagtctaggaccatgtggggctcaggaaacatggctcctggtacatacacaggaatggtgtctacaagaatttggaattctccaaattcatctctgtaaaaacagctgattattataggacaactgccacattaaatgaatataccaattaaagatagattttgattacaaaaatgttaaaagagcggatctaaaaatcaaagaaacacaatatttaccgagtacccgctgcttgcacgccctgtgctagacatttcacaccccctctctaatcctcaaggtaaattacattttgcagacatgggactgggacctggggagaaaaatctcctcctcctgggtcacagagcaagtgagcggcagagttgagggtgagcccaagtcatgctgtctcccaagccagttccttctgagctgcctccacatgctgccttggccagaaggcccaggagagttggggggtacatggaataaagcattccctggaatgcacccctggagtgagcaactgggtccaagccatggactgaggggcctgaggctcctcactccaaggttgggcctcccaggccagacccctgcctgtcctccctcctagtgctgaagggtaaggggtagaattcactctctcattgctcaaggacttatgaagcacctactatgtgccaggtagtgagccagagatgaacagaagcatcacattcccctccccactgtgcattccagaccctgaaagtggttgagagtaaagaacaatgtgaagccagactgtcgggggtcctagaccaagtttgttgcctcctagctggatacccatggaagccacttggtccccaggcctccatcctcactggcaaagctggcacagtcgttttgaggatctcaagcaatgataggcaaggttcctggcatacagtaggtgctcagtttggtcagttaccctcccccatccctcctccgggccagcactgaactttcttctaagcatttcttcaatcatggcaccagggggctttaccttctcttaggccccatgaggaaccccaatcccagggcttcaggatgggccatgcagggaagtaaaagagagatgtgctactcaccctgggagactcagcacttgagctgtaattctgggggcatcacccaggccccctggctgtctgttcacttacaacccaggccttgttatcacatctttactggaaagcagacaggcagtggtccttgtgagggtgatgaaatattcaaatggaaaagggaagatttattatattgatctccttggaagggctcacagggaccatgagctttaattatcagctcggagccccagcggagcaatgccaagtgattgtctgcagagggctggatttatggccaggatctgccccttagacactctccttcctctgtgtcttctgccccaaccctgtctccagcccactgagtctgggaaagccgatgaagccactgccaagacccagttgtacgcaacagtcgttcggaagagcagcttcataccccgctacatcggctgcaaccacatggctctggaggtaccagggctggggccctctggggtggtggtgggggtgggaaagggccaagctttgagcaggccccacgccttgcccttagccccctctggctgacctgagggtgtggagcagagatgtcaagaatggaaaaagcaaccaggcctttccaaaatagcaaaaggagttgtgaagacaagccctttggcagggatgacaaggatgaagatgctcaagcctcttctccttccctctctgtcttggaggtggcggggaggggctcagccacactgctgctcctggtgtaccgtctctgtgctgcagtggggaccagagcctgtctccccgaatcttatgctaggggcaggggagaagccccgtgctccccctgagcccacagcccagcagtttcctgctctattcttcccctcctgggatagtgccttggcccccaagcaaaagtttagggcctccttgagctttccttcagcactgtgtctaaagaggtttgactggtctggcgattaggtatttagtttattcattcatttattcatccagcaactgtttacagagcctcttccattagccaggacagggctgagcccaccttgggcctggccactgccccttgacccatcaccatccaccccctaggccaattagcagctttgggaggaactcttgatgctcaaagcagacatgatgcagggacctggcccctctcccattccccccaactttcaaactgcccatgggtgacagattcaaattcagctatggcctgagtatgatcagggtgggagccacaggacccaagctctgagcttccacctacccaaacatggctgatctgttcctatccttcccacccccctacttcccaccagcaccgtgggcctggcagggaaggaagcattcttttgccttctttcacagccagggacactgagacccaaggggagtatggtatgggagccaaaactcctaacccacatttctactcccctacagccacccctctgatgccagcatatcagacctacaggcgccctctgctccccgccaccttctatcacgccctttcctgaggacagccagcaattcacacacacacagaacaaggaagaggggcaacagcctggccttgctgtccccaggccgcaccccacagggaggaggccacatccccaagacacaggcagaactttagggctgctgtggagctgccccaccccacccagccctctgacttgcctggtagagcggtagagtaggggccttctctggctcacagcaccctgcccactctcctgccccagcacagatgccctctccatccgtgcgacaggtatggccacagagcagctgcctgctcctgatggtgagcgcatggcaggagcaggaacttctgctacttcccaggctgtcatgagcaggtgtacttgggcagctgtctcattcacacctgatcagagtccacacagaacaggtgcaaattagctgccaccaccccctttttagtcttacacctgctggggagcctgtgagcaatagggcctgccagcctccagtgaaatccctcagccccagaccccagacccatccaaagtgtgaaatgtaccatcagagattcaatcctttgaatgtgatgaagggattcagtctccagagccctcagtgagagctgcgaggccctaaggactattgtacgtgcccatcagctcacacctgtgtggggttagaggtgggaaaaccagctgagatgggtattgaaagaggagcctgaaaggagggtgcggagggagaaaagggagaatgatccagaacaagcctcactcctgggccctcgccagccacaatgggttggtgggagctgcagggagtctgagtagagggatcagcatgtgcaaagaccctgtggcagaaataagaggggtaagtggcaggagtaaaagagtctggagcaagaagacaggggctgggggcctgtcgggagacacggcagaggggcttgtggggtgtcgggcagggaataacgtgacccagttcatttttaacaagagcacttttgccatcatgtgtcaaattgcctgggaaagaggatggattagggaaaggaacagaagtggagaggctagtgaggaggcagaggaatcgaaggagcaagaggaatgagagccgagtgggaggtgggtgagggctgagggagagtgggagccattggtggatacagggtgagggtcagggtccgggagatcagggcctcttaggctggcagcagaggcgcatggggacagactccctgtctcccctgtctgccttccagtgtcccccaggcccagactgagcagggggtcagtgagggttggagcaaggtgacgctgtccactcctgctttgtaacctcctgctgggaccccgctcggctctctgaaagctgcgccaatagaagcctggagtagaggagagggcagtcaggactgggaggcagggaagcctttagggggtgacagaggactgaggagggaacaaccaagggcggtcaggggagtgacaaccgggatctgatgaagaaagaggagcccagagatgcggatgctatgatcctgttccaaaccagtacttcctggggaaaccagcaaggcaggagagcaggcaccagggtgagcagtggagcaggcaccagggtgatgggcacgagggaggcaaggggagcctggctgtggccgctgatctcaggaagttcagcatggtcggagaaaccagacctgggcttcctgtcttcagtttataaagtgctctctcacaaacgatctaatcagagacccctcacagccctgggaggagcctcatttgactgacagaaaccaaggagctggaacacctagccctacccctagcccaacccctccccaggagccagtggaggggccgaggttagaacacaacctcccttcccaggacccaactctcatcgtaccctttctccccaaagaaactagtgtaagagatccattggtaaatcccaggacagaaagcgggagcagttgcctcagctcggcagagaaggcttcctgagggagggcagcctggtgcaaagcaagaaccgagtaaggcagggaacagggagaagcaggtgtcaagtgtggaggcagccatgagctcacggatggggaaaaagagggtaggcagtctggctggctgtctctggaaggtcccaaggccacatggtgttcacctgcctcctctcctctcctctccagatctttctccggggagtcaacgagcccctggccaacaaccccaaccccatagtggtgattgcccgggtcgttcccaactacaaggaatttaagtgagtggggcccaggtggacctgggtgaggagggcagagcagagggcagaggagggggtgaggctgtcattgctgccatgggctgattccaggacctccggcaacccctctacccctaaggcccttcaagcctctccattgggtctgaggtcccagtaagcttcctgcagcagaccatgcctttctttccccagggagagcccaggcccctggaaaggggcagctcagtcctctcctgagagcaagctggagggcaggtggtggggatgagtgccgataccaggcctaacagctagagagtgtggggaggacaacaagaggggtcctcattccctgctcagggaacctcagcccctccaacctgcctccctgcctcacacccaccacctccccactccccctcccactctagctcagggccacaggctccagccagtggttggccccaaaggccatcttggaacttcacagcctttagccctgccgggcggagtctcctccctcctcatcctggaggtctccctggtcccagccacaactcatcccctcctcccctagacctccttttgagtctgttggagtcacagtcctcaagaggagattcatactttgccacacagtgggaaattcccctatgaacgtgtgctctctgccacagcaccgactcctgggagtcagggtctgtcttggtcacttccaactggccctgatggcccaagatgactcccctacttctctgtatctcctgttgagtttttatgacttatgaagcccccttgcttgttggaggaaggaagatgattgatgcacgcccagcccagtggtccccacttgtcgtgaggtccaggcccgaactcggcgggatccctgcaactcccttctcttgcatcaacccagagtctaagcggggggccctgggctgccaggctcaggtgcagagcccagagcactgaccctgtctccctgcctccccagggtcagccaggctaacagggacctggcctctgtggggctgcccatcaccccactgtccttccctatcccgtccatgatgaactttgacgtgcctcgcgtcagccagaacggatgccctcaggtatgtctcctccccagtggttccagcttcctgtaactaccccacacattcactgttcactcactcagtgagtcagtcagcagttcccttgactatcgagtaagagttgactgaatcccacggcatacccagtgctgtgctcgcctgtgcggcagagaaactgccctccaggaactcttggtctggtgaagatgggagtcacgtgggtgaaaaagttgaacatcaacacaagataatgtataatctaataacaaactgggagggcctgtcagggctatcacatcagaggagaagatacaaaaggacaaatatatgattccacttatatgggatacctagaataggaaaattcagagtcagaatgtagaacagtggctacaggggctggggaaagggaagaatggggagttacaggtcataagtacctagtttccgtttcaagtgatgaaaagtcctggaaatagatagtggtgatggttacacaacaatacgaacaaatgaatgcatttaacattaccgaactgtacattaaaaatggctacaatggtgaatgttgtgttacgtatattttaacccagtaaaaaaattttttttgagacagagcctcgctcttgtctcccaggctggagtgcagtggcgcagtcttggctcactgcaacctctgcctcccgggttcaagcaattctcctgcctcagcctctcgagtagctgggcttataggcacatgccaccatgcctggctaatttttatccttttagtagagacagggtttcaccatgtcggccaggctggtctcgaactcctgacctcaggtgatccacccgctttggcctcccaaaaggctgggattacaggcatgagtcactgcgcccagcgaaaaattttttttaatcagaggagagggatgtaaagcctggattagggaaggcagtcttgaatttttttttttttttttgagacagagtcttgctcttgttgcccaggctggagtgcagtggcaccatcttggctcactagcaacctccgcctcccaggttcaagcaattctcctgcctcagcctcccaggtagctgggattactggcacccgccaccatgcccggctaatttttgtattttcagtagagatggagtttcaccatgttggccaggctggtctcaaactcctgaccttgtgacctgtccacctcggcctcccaaagtgctggaattacaggcatgagccactgcactcagccggcagtcttgaatttttaacagaggaagggttggtacaggttggacacagcaatagcacaagtgtgaggtggagacaggcaggctatgacccatgtcagggcagacaggagggctgtgtgtttgagtatgaggttgggggcgggtgcacgcacagaacatggctgggttcaggggaatagccagattggtctcttctcatgatctgcgcttcactgccagcttgccctacacgatggtcccaacattcctaggggccttgggggacagagggatttttggaggtccctcctattgtctgcccaccagtgcttatgtctggcatagcaaaaatagaacaagacacccctttggagcccaggcttcatttaaaggcaaagacatttgaagaaggctcagacatggggtagagtgatggtggtggggaggagtgggacaaagggggaccctggggacagaggcttcaaacccaaaccaatcctttgcctgatttccctagagttacctcacacatggccctgcatttgcccagaaaattaagaaccaatcagcaggctgtcccaaggggcaagaggcactgcctgctttaatgagtgtgccccctcccacccccaggctttctctggctgcctttgctgcctaactagtctgggtaggagaggtgccactcactacagagacttgttcccagtgccttttgcatgtgtgggacccggtccagcaatggcaggacacctgttgaacatcacccaaccccatggcagctgggccaggttgggaatttgctggcagctggcacagaggtgcccaggtgcagcagtgagagaacaggagcaggctgctgtggtaaggaggggtggggattgcccgggcagagccatacctggaggggcaccagtcagcagcgtgagctcagtcttcacacagacccctgccctgttccctttgagcgtcagtcccctcatctctacacttgagggggtgggattggacttggtaattttagggcctgccctctctgacatcttggggggctgtgatttctcaccaactgtcactgtgcaaaagcactgtttgacctgggtttgaccccagctctgtaacttactggctgcatgacctttggtaagctgctcctttctccagactcattgattccaatctgttaggagaactcaaaggataatctttgcaaagtgtccaggcccagggtccaaggtaaatgggttccactcttaacagagctgtacctcccctagtgccagtgtcccctctgaggccagcctcaccactgcccttttcacatctggctccaagtaacagaaaccccaacttggatcggcttaaatactaaggatatttattgtcacacaccacatcaactcacgacatagaatgctgccagaattggtggatgctcaggctcagaagcatcctcgaggtctcaggatctttccaacaccccgaattaccatcttcagctggctaacggctcatgggggcacttcatccaaatagaatgaaagaccagcagataagaggcagcctctctttttttttttgcgaccaagtctctgtcccccaggctggagtgcagtggcgcaatcctggctcacactgcaacctctgcctcctgggttcaagcaattctcctgcctcagcctcccgagtatctgggattacaggcgagcgccaccatgcccagctaattttgtatatttagtagagatagggttcaaccatgttaaccaggctgatcttgaactcccgacctctggcgatacgcccaccttggcctcccaaagtgctggaattacaggcctgaggcaccgcacccagcagcaccctctcttcttgtaggtggttttaaagagcaactggaaaccaaccttacccagccatccctcagcagacctccttcctgtctgattagccaggattgggttacatgcacttccctgagccaatcactaaggaggggtgtggctctgccttgctggtataaatgtggaaggttatggaggcggagccacccgaacccaagggccatctgctggtgatgaggcaaggaggggcatggtggtgggctaggtggccctcagtggagcctggtgatgatggcaaaggctgaactggtgagttaaggggtagatggcctgtcggacttcacctggtccagcctgctggaaccaacatagggtgggccgtgtaagttactcctaccccggcaccttggaaggggcccattgcccaacaggctgctcctgttgttctggtctcctacagagctggagtggagctccgggaagccatgtgtgcccaccaccatcccctcctctctcagccccacagctggcctgtccccaagctctcctggggccccttccatccccacagaccctgccctagtgctagcctcccctcaggcccctgccatccattctctgaggagcagccagggcatcccctgcctagcccttcccctgggccccctgttactatcacgacaaggcaaatcccactctcagccaggtccacaggccctgtgccctccagcctcctggcttatggctccagctcatacaggcattctgcagccccactggacagcttgctgttctccacacccacactgccccttcccacctccagcctccacctctgctgcactcgcagtctggaatggccttcctcttccttacctactgcccttgtccttcaggtcctccctgaggaatggggtcagaagtcatggctttctcctcgcacaccccagctcccacaaccacagcttgcttaggactctacatgtttgtgtgtgtgtgtctgtctgtctgtctgtctgtctgtcccctatcctcctggatgatggtgggctacagggtcgggggcagagtctggctctacagcaccccacaggcatctggaatggagaagccccccagagtcaacatttgctgagttcagtgaagttgaacttacatcttaatagcaaaacatccattgtctcctttaaccttacaacaggctttcaaagtgaggagtttgaggcatatccccatgggatgatgggaaaagtaggtcccaaagaggagaagggacttgaaggccacacagcaaggttgaggcagacccagacccagagccaaggggtcctagatccctagagaccccagcccagcatctgctcccagcagctactcctccagatggcggccactatgcctgggcagagcaggcagaggtggatgtgggtgggcccaggggaaataaggcggtgggcgtggaggggccatggaatgaaggctctgtccccaggggaagcaggtctgcctccatggctgggggttaatggcttttctgaagatcacagctgagggttaatgacattccataattccactaccgctgtggcccttccattagcatctgcaggcgatgcctgcctctccccgcccccatcctgcacacacatcagccacagtaccctcaccagggctctggcgtcagactgcaggtcttctaactttgagttcccaccactcctgcctgcacatgcacaagacaggctgaccctccctccccagtcctaggtctgaagtgatctttcctaagtgacttgccctgggaaactactcagggaaagggctgttccttattgggccggcagccactcaccacctctggcttcataggctccatttagacacatgaataggtcccagaaagggcagctagcgtctactaaataaccctcttccagggtaggagcaaggtatggacggcaggggactgagtcacaggtgccccaatgcctggcagacagtcccagccatgtggaccctcctgcacccaggagaatggggtgactctgggagggacatggtttggggatcaatcttgaaagatcactcccaagccccacagaagtcagaaccaacttctctcaccggacctgttggccaagctcccataagaagtgggatgttcccatcattgcagtctctgttcaggtgtccagggcaccctagccctgcagtgactgcaacccatctccccaggggcaggggcagacacagctgagccttgggctgggcctggacaaaccaggcccattagtgtgaccgtcatcagcaccctgccactgtggggaagtggacctacactgatatttcatgatcctgcatcaataactcctggagccgcagtgcatttgtgctgaccttttcgagcaatgactgattcctgtgggggagcaggaggtgggagcggctgctactgttgctgacagcccctggctggggaacagaggcaaggcagccacttggtgggtctgtagcaacgacccgcagccccgccctgtgctgggaccctgcagggctgcctgctgggagttatgggccgatggccatctcccatctcccaccttctggccttggcagatgctgggcctccccctggagtctctcctcatttcaggcgtcctctgcacagggtgtgctcagtgccactccacatttttgattgtgctgttttcccatcctgaagacctttatccctctcttcacccagccagaccttccttcagagcctttctctggttctgcttcctttaaggaggcttttctgaccacccatgggaatatttcatatagctctcttattgggcagtgctacagttaatactgtcttgtttcattgtttaaatcatacccatgtgtgtgccctaactgctgacctagggtgccatcaagtcccccgagtgcccactggcccacactgcgggcacacggagcctctgtagtctgcagagatgtcttggcctctgcaaggggctggggaaactgtgtgggaaagagaggggctggtgacacagacagaggtcatgtctaacttggcatctgtgacaccaccagccatgggtgtgaacacagatacaacactttaggaaaacagtttaccaataatgaatgaggtgtcctaaaatacacatgtcctataacccagcaattccattttaggtagttgtactaaggaagtaatttgcgacatgaagatatgtagcagagaacgttcaatgcagtgttattacagggaaaaatgggaaggaagaaatcagggcacttggacatgaacttcatatcctgaagttactcaagtcatgggtaatgagctttctgtgactttggatctgcttaggttttactggcaaatgaaaaatgcaggatgctagaatggtgattatacacaaaatatacacagaaaaaaactaggaagaagcacagttttatgaattattgtgtttatcataggaacacaggagctgtttttcttcttcctatttttctgcattttcctaaatgtatttattaggtgtgtgctgcatttatttgtttatttatttatttatttattttatttatttagagacggagtttcgctctgtcacccaggctggagtacagtggcgcaatctcatctcagggcaacctctgcccccccgggttcaagcagttctcctgcctcagcctcctgggtagctgggattacaggagtcccccaccacacctagctaatttttgtatttttagtagagacagggttttgccatgttggccaggctggtcttgaactcctgacctcaagtgatccacttgccttggcctcccgaagtgctggaattacaggcgtgagccactgtgcccagccagcttgcttttatagttgggagaaacatttgtgacaaatctagatacacaaaaccaaatatctgtgtatgccttgatttgggagaagctgtggcccccaccacctgctcctaccctctccctccagctgtccaagcctgggggacccccagagcagcccctgtggaatcagtccttcctcttccaaggccgagatggagctaccagcttctcagaagacacagccctggtgctggagtactactcctcaacttcaagtacgtgacccctggtgcctcgccagggcagccatgcctcaggagatctgtattatgaaagggtgttcagaccatcccacctctgcctcccacagggatggatggttcccaggtgtccaggcggcttcctaatgcaggcagaggagagctggctgcgttccttgtccacaggccaggacacgtgggcctgtcccatactaggtcttggccccaagctttgttttattgcacccatcagtgatgggggagggctggagccctcggaactcacagagaggggtgagggagatgggcttcagagaccagctgatccacagttttctgcactgtgggattgaagcccccaaagggtagagatgaggctgatgtatataaattcccagacacacagagtatgtttagagttggctttgagttcacaaagccctgaagatgagaagaggatgtatgtgcagggaaaggccaggaggcaggaaagcaggcagcgggagacaggaggactggatgtcaggtattaaaggatggggccgaggtgggggctttggcaggagccctagttgatccttcccccacagtgaaaggcagccagccgtggaccctcaaccagcccctgggcatctctgtgttgccgctaaagagccgtttgtaccagaagatgctgacagggaaaggcttggacgggcttcacgtggagcggctccccatcatggtgagccccctgccctgaactgggcccctagcgtgcccacctggccccaccctgcctcaccctgccccacctcaccacacctccataggagaatttggcttctccagaagcttctgtcaaggcacccaccagggaagtcacccagtctagaagtgaggagctccctggaaccccagaagccagtcttgcctctgggactatgacgaaccaagccagagaaattgcccctgagcaacttgggagacaagtacagggtgaccctgtgagacagtgcaagagttcaggctttcagccagccagaccctgatttgaaccacagttcaaatcctcactgtggaaattcaggcacattactgaaccacaagagtcctcgtctgtaacacaggagaagcatgccaagtacacaatctctgtgtataacaagagagttcagagctcaggctctagagccagactgtctgggtccaaattctggttccaccacataccagctaacatgaccatgggaaaactactgaaagtgtcaatgcctcagtttccttgcctataaaatgggtacatggcaatagcacttttttcatagggttgctgtgagatttcatgagaaaacccatggaaagcacttagagtaagttctcaacaagaatgaataatatcgttaccatcattctctattcctatgccaccatttcccctaaaatacttctggccatcctgacataatagacctcaatgaatgagaatctctctgtcagatgagcctggtagtgccagacaggtctctagaggggtttagaaggggtggtgtggaggcagtttgcgagggcaaaagcaggaggccagctcccacctccctcccaccctcctgggtgcagcccgcaggtgacaccttccagagaaatctagaacagtaggtggggcagaggcggaagctgccctggccagcatggtctgagtgctcccttttcctccccaggacaccagcctgaaaactatcaatgatgaggcccccacagtggctctctccttccagctgctttcctctgaggtaaggctgtgggccaggggagggtcagggccagcaggcacatgtcagtgagatccaacttccttcacaattgctggctttgttcagggacttctgggaggatgggactactactttggatagaaacgtctaagggtgatttgagactccagacaaacgtagagagagctgggattaggaagaggagagttgtgagcagagggccacccagaccttggagtcagcctctgaccaagcccaagccaagtctggctcactgggatcgaggttctgcaagggtgagctaggatatcagttttctattgctttataaccaaattagcagcttaaaacaatgcccatttattagctgacacttctatatgtaggtcccatgacacagggtggctggaatcaagatgttggcagggtcacattcctttctggggattatggggaggaatctgcttccaaattcattcaggtggctgccacaatccagttccctgcagtgccggactcacatcccggtctccttgcaggctgtcagccggggcagctctcagctcctgaaggacgcccacatgccccctcacaatggccccgttcatcttaagccagcaggcatgtccagtccctgtcacacctcaaaactctgacttcctcttctgtcagcagccacagaaaacttttagaggtgcttttagagggattttagaggggctggtgtgataaggtcaggccattctaatcatcttcctatcttaaagtcaacggtgccatgtaacaaacataatcccaggagtgatcagtcatcatattcacgggttccaagaatgagggtgtaaaatcttggaggcccgtttttggaattctgtctaccacagctgggttggtccaaatgtgaagacacccagggctaagccctgcctgctggatgagcctcgatccctctcgctagctacacctggtctcagcccagcttagaccctgctcatttggctgcagtgcacatgccaggcacccgctggactttccctctttcctctcagtggtgctgggatgtgagtagtttaggaccatgaacccagaaagtgtttgcagggactaatgtccgcgccaacccactcctgccttcttcccacgcaggaaaaatatccaccagctctggggtagcacttggctctgtgacctcactcatgaagaacacagggaatcctatggtgtggggtatgaggagtatatctgggttggtaccagcctgaaagtgcctttacaaggcctctggagagggcctgagaccccattagcactccctgctataggtgttcaggattgccctctcaagggtagaagcaacaaaccccaagaaagaggcaccagaatcttggagaaaaaggtcacaaacttcccagtttggagcccaaccctccggggcctcttcccaaggtatagagtctgcctgtggccactggccactgccagcccctccccacctccctctgtctcctgccccttccactgggcatgtgtatcctgggactaaaaggagcgtcaggtgcccctggtcaggggactgactagtgggcccaggcaggcaacaggcaggtgggcagaacagtttccccattgcccaggggctgggcacaaaggtctccagtaatgaattattcaccggagctgtgctaagtgcagaattaatccctttccttccagctggcggcctcactaaattatccctccaagtcatgcgggaaaatgctgccgaattcatttagctgctgagtgttttgatctgggccttgtgattttagcgtctccttcccccaaccccctccccctggaggcgggtaaaaaaccttttagtaatggatttctgagaagaaaggaaaagaaaggggatcaggattgggtgtgtaccaagaaaatagtactagcagaaattcagattctgcagccaagaattcacacacacacacacacacacacaccccctctacatatacactctcaatcacgtgtgaatatctacacacagtcacagacacacagatgtgtgcgcacataccttggcaagaaggatgcacactcttaacacatatgtacacgctctcacatacatgcaaactgacacacagatgttttcacacctgcagtggcacacacggaagctaaatctctttgtagtggaactatttcttggtaaactatctgagaattggccaataactgactccctttgattctagaatcttgaagaccaatttaggagcctaagtataaagtgctaatgtggttaaattcaccatgaagtccttgcagctgcagcacccattcatttattcttttattccatgtatatttgatgaggagtcactgcatgtcaggtagcatgcaaggcaagaagtagaattttggctgccattgtggattgaaatggggagaaggaggggttggcagccatggacctcattttgatttgagctcacaccttcattgggcttggacatggctctctagtgtctgagaccttttggcatccttctccctaagggatggcaggaaagtgttgagaattcatgaacaggtcagatggcattgcagctaaatctaaaggggcccatccccttctccatccctcatcaccaccttcactgcaataccatcattgttctctatgcaactgcaaacatttctgaagcacccacatgagcaattgctgttctggattttaggaatattacactgaagaagaagaagaaaaaaaaacaatcaggccctgtctttctaaagcttgcattcttagcagggagtatggaacagacaataaaaaaataattcatgtcagctaatgataaagggtctgaggaaactcaaacaaggtgacatgatacggagtccttgaaggggctatttggactcctcatggtagctgagtacggtgatgagctaagctgctataacaaagagatcaggttcctgcccccttattgttgcgcctaaggtgttgcctgcaacttcatcatggaaggtacctggtattcatctctgcatcctagactttgggaaggcagcagcagggctggggccatcaactcttccaccctttaaatcaaatattgcataatgggtccagaagccaccacctgacacctggaggtcttagagtcctgtggacactccagctgccgaggcttgtgatattgggcctctcaggcccctcgttcacatggtcaacaactccatcctaggggtagctctttgcatgtggtcagacatggtcagtgctgtcacagagcggaaatgcttcaggagaaatgaatgcgcgtgccgtatttgggcccagccccagtctgaggacataggctctttccatgagcctccatgtccaggagttttgggcacaggctgtcctggataattggacattttggtgaacacagcttccccacacccgccactaccacgtcacccattctcagagctttcagaagcagcatggtgaaatttgcaaataggcagagacagcagtggcctctctcaacagcccacactggacagcaatctccctggcagcacgtggtcatcccagtctctcctcctgtgctgccatgacagacagctcactacctccagaagcaggccttcctatggctgagtgatagaaatggccaccccacatgatctcaacctgcctcctggggacctccctctgccccaagctcctggctttgcccccgaggctgcagggcgacctcagcaagcctcctacatagatcacatagtcagccaacacttttgagggcagactagataacaaagcctgcagactcagtgaatggcaagaggtggtggtctctggtttggaatattgcacttgaaggtggttggttggtgatgggttcgtttttcaccctctggtaggacttctctagtcatttgctgcttaaagtgatctgcattaagatggcttgtgtgtgtaggtgagtacgtatatgaacacacacagatcacacaaaaactagaaaaacatgtacactcatatacaaaaacacatacacagaaaacttccctttattgcacattcagtggggactggcctttgaggtccattaggctctaaaaatccatgagtctggctgggtgcggtggctcacgcctgtaatcccaagactttaggagtctgaggcgggcggatcatgaggtcaggaattcaagaccagcctggccaacatggtgaaaccctgtctctactaaaaatgcaaaaattagttgggtgtggtggtgggtgcctgtaatcccagctacttgggaggctgaggcaggagaataacttgaacctgggaggtagaggttgcagtgagccaagatcatgccactgcactccagcctggacaacagagcaagactgtgtctcaaaaacaaaaacaaacaaacaaaaaaactccatgagcctatggctactccacatacacacacacacagaaacctttggtctcctccattcctcctctgatctcagcctcttctctttgaagagtgtgatgtggtctctggggagtctacacttccccaggcaaagcagcttggctctcttaatgaactggtttcgagatcccacagcatcctgggtgccctccagcttgcagccagcctctttgaagtgaggcccacactgcccaggtttcctgggctgaccttgtggattggagcctggcatgcacacagtaggtgctcactgcatcagttcctgcctctctgcctggaaatgcacctccccatgaggtgggacaagttcatgccgtcatctgggtatacagcaacatttctcctcttgcatttaagatttgggatccatcaccttgcccagatagggcaccaggcagaagtagggcctctcagatgggtggccacaccctcctcagcccacagcccacagacatgctgggatgacgtgaaaccccctggcttcctgggagtatagagagggtgcatttgaggagaggtggcagtggcacctgctgccaccactgaggggaggggcaggtgccatggtcccatctgaccttccccctccctcttcccctcatagggagagaggggggcaagtctttgatgctactctggtggcttcttttcagactagttacaaagatctctctggagaccagcccagagtgaggacaagtggccacttagcaaatatagaggaaagggcaggggacaggcagcatcatgctggcttttgaagaatttttatggattttttgtaagccacacctgacacccctgagatggtccttagagaaactgcaacacaaacctccctccatttcttccccaagcacagcggcctgaatgggccagtgcccagggcagcacagcagtctcctccactggttctgccctctgaaggctctgttcccacccccaagactccatctgtgaaaacactaccataaggatggatccagagagagagaccctttccctgccactatctcacaccatccctcactgccctcctttccacacccaaagcctctgccctcctatcctctcattgcctcaggtcatttggcaggaggcagaggagacagatccaccccttacccacaggtgccctttccctcacctgctcaggttctaggtccagtgtagagctcttcccatcccatccaaagaaaacttagagctgggcgtggtggctctggagagattaaatctgtatacctgtaatcccagcactttgggaggccgaggtgggcagatcacctgaggtcaggagtttgagaccagcctggccaacatggagaaaccccgtctttactaaaaatacaaaaattagctgggcttggtggcaggagcctgtaatcccagctactgggaggcggaggttgcagtgagccgagatcacaccactgcactccagcctgggcgacagagcaagactgtctctaaaaacagaaaacaaacaaatcaaaggaagcttaggatggggcaggagagacatgagagtctgtgctttcacaaggccaacctggcccccaggtcacagactctgtgtcggagcagggctggccatcccacctctcctcctgcgctgccatgacggaggctcctacctgctttccacaatgcctgaatccccctatagtgttccctgccttggggacaatattggcctcccttggtgatcatgcaactcccatgctgcccacttcagagagaaggaactgaacagtccctccagaacacacacagagtttgacagactctacttggtcatttcccgacagagagttcattaccacccaggatgccctctccatcctctactagctcccttctaaacttccttctgtctctcttcaatttcctccccctggccctgccttttcctcccagaggccaactccagagaagtcagggcctgtcagccctactgacatttgcaaactatttatggcatctccagcctgaacccactctcattcctcttcctctttgtagcacttggtttctgattcttgtcctgctgattgtctcctcttgacaacattcctgttaaagtatcccccaaaactgtggggcccaatcagcattagaggtagagtaggaacatcactccctctctctgaatacattctcccctttggtgcagctgaagcctagctttggttctattttagtatttatcaaagcagtgagggtctgtttagagccagagtccaactctggcacatcagtaagcagcatgtctgcatcttgcctccctgctgttctatactgaacttagacagggtttctctcccctgtggtatttcaccttttttatctcagcccatcttctaagcttgagatcattctggaccctgattttatcatgcaacacactcacagccccatctgtacccccaaccccaagctccaggtcatctgtggaggtggccaagacacttgaagtgctgcaatgtccaccttgtaagcctgtagacctgggcttgaatctggatcttccatttgatcttagccatcctgagtttcactgttctcatccataaaaggggattgtaatccctaccagccaggaacatagtgaagattgaatgaggaagcatgtgcaggtaacctagcacagtgtcctgcagatgctcggtaaagggatctcttagtgtctttcacccaggtttctgacaaacatgctgaactcatcagggatgaggacagggctcctgggggaggggagttggtggagccctgcgaacccatcactcggtgcccgcccctcatgacagctgctccaccagcttcgcatccataaggacatcaggaggccttgtcaggtgctgaagataaacatcgccagcaccacatttggtctcgctgcaattttctgagaatgaaatgggggaagagacagacaaccatctctccagaagccagacttgctgaagtcctcaatgtaccctgccctgagttgggggctgtggagcctaggagctcccaggccagaatgggaagggctggatggagaggcatactgcttccaattgctagtcattcagaagacctgctttagctcatctcaaatgtctcaccaggctgggcctagtggctcatgcccataatcccaacactttgggaggccaaggtggacagatcacttgagctcaggagttcgagaccagcccgggcaacatggcaaaaccccatctccactaaaaatgcaaaaattagccaggcatcgtgttgtgcacctgtagtcctagctacttgggggcgttgaggcaggaggattgcttgaacctgggaggttgaggctgcaatgagctgagatggtgccacttgggggtgctggggcaggaggattgcttgaacttgggagattgagtctacagtgagctgagatggtgccactacaccccagcctgggcaacagagtgagaacctttgtctatttatttttttaaatgcctcaccaaccacagaacctagtgttgccttgagaatgtgagcctacaactcccagctgcagatggtgtgtattaagtcagaatgcagagatgactgagaaaactggacattgaacactcccttcccttgctctgctctccctgtgagcccagtgcataattggtagattgaagaagggggagggaaggaatagagagagacatggcagaagcttctagacaaaacttctcagaaaatgggagttggtcttgggatttccccccttctgaaaacccaaccaccttagtatagacctcccttcagtgctttcagccaagatgtatctctggcccagccaaggtcattcattcattaaccatttgttaggtttcttttcctttttttttttttgagatggagtcctgacctgttgcccaggctggagcacaatagcatgatctcggctcacttcaacctccgcctcctgggttcaaacgattctcctgccttagtctccccagtagctgggattacaggtgcccgccaccatgcccagctaactgttgtatttttagtagagatggggtttcaccatgttggccaggctggtctcaaactcctgacctcacgatccacctgccttggcttcccaaagccatttattagatttctaacctgtgccaagcagtaaagcaccccaacagatcactatcacccatcttactaagggtcctggttgagattggtgcattgaatatacagaggtcagggcaagcatcacagaaaggcatggtttgagctctgttccaaatagtgggttggaaattggcaaagcaagggtgcttcaggcaaagggacccccatgtgcaaaggcatggaggcatgacagtgtctggagcacatgacatatgagaactgtaatgggcagtgagactagaaagctagaagaagtctagattgtagaggacctgggtgctagggtgcagggtgagggctttatcataaagtggtaggaaactaagaaaggtcttggagcagcagtaggatgtgatttcatctgtgttggaaaggtctgtctgcatgagaataggggaaacccaagggaaaaaaataaattcagaaagccaggtttcagggtaacaagagtgagcccacagtcaaaccactgagccacaggcaggactttcatactaaaatccccaacagaatttttaaaaattcttatcagtggcacccctcctctggcctcaaaatgtgctttgggattaaccctctaacaccacttctggcaaatgaatcatggccccaccaaggattaacactggggcccttcttggctgggagacagacccggagcttcaaaccccactgcagctgcaagagcacgcaggatgccataaatgaggctcgctgtatgcaggggaggcagcaagccctcttggaggggcctgttgtctgagcttcgcctacagctgaagagataagaacctacaactgcagccacaggaaatgacaaagcagtgactgatcggggaactgctgcacagggctcattatggcgcttgccagtgggcgagacacccttatcagggagaaaattgcatcaggcctcctgaattactagcgattggaagcagatttcttgggactcactttgttagatacctaatgagcgggatacaggcgggcagagcccaaagccagcggggcgagggacaaatgtctttgttaaacagaatttgtcagtttccgcttcaggccccctggggagggttcagggccagctaattgaattaagagcatgtgcgctccagcaagaaggctcagggcggggcgagaggcaggcaggccggaaggcgggcactttcagcaccaaggacagcagctgcagcctggctagtcagtaattgtggggcaggctggaactgctgcattttgcatgattggggatctaggggatggaatgggtaggaggaaggcagaggatgttgtggggaggagggagacaggtgacctaagaagcctcaagcctgtgatgccattggcctggtctgtctcaacagacccaactctgctaacaacagtgagtgctgggaggagtgaggaagggatgtcttctccccaaccatggcactcacatgtggtgtgggcagctgcaacaacacagggagcagtgagctgaatgctgggtctgagctagtgcgtggccatgcatctctttgagctttcaaagtcaatctccaattatagtcttaatgaaccaggatgtgctgcagccacgaagccatggggacaggggccacttgtcagccccaagctgccccagcaggcagagcaaggcttgtcaaatacagaagcaaataagtaggcttgtggggtgggccagcagcccccaccttacctggaggaaaggagagcgaggcaaggctgggcttgattaggaggagttagtcttgggaggagttagtctccaaggctcttcccatcctccaccctgactcaccatctcctatgggttggctctttctatggtctcgagcagcctggccctctctatggtctcaggcaagctcccttccttgagaagcaaggggctgagggcataatttccttccccaaatgtgagctgattgaagctgtggagtctggagaggcaatgctgaccctaaagaaggagaactattagggagaatttagacatgatggatctcttggtgcccgtcacctcacatgacaaaagcaactccctctgatgtgccctgcgggatctgtgctgtttggaggtctaaagatttcactataaaattcacctctccaccttgcctccaaatcccaggccaggatggatcctggcaaagttgaatgggacaggggaatgggaatgtgggcagagacctgcaggctggggaggtacaggcatggagcagccatgggagcagatcctggccagggccagccccagggtagggcaggacagaatcattgagtctggcaggcactacaggaagggtggctggagcaggaatgggcaggatagacttaaagtccataggtactctgccttgcctgccctccttccccgagcccacccccacctcaccccataagagactgatggggtaaaggcactggtctggactgaggggttgttcccacctttattttagctttgtgatgaaattaaatggattatacatggtaaatttcagaatccacatacaagtacctggtgagtgcccagctctgaccaggggctcagtaaatgtcagctctgggttattgcattgacccatctggtgctggggccacactgagtggatgtcagggagacaggctatgggggagggaactcctttgcaattgtccctgctttcagtactgatgggggcacctctggagacctctcccttgatttcattacttctacttcctctcctaactggattagatggcagtctatgaaatccagggcatagagattggctttctgcctggaaatgagcagaaatgtcattataggtcctgaatcagcatctcaccacagccccaggggccacctggtcaatgggaaggtggtctttgccctgtatttatgctttccttcattctctcctgcattcatccatccattcatccacccactcattcatccatccatccaatatgcattttgtagctcttcctctgcagtcaatctagtgttcagctgttccgagaaagagacagatgtggtactttttcctatctaaaacacatggccagaaaaccctaaaccatctgactcagatgctaccctgggtgtcttcacgtcagtggggagcctccaagtgaagcctgccctctgtgagccatagctactgagaggaccaggtgggagagagagccaggcctgatgcccacagacaaaacaggcccaggagtcttggtcatgaagtgcagtaggtggcctgccaaagtcagcctcggggtcccccagtgtcccactcttcccattccaagagtcttattatagctgctttctctttggcgttgtctattttgcacccatttgatggggagttgggggacatagagcccagacttagccaaatgcctctgtgtacttatgtgactgtcccttactctatagacatggccagaaacatcttcacattaatgaatttctgcacagcaaattttatttgaaaggggcataaaagaataattacttaaagaatttcagtggtaaagtgaagggtccttgtctcaattcattgaattagtatgcatggactttcctatagaagaaccactttaaaagaggcccacctgcattcattccctctctggttgttcagggtcaaacacctgggcacctctaactctgagcgcatctgtactggttggcagtgtgcccattgctctatttatttctagcacaagactccagacagtggaataatttgtctgctatgcagccaagagaggattccaacagctggtgcagggtggaactggctcacttttgaggtccctgaaaaccctaggactgcatgattctttgaacaatgagtatgttttagagataaccatgaatttccaacagggctttaaagtaacccttccccaaagggagcacagacatgtccctaagcccaaggaacttaaaattttatttaaaaaaaaaaaacaaaaaaaaagcagccaggcacagtggctcacgcctgtaatcccagcactttgggaggccaaggtgggcagatcacaaggtcaagagttcgagaccagcctggccaatatggtgaaaccccatctctactaaaaatacacaaaattagccaggtgtggtggcggatgcctgtagtcccagctactcaggaggctaaggcaggagaattacttgaactcaggaggtggaggttgcagtgagccgatatcatggcactgcactccagcccgggcaagagagcaagactctgtctcaaaaaaaaaaaaaagaaaaaaaaatagcaggcaagtctggaattagcaacatgaaagcacagacagccaactgctagaccagaagaacccagaaaacctacaagtcagtgtgagctgagacatcaagtcatccttgggcggtgggggtgctggtatttgagtggcatcagactttagacatatgacagtgataatcctgccaagggagaaggaggagaacgggaaaagaacatggagggagacgaaggctcatcagaatatacagagaggagagactgtctgcttaatgggtggtaagattgaaggatgatagaggagatgaaatggaaaataggtctacatagcaaagggtgtcaaaagagtgtaggattttagaagctgttgttactgcaccaagtgtgggtgccagagatggcataattcatttattcttccaccaaaaatgtattgagtgcctacaatgagccagagactagggatagacaaggttccttgctgacatgggactcacatcctagcatgggcatttgcagaaggaaggcagttaagaagtaaatgcatttttaaattttctggtagagtaggtgctatgaacacagtaaaatgggataaatgaatagagagtatattggaagtgggattactttagatagagtgggcctctatctcaaagtgtagggaccctctgagcagatcacatctgggctgagacttgaatgataagaaggagacagctgcgtaaggatccctgaggacctccaggaagagaacagcaaatgcaaaggccctgaggcaggagcgagcttggcttgttggaggaacagcaagggccatgtatttgggacccggtgagcaaggggcagatggtaggaggtgtgcacgggccagccatgcagggcctcctgagccatgaggaggagaggcttggggtgtagatggtgtgcttatggtagatgggcacagagaaggggcctgtcctgaagtttctctgcaccttctcttctcagagaccagaaaacttcttgacaccaaacaacagcaaggctcttcctaccttggaccccaagatcctggataagaagctgagaaccatccaagagtcctggtccaaggacacagtgagctccacaatggacttgagcacgtccactccacgagaagcagaggaggaacctctggtgcctgagatgtcccatgacacagtgagtgtctctccccaggtgggaagggccggggcagtgatgaggccatgggaaggggacttgactgccatctgcaggactgcttcatgcctcaggtggccagtagacctccctccccttaggcacactctgcatgtgagttaccccaaagtcaaactgctgggcgctgtggcttcttcgtttgcagggtctcttcaccttttgagtggaactcccgtgtaatttctttcaaaacaaacccatgcaacacttgtaagccagggttccatttatgtgtgtaggcatcaactcagaacttcctgaggtgcatggccactgggtagtgggaaacacctttaagagattcattttagcttataacaggagaaactggggctcaaaaaaagaggacaccagctgggcacggtggctcacacctgtaatctcagcactttgggaggccaaggcgggcgggtcacccgaggtcgggagttcgagaccagcctgacctacatggaaaaaccccgtctctactaaaaaaatacaaaattagccagacgtggtggtgcatggctgtaattccagctactcgggaggctgaggcgggagaatcacttgaacctgggaggtggaggttgcggtgagccaagattgtgccattgcactccagcctgggcaacaagagtgaaactccatctcaaaaaataataataataataataaaagaggacaccaattctggtgacatagtctgtgtccttgatcatgggagctgctgtgttttcctgttgctggttgagcagatgctcaggaagggctggtggaggtggccaaagtgacatcctaatttgctgaggagtcagtgctgggtttcagccctcgatgcagagagctaaagaatgggctaccaaagagacagtccagggaggtgctacccagtaaccatggctgaattattgggtagcttcctcccttcttccacagcgggtcccatggggaacgctgctctggaagatcttgagaaaaggccccagacaaggccaccagtccacagggaagtccaagccatcctcctcccaggacctgacctcctccaccaacagcctcctcatcttcccctggcacttctgcacctttctggaacatgtcccatcagacgaataggaaggctggctgtctgctgggcatgcccagggttcttccacatgagcacccctgcccaccctggagcagggccatcctgctcaggcaccacagcacttatgggccatctttacaattttctcccgtcacctctggcccttggggaaagagcccttgggattaacatccagctcagtcataaactgcattgaaaataaagaaaccctgtctttggagatttggggcagcatgaataaaccacttgctcctgccctctccacatcctggcctcgtggttcccccttcttgtgcctctaagcagaggtagtaaaggaaagagaggccaggtgcatggcctgcatctgtaatctcactacttgggcaggccgaggtgggaggatcgcttgagcccagaagtttgagaccagccctggcaacataatgagatcctatctctacaaaaaattcaaaaaattagctggacttgttggtgcacgtctgtagtctcagctactcaggaacctgaggcaggaggatcacttgagcctgggaggtcaaggttgcagtgagctatgatcgtgctactgtactccagcttgggtgacagagcaacaccctgtctcaagagaaaaacaaaataaaagaaaaaacaggccaggaaagaaagaagagggaaggtgccatcatggggaaaggcacatgggaagggaagagaaagaaggcatccctccctggtctcagccctgtggagggctcagagcaacctctcctgctcagctgccccggaggggccaaccagccaaccctctgccctccccaagctaagcctccaccttcccccaaggatgcagacctcagcccctgactcacaccacctctagaagcaggaaccacaagcacctcctggctggacaagcctctcacatcagccatctgggcactgacatagcacaaccaaggagggggaagtacccagccctgctcctagtactgggcatggcaggcagtccttcgtttggagtctgctgggtaaagcatccaaggtctgaactgaggtcattaggtctgagagtctttgagagaaaccagatacagatgtcttaataccatggatttgtctgtgggaagtgagacacaaattgctggggtgggttgggttggagtctgcactgtacttataaaacttgatgatgatgatgatggtggtggtgatgatggtgatgatgatggtggaggaggagcagagaggaaaaaatagagtggaggaagaaatggcctttaaatatagaatggatctgagaggtaggcaatataaacaatgttttcaacatctgaaagaatattagaataacatgggtagagggccagtcttgattttctcttaagaattaaaccaaaagagatgggaccagattgcagcttgagaagtcaaggttagccattaggaggaagtgttttttggttttttgtttgtttgtttgttttcgagatggagtttcgctcttgttatccaggctggagtgcaatggtgcgatctcagctcaccacaacatccgcctcccgggttcaagagattctcctgcctcagtctctcaagtagctgggattacaggcattcgacaccctggctaattctgccttttttttttttttttttttttgagactgagtctcactctgtcaccagcctggagtgcagtggtaccatctcagctcattgcaacctccgcctcccgggttcaagcgattctccttcctcagcctcttgagtagctgggattacaggcgggcgccaccacgcccggctaatttttgtatttttagtagagacgggctttcactatgttggccaggatagtcccaagctcttaaccttgtgatctgcccgccttggcctcccaaagtgctgagattacagacctgagccaccacacccagccaggaggaggtgtttttgagcaacagtaaccattgtgagcgacagaggagtaggcagagaaagaagcagcctgagcatgctaggccgggattctgggaggctctgagtgataccccatacccacagactgcagaggtgttgtgagctgggtctgatggagaactcactcaagcatgcccaccctgggcatcaccctcagcactcccatcagtggctcattcacccggagagagtgttcctggtccctctaccctccctcttgctggacacctggtgaggccttaaggactggctgctagccctggtttgctatcgggttagggccactcagccaccaccatccagtccttgaactaaagaacacactgacttactcgcctctgggctccagagccctgcccaggcctggtccaagacagatgttggtaaatgctttttgggcaatggaatagagaacccctggctggacagcaagagaatcagaaagaaccttagaaagtatctagactgatcctctcattttacaaagggtggcaatgaggtggcccagggatgggcaggaatgggcctgcccaaagcttcctgacatggcaatctcatgccaccttgcatccagccaaggaaatactggacactacagaggcctgtatgctcagtcaacctggcaccatcgggtcccccagagactcatagagtatccagggcagtgggtatgcccctctcccttacccatcccactctgttccaggcacgccatccctccttgttcctgactcttgactacgtccttgtttatcctctcacctctggttcggtctcccaactcatcatttctctctctcactccctctctcactcaccttctcgctctcactctctcgctctcctcagatttaccaggctggctatttctacttctgacactttgccctagttggggcctagagacccagcccccagccccagctcctacccactggccagtgcccagaaggatcatggcaggacccagacacacatgttcacgtggccagtagatcccagttacaggcagtagaacgtgggtgagtagcaacagtgtacggctccatgacaagcacaggtagcctagctgtgtagcaatgggtcactcttccatagcaaccaaacaaaattacatagcaatggatgaactcaagcgaccatgaggcacagtgacaagcaatcgaacgtggccgcggagcagtggagtgtcgttgcataacaatagacccagccgtagaagcatgtcacacagccctgcaccgcaggagggtgcaatcacgggaatgagtacggagcacagtgtggaagacgtgggcagacatacagagtagtagcactgggacacaactgagtagcaatggcacggtcacagtgtgtgtggctcctggacatgcggccagggagcggtggccggcagcaggtcccagggctggagcagcaggcgccagcgacatggcagtggttgagttgtagtcaaatgaagaaccgcctccctcacgctgggccgttgtctccggctgagcctcttggcctcccctgatttcaggagtgtgtttgtctatatccagtctcatcatgcattccccggagcccaaaaaacaattttatctctgattcccttcagatccgacttcagcttaataggaaattgaacattttctggagagaaaagcgctctgggaatagatgagagtggagaagaggaggtctatgcctctctgtgcaatgctgcctgctgcccctggccctgcctgtcccatccccatggctcactaagcccactgtggctccctgtccctggatgtgcccttgatctacctcattcccagactgcaacccaaccatttcttctcaccttggaacacttcgttttgatgcaggcctttcaagttccatttggtcaacatggtacaaaactctggtcctgggtgggcccatcaaggtcaaggtcccatgggtatggtcttgggtcaagtgtagggcctcaggcagaggtagaggaagccttatctcccgtctgagtagctcaggaagccattgggaagaggtgagcctttaagtgagtgtgaagagtgaggtgttaaggttcatcctgaacatggcaactccccaaatagtcaacagcctgcaagcatctgccctccactctctgggcaccctgagcccatctcacacggagccaggccatgcctcctgacgccaggaggggagcaggtaaggcgagggggctctatgccacctctagatggaccgacttcctccacaaagggcttctgaaacacctgccatgtgcctggactccccattcctccagcctgtcagaaaaccagaactctccaccctgccatgtgcccagccctgtgtccagctggggcagggacatggggacaaagaggccaaggacctcagctctgagaattccccagtggacaggagcaagccatacccggggagacgattagtggcacagagtaggcacacagtaaatatttggtgggggatgaacaggcaaaggaggggcatggttgggacaatgtagctttttaactgccacacttacccagcactcctggacacacctagtgagcccttagtgaatgagagagagctggggaggtggtggatagggggagaggcaggcaaggaagtcttcctggaggaggcagactatgctttggataaagaaaggcagatgtgctcatttactatggaagaattgtgtattcagtgttgtttccagcacagaaattcaagcacagggttgcttccctcctcttcctgtctctctccctgtctctcctgctctctctcgctctctctctttttctccctcccccctctctctctccacctctctctccttctctctctctctgcctcctctgtttccctccctccttctgccttgctcagaggagatttgtggcagaccagagggccctcataccaggagatgaataattgacaagggttgttaaaagattcagtggagtttttccaacctccttacactggaataactcatttctttcattctgtttttgaaagcctttccccctccctccacctgtctcctccacatccccgccccctctgagcataccgcttttgtttctcttcctttcttgagtctgctggaccctagaatgattcggccttaatccctcggtttctctaaatccccttccccagctgtccccaccccacttgccgtgctccggaggtgtaggttgacttcagcagagacagccccagatcatgagtgcagagaggaaggaggaccagggaagctgtggcctctcccaagtcccagtgtgccagaggtgggctcggtcctcagaaaggcaagcctcccagcacagggacccctttcctcgcaggcaggcggaggggtgctctggggacgctgggtgaccatgtgccttggtttctccatcttagcatgctgcttaccctaccctacctgcctctcaggatcagatgggagaggtgaggccccccagaaagggcggctggccgtgtagcagagacaccctgagcctagtcctttctgtccggctggcatggccctggggtgaccacccatccctgtctgtccaggactgacgggtttccagactatgaggtgttcagtgcttaaaccaagacagtcctaggcaaacctggatgggggccaccctacatggcacagaaacctcccctgtcccaggtctgccccactggaggttgccacactctctaccctgtcagcctccctcatccacagggcatactccccctgcccagtctggcccagctccgtgctgtccatgcactcatagtgctcccactgctcctgcaagtgaccttgaccttccttcccttctctgggccccagttcctgcctctgacagcacaggcggttggagcagatgttcctgagtgccctgaggctcctgcactgtggctgcagccttggtcctgcccccagacccacacccaggatggggtctgcagcctggtgaggccgacagcagagcagtcagacccggcctccactcctcagcaccacctggtggcaggtgattaactctgagcaggagtcttttgaggctgccagcagcagtcaccagggaagggacttggagcacccctgcacactacccactttggtggcaacaagcagcaggaacgtcagcctagggtggtgacattgcaaagccccgggagcctgggattggcccccaggagcaggaataagcagcccccccagggccactagttcaggcaccaagcccagcctgggagcagggtcacccagggtctgggagtacgagagggcccaggccccaggtcctttggaaccaagagaggctgaggaactacaagagaaacagggagtgagacagagacagagagcagagccaaccagggcccacccaacggcctccaaacagatgcccttgactcagtgtccccttcaggccatcccacaccagccacaagacacgttcccaaaacactggccaccccagccttcctgctgtgtcccctcagtctccgtagcccctgactctactgcccagcgtgattgccccatttgctgggtttgtgctctctcccagtcacctctccaagcatccctgttctgtgcagcacacactcacgagctcccgcccaggcccagctccccgaaggcaggaaggcttctcagggccccagccctcctcagctcctcccctgcactcctgcaggccccgagctgggagcaccgcctgctgacaggggctggagggggtcctacaattaaatacttaagacaaggcaaccgacctaagccatggctgagaacactcgccagctcttttccctttcctgtccctcccccaactctgacctttttctctccaattcctaaacacaatcacacacagtgcttaccaagcattttagcgaggaagggagggagggagaggagaagggtagaaaggaagaaataaggatcacatcccacatgtgtctgttacttccctctgcagacccctcctctcacctgcatagctcttgcaggtttgtgttccatctccaccactccgaagctgtgtgaccttggataaatcactccacctctctgctcctgtctcctcattgttaagtagagggaacactgtcaccctgtccacctcttgagactatggggaggattaacaagagaatgaggggcaatgtgttggaaactgtaaagggctgtccactttgcaggagacttaatagtcactgtgttcctggggccctgcgatcaaggcggagaataaaaaggaagcaaaaatcccccaggcctctccctctgaccctttctccggcagggctgttcccagacccctgacccacttctcctccctccttcccccatccctccgagtctcagcgggccattctcctcctccatccatcacctgagactaaagagattaataaacgagactcataactcagctgctgggatgcagcagatatttacggctccgtttcaatttgcagagagattaagtgtttgtcgatttattgtctcttggtgtgtgcaagcggctgagcaaggccccctgcaggccagtcccctcccccactccacacgccctgcacatgtgtgtgggtgcctcgcctcccacccccagcccccagccctggagctggcggggagcctggtgctgctctgccaggcaaagctatgagccagtccggtgggcctgtcttcctgaccgacttggccaggtacctaagctgatttagagggcccactcacactcctccagccttgtccctccccacctggctaggtaaatgtgccccagatcccaagctccacgcttctagaacactctgtcggtacccaagacccccgaatgggcctgaacctgcttctgcttcttcttcttctttttttttttttagacagagtcttgctctgtcacccaggagggagtagtgcaatggcgtgatctcaactcactgcaacctccgcctcccaggttcaagtgattcttctgtttcagcctcccaagtagctgggattacagacacctgccaccatgcccagctaacttttgtatttttagtagagacaaggtttcaccatgttggtgaggctggtctcaaactcctgacctcaagtgatccacccgcctcgccctcccaaagtgctgggattacaggcgtgagccaccacgcctggcctaaacctgcttctgaggactatgcaagcttaaatctacacttctaagggttgaatacttttgcaagggtgcaccctgagacccaagaagcaacggctgtttgcagagggcacatgctggaagcctccatttctgttcttgtactgggcactacagatattaggggtgggcctggagaggggaggcttccatagagaaagccccccagcctaactggggagaagtctgcaaaggccaagggaagtgagacagcatgaaaaggagcatcacccaggggctaagggggaagtactcaaaccccaaggatgagcagtgcttcaggagccaagaaggggccacatgagcacagggagcaaaagtgtctggtgcccccaacctcctcagacccccagctgtctctcctttccctgttgactttgtattctggcacaggcacctactcattcattcatttctggtacatgcacctactcattcattcatgcattcattcatttgttcgaccagggttttgagcatctactctgtgccaagtctggttatctcgccccacagattcctccactcatttgtgcagccccagcaggtatgagttccatttccacctcccaagagctgtgtggccttgaaaaaatcactcaacctctctgatcctgtctcttcattgttaagtagaggaaatactctccccgcctcttgaggcttttcagaggactaacaggagagtggatggcaatgcactggaaactgtaaagggccgtccactttggcactttgcaggaggcttattaatagtcgttgtgttcatgggatccctcgagactgagggggatgacggaaggcagcacaactcacccaggcctctccctctgaccccctctccagaagttcacctccaagatatgtgacagtcacataaagataattccgtacaagggtccctgtgctcaagaagtcccaattgagcagggagacacatcaagaatggctggaggaggatgtggtcaggactggggctcagggtcctcaggagattgtgggagcacagagggggtctacctaatcctaacccccatcaactcccaccccaggcagtgcacactttctacagaatgccagggtagtctgcagatgtcactgtgataagcaagagagaaaagccaaccaagcatcagtggcggttagcatgaaaccataacagatctttgatttgttggtggaagggaaatgaaattcctcttgttcctgcaagaggaatctgttgatctgttgagtgggaattactagttagtgtgtgtgtgcctgtctctctccaggcctggcctggggtctcaccaaaaggcactgtggggccccagggctagtcccttccctgtctggacctcagtttctctatctgtattaatggagcgaatgcctccctccagtgagggatgagaaagtcttagcggtgtggaggaaagaatggatgggataggtggactagaggactggtcaagtcagggcctgccctaagtacccagaagatcaggctcagaggagatgagaacgaggtcactccgggcagaggccacccagagagagagaaaatttactgccgagagagggttgggcaggaggagcatcaggagacatggagtcagttctgacttgaggagtcagcctgactgacccctcccctcctgggcctccgtctcccctcctgtggagtgaggagcctggtcttgacaatttcctctttcatcccagcaaacaaggcaggcagaggtgggacagcctcctggcgctgctccttagtgagatggccggtgctgccaggtcttgctgtccatccttaattaaatggtgggtgggcgaggcaggagtggagcactctcggtaactaaagccaagatgatgaggccataaattgctgagggcttgaatcatcgattggtgagggtgaggtggactatagaaccaggagcgactgggagaaagagttgctaacctgggaaatggggcttgtcccttctgtgctctgcaagcaccagcccaaccttagtactcattttaataacactaagtgttcccatcaagattcactgagctcgtactctgtacccagaacttcggtcacaatctcatgtaatcctcactccagactgaaaaggaacatacaattatcatccccactttgtgggagaggaacctgctgatagcacaataaccctcccagggccaccagacaagaccgagggggagtcttggtccaacacaggttgggggtctccagcctagcacttgagccttggccgagcctggtgacttggaagtcaggagcctggtgagcttaactcaccatcttcccagcctatctgggaggaagagctgcctcagtttcctagtaaacaccaagacaagctctgtggcctcaggccaccccctgccgagttccacctggaacatttgagagtataagcaaggcctacataccatatgtccaaaccccagtaatcaaaatataaatcaagcagaagctagcaaactcctaaatatgttccattcctctacctcaataaatacaccttatgaacaacctcaaagaattctcagcttccacactggcccctggcagtatggcgagagccactcccaggcccccacccctcaaccccacccatccccttttcttctcacacagctcaatttcagtcccacacctatgagactctgtgggctctctcgagtgcataagggtatactgccaccttcaggaggacaggccctggaagcaggggagtgccaggatcccagttacccagggtgaggtctaaagcgggcacgggctctaggtgggcacgtcccccttgggaccactgactcctcaccccatgggaagggttgtaccccgaagagggccaaagcaggacctttcaacccacggggcccagggctggagcccctcttgtccagggctaaaggcagaactgtccctcccccaaccctcaccactagcttggtgactctatcagggtgcactcctgagttcagattaaatgtttttcagtacaatccaatttcttcctgacacacggactagaaaagcccagtccatgtgtgcagacagacagacacacacacacacacacacacacacacatttggtgctaaatatccaatcaagtccgcagataatagagaccagccagttcactcccagtttaatcagataaaatgctcattcatcggctcctgccagagctgccgtcccctccttagggcggagtcgagggggcggggagggcctgtgggggaaggggctgagacccgagtggcttgagcatgtgggctgcgcctttaaatcttcaaggaggggggacagcgttgcccacgggggactaattatccttcagcctttagccagctcttactcaaacagacaaaagggggctcagcatctctggtggcactaagcctctgcagcagaatttttttcactctcagatatgcaaatccacctccacagggtggaccctggggttgggctgcagaggggctcggggatttggaagggccaggaagagcaatgacagctggaccctctcagaggactagtttgggactggaggcatctcactcttcctcctcaggctgggtagggagccattcagtagggagctgccacgctggtagggagggtcctgtggaggccaagatgaagacctcaccctcctgccttctcctgtatgtgggtgggggggctcctgtggagggccagtgggctcactcagagagctggctcaggatctgggagctgaccgtccagatggggccctcctgcctacctcagccttcctcctcctaagacacagccaccaggtgacctgtcccaagcccaaatctagacatgctaccccccgccctgaacccatgcattgttcccttgcctgcaacaggagcccctcagcctgatgggccctggggcttctgaagcccctgcctcaagcctttacctgaacccagaatattctacccatgctcaatggcagtggtgcctcctcccagctccaggcctgtgttcccggctcactccaccttgtacccctcgcccacctccacaccaggtgcctggcgtgcagtgggtgctcagtaagtgtgtgctcactgaatgcacagaatgcccttcctgagcagcttggtggaccaggggtggtctggatcacagaggtgtttacctcctactcggctcccagccagcacctacaggaacctcagtctctttagctgggaaagggggacagtgctagcccttatccccaggctggctgtgaaaacctcacagtgcctggagcggcttctgtgagccatgaagagcttctggcgcctttttttcctacagtggggagtgaagagtacagtgtaggagagtgcagagggtctgggaacaagcttccatctctctcggtccctccaagacccacatcttacaccactattggccactccttcagggaatctatttatccactacaaatggatctgtgccccacccgttccagaccccccaagtcctccaccagccatctcaacagaacagcctggactttaagtatgaggggaacttaaaaactctgggagaagctagcgcagtggctcacacctgtaatcccagcactttgggaggctgaggcaggaggatcacttgagaccaggagcttgagaccagcctaggtaacatagcgagatgccgtctccacaaaatttttttaaaaaattaaccaagcatggtgacacgtgcctgtaatactagctacttgggagactgaggtgggagaattgcttgagcctaagaggttgaggctgcgggcagtgagccatgtgcccgccactgcactccagcccggatgacagagtgagaacctgactcaaacaaaataaaaacaaaaacaactctgggaagatggttaggaggcaggactggagatgtgcttggtgcagaaggtctggctaatcagaatttgaattctgaggccgggcacaatggctcatgcctgtaatcccagcactttggaaggccgaggcgggcagatcacgaggtcaagagattgagaccatcctgaacaacatggtgaaaccccgtttctactaaaaatacaaaaatcagctgagcgtgatggtgcatgcctgtaatcccagctacttgagaggctgaagcaggaaaatagcttgaacccaggagacagaggttgcagtgagccgagatcaagccactgcactctagcctgggcgacagaggagactccatctcaaaaaaaaaaaaaaaaaagaaatttgaattttgagaccgactctgaggggcctgaggtggtcagggggcatcctgagagagccagcagggagggtacccgccagcagcgagagtgctgcccccaggaagccccctcccttcattgccacctgcatctgtgaggtctgggccctggatttccattacctgagcagtgggcaaggctgagcaggctgtagagaaggttcccatgggggactctcagggatggggagagtgaggtgtgagaggaactgaggccaaaagaggctgggtgacaggcaggggaggtggggggctctgaaaggaccaactgccttgaggctcaagcctcaagaggcaaagctgaacacagggattactggggttttgatggctgaagcactttgtgaagctctggggtggcctggagcctggcagcagtgaggtggttttccgcaacacagggctggggaggaggcttgtggcctaggctggaggcaggaccgtgatctgcctggacagggcgcacggggcctgtagcacaggcctggaggcaggacgggtggtctcaccccacctctgctctcctgtgacactgagctcccatcaccctggtcccttcccctacccatggtccctcccaaggctaaagatggtctaggcctccttggatcccccaagagccccaaatgtccagacagggctccttcccccagggagagatgtggcaggtgcccccagcatctctcccctccacaccccctaccccagtgtgttctctcctggcctgggtgaggacaacaaatgggacacagtgggcacatgcttcgcaaaaataatgagagggaagaatgtgaaaatgagagcctaggattcaggcctggagagcacagtcatctaaacagacgaggctctaatagcaggatctcaacccctccagctgaaaacgaccaggaacacacatgcagtttaacaaagttggagttattctgggtttattgactcgttgtagtaagggggatgcaaccatgggagttgcggggcatcccagaaagagtgtgtgggaaaggacttcacagattcaagctggtgttaggggatttgggaaagggtttgaggaaacaggctttgctctgggttagatgacagcgggaggctggcttagaatcagcattctaagagtcggtatcataggagttctcatcgagaaggcaggaatgatggtcactaataaagaagcagcagtcactcatattagccaggaaagggagtttggtcatttttgtggtttggacaatgactatgttttatctgtgttcacacactttacagagtggtcagagagtggtgttgtgaatgacaccagggtccagctgtggccgccagctcctggccaccaggggccgcttttctttcttggtagcttcagacagtgaccgagaagagatgaaagggacagatgttactcacacagcacatgccaggcactgtgctcaacactagacagaccttgctcacgtaatcttcaccacagccctctcctcattgtacagatgaggaaactgaggttcagagagggaaggtgcccatcagagtccagaaggactggcaaaactagaatgtaaacccagcttatgttccccttgttccaaagtccctttcacccccttgcccttgcctagaggctgagcctctgctcgttcctcggagccacgtggtcctgaatagtgtcccttggacacccccgctaggcacatcttcctgaaggggttcagcctgtccatggcaggccagccgcagtgtcagcagccgccccagcccaggagggtcccccgtgcctagaggtgtgaagggtaatgaggccccgtaattaaggtttctgaagacatggctgggagatttatagacaggctttgtcaataattgtgctaccggctgcagatccagcgagacatcggtaagtgctcgttacagcttctccctgctccctgccctgcccccgcaccacccctcctgagccatcagcctgcctgttcacagcgcctatgtacacaggcttcgctcaattaatttgcacttgttggcgccatctgttcttttcatgtgtccttatcaggagtgtgtgcgtcctgcctcctgctcagatgtgacagtgcaaccctcctcatacatataggggcttcctgggcaggctcacatctcccctctcagactgggctcctcagggtgggacactgtctcccccctcagtctaggacccctgaaggcaaggccaagtcttcatcttccttcacctccccctcaacacccacagcctctctctgctgagccaagcttggcctggaccctagcaaaaccttctgagtctgaccccaccaggcagggcctcagccctccagaggaagcccccagaccccaaaccaaacaatgccctggaaggctggctgcctctgggtgctgggaggtagggtgtttgttctgatccccactctggctcccatagcctgagctttggcaggttcttgttacgagaacagtgacatctttgagtcacaggggtgggaaggggctaagaagccacttggaagtctctgtttcccttgagcagcattggttaagggtggtacaggggccaaggcttggacagctcctagagtggggtgggtcatggcctggtggctccaggatgccagggcaggtggcccacccagataactgagaaaaggcagcacctcaaggatgctttcccttggctctctccccatcccgaggttttgggcagccaacatcccagcctactcttctctgggtcattctgtcttccagaaggcctctcagtcccttccaaccccagcacagatttctttctttctttctttctttttttttttttttttttttgagacagagtctcactctgtcatccaggctggagtacagtggcgcgatctcagctcactgcaacctccgcctccccgggttcaagcgattctcctgcctcagcctcccaagtgtctgggattactggtgctggccgcgatgctccgctaatttttatgtttttggtagagacggggtttcgccatattggccaggatggtctcgaacacctgacctcaggtgattagcccagcacagatttctaaccccggagggctatgaatgctgagctggccctgccacagaagtgctaggcaacttcttaccctgtctgggctctgggtcctgcatagcacattggatttgtttagaatgcaaccagaccttattctgggagggtcacaagcatgcttggtgccagcatccaggcccagcccagtccactttgcctgcctataacaggcttgacagctgggccttggacttacatccaaggtcccatgactgaaccctgcagccgctccagtctcatctcctaccagcccctccttgccgcgtgtcctgtctgcactcccacggtgttccaggctgctgctcacctccacacctgtgctcctgctgttccctgtgctaggactgtgtctcctccttatgcctgtatcacctgacaaactcctactcatccttcaaaacccatctcccgctctgacataccctccaatacacccttgcctgcaccccagggtgaggagggggctggctggggggctcccccgctactgcatttgccatactgatttactatgccacactgcctgctctcacatcgactagaatacaagctacttggggacagagaccccaagccttggccacatctgtgtctccagtgcccaccacagggcctggccaagtgggcctgccaaagagtatatcctgaactgggaggacctcagtccttggcctgggtgggggaaaggcagtgctcacccctcccctagagatggaaggagacacactcttgccaccctggctgcccacttatagggtcatggcgacctcaaggcagacagtggattcagttagggcaaaatgcaaacacacatttcaggggtggggggcacagagcagggggctttaaccaagctctctgcccaccctccccctgccagccccctagtctggacccatcccagggcccctctgtgaacatcactggcatcatgacgagccctttcctgcagacagctccaagctgtggtggagcacctggggtggggatttgggggttaggaggggtacagttccatttgtatttcaggcccagcagcattcctgccaggagagagttttagaaatggaaatggagggctgtgttccctcagcacatgtcccgcctccgggagctggcatctctgctctcacatggcccatgtgcaggggcacagaaccccaggtgccaacgagccccctcctaggctgcagcagaagcccacagccaggcagggcccagagaagtctgacagcctgccaaaagcaacagcaaaaaccacctcagcccaggagcctcccatcccccacccccgtgtgtctgatgcggtggttttattgcgggcagtgagggcattcatgacagcctcagaatgtatgagccagacctggagccagcaggggtaaggggagcagagcaactgtgcgactccaggagatgggatgtgggctcagtggaggccgttgcaggggaccagggaggcatctggaccttctggctaggccagcttcaagctcgagttgcggggaggcctctcctaccagcagctaagcatggctatcaacatcctgcgtgccccaccctgagttcagctgagcctctggccctgcaatagggagatcccagccctgatgagtgatgaagcatgagccctgcccttgcggactccaaggccaaggccagttgaggacaggagagccagccccagggtccggagtggtggtgaagactctggaaccagctcacccactccaagaacttccctagcctcctcatacctcactctcctcctctgtggaatggacatggagaaggctacttcatcaggtgactggtggtgaagttaggccgatctatttaaggtagttagaacagtgcccagcctatggtgagctcttgttacctgcctggtgcaggctctagaaattcagaaaggaagccaagaagagtaggaaagtcttttgttaggaggtgggctttgcagaatggatctgcagagatgggggaaggcgactctgtcctgtaggtgggggaactgcgtgagcaaaggcacagaggccggatgcactgaacctgtttgttcccccagaggttctgaggccacaggaagtggctggcgtgggagtggctggtccaaggggagctgcactattaagtgtggagggggagggggacaggagcaggaccacagggaccttgaccgccaagctgggggaaggaagtgtgaataaagccccaatgccaccaggcatctctgtactgccctcctctccctccccactccagccaggcacctgccctgtttcctgggaccccctgaaggaggacatcccttagctccacaaagagccctgccctagtcttcacatagtaattgtcttgtgtgtctcacccagtgataaggggtgggcaaggggcaggggtgggggctcttgagcacccgttttatagatgaaatgcctgagaccaggcgggagcccctggggcctccctggcttcatggggcaggctcaagtccctcaagggcgcggcttccctccctctcagcagcccacacttgttctatgtccggtgatgggtccctgagggtccgctggggcgcccctccagcctcccgccagagcagggctggaagactgccatgtctggggccaggctgagctcagtgcatgcctctgcgtagtgcattattgatggggcttctaattgtgcgtttcccaaagtctacaggcttttgatgaaaaattcatggcacgcccgaggatgggagcagactcaatcgattggcgcacagcaggcaggggaggacagggccccttgcagggaggggtggtgaagcctggtctgggaggcttcttgccccaggatcttggggatagcagggggcacacacccatttccctggtggggaggctgaggggcaggagcaggaagatttaaggcccacatctcagtgccagccagtgactggtgccatccagggaggatggccgactccaccacgggcctccctttcatttccctggaggggtgctagaccctccagagcccctcatgagagttgcacagaggagggagtaatatttctggagccactcttatatgccagacgctgctcggacgtgtacactcgcagcctcatttaatccccaacagcgttatgagatgggcacagtgatgcactccattttacagaggagaaaacaggcttagagaggttaagtgacctgtccaaagtcacacagctgcttagtaacagagcccactatctttccacttcaccaggcccactcaaataagaactaataggagtatggggattgtcttgtgccactcccctacttgtccctattgttcagaggaagtgtccccattaagaaaaagtggagtgggccaggtgcagtggctcatgcctgtaatcccagcattttgggaggctgaggcaggtggatcacgaggtcaggagatcgagagcatcctggctaacacggtgaaacccagtctctactaaaaaaatacaagaaattagccaggcatggtggcaggcacctgtagtcccagctactcgggaggctgaggcaggagaatggcatgaacccgggaggcggagcttgcagtgagcccagatcgcgccactgtactccagcctgggagacagagcaagagacagagccagactccatttcaaaaaaaggaaaaaagaaaaagagtaagtgaaacatgaggcctgcaaatgagaaaaggaagcgccctccacaacaccggcagaagccagaggccccccaaccctgtgcagagtgctgagctgggcacccagcagcaggggtggagattttgaaacgggtagaggtgactgtcttggcttgtccagtcagggattattattgtgccaccattgaggccccaaagaacactgtaagtcatctattcattcattaaacaagtaaacaaatatttatgaagtcccagtgctggtcagcatcttgctaggtccaggtggagggccctatcatgaaagcctttgggaccaagcttgtctgggacagacaggctgaacccagttcagctggggaaaggcaggcaggcccctccatgccccaggagggggtctccgcaacccaggctgaagccagttatatcagacattctgccttcatgaccagggccgtttctaggtggcgggctggcttgtttgggtttgtttttttttttttttttttttttgcttcccagtgagtttctttcaaaaacatccacccatgtctccgctgaactaaagagaaaggaatttgtccagagcatcaggaaagcagccagaggaagtccccagggaccaggcgtggggccctaagccacactgcagctgcagggaggagagtgagcccagcttgtgctgctgcggggtggggaggactcctgaggggacaagggggaatcagggagcagagagactaagggggagggggaggaggagactcagggacagagggtgaggctcagtgggagagaaaggggagacagggtatgggggtaaccaggaggcagagaaagtggagaagagcggagggagttgagggggaggcaggaaccaaggtgtagccaagggcaggtgagggaggagggactctgagcctgggccaggggagtcagaaggccggagccctgaagggccccacagccctccccggccctgctgtctccatacaattctgtggccaaggagtgaaccttgcatgatttcagccaccccacccagacaccccccaccctggaacaaaggggaagtggccccatgggcctgcctgcttccagctcagggctgggcttggtcaccaggcaggcacttgttgtagcaacagtccctggggacccatcctggggaacaggactgctagcagtaaagatgggggagccagggcccccatcccctccagcccccaaggctgccccaggcctcattgacagcttctctgtaagtcgccccctcgcccactggttctgggaagatgggttggctcgcctagcagcaggtgtgttggggtgtgttgcccagcaaccagtagaggtgttcccagagcctcttaagtgggaggcagggtggagaggaccagggctttggcccttagatgcccgtggtcacaggaatcttttgcaaggcccctggctccagcctaggccacctgagcccacacagtaatccagagagggaggacagaagggcttctgggaaaatcccttgaagtgatcattgcctcctgctagtctgggccctacctctggtgtcttggaggtccagccttggatcctagaaagtggctgagcctgggctagcctgggaaggcttgctggtagtgcatgtgtggtgccgagctgtgaggaggagtgggtgtggcagatggggcatccagtggaagcagcagctcagactgggggctggggccgccccagtaagtgctaacccttctggtttgggccccagttgccaaagcatttcttcttcccctttggcaagaatcccagaggacaaccccaacaagggtcattccccacagggtgcagatgagcaggcacggagtgggcaagggcctcgcttcgggtcgttcgacagctgtgggcagaggctggatcagaacccaaggttctgggttccagccagggctcttcccccacccaatgtggggcattcctgaggcagcaaagctctaaccagggaggattctggcaggaggtgaccagtggggaagggttctttgaggaagagtgaacagggcctgtgagaccaggactggggcctgcccctcaccacctgctgaatgcccagccctgtactcacctgggctgagagcaagggctggccccaatctgctgtcagcagaggctggactctggcccaatacccaaggagtcatgactgatggcctgtcttgggatagcccgggggtcttcctggaggaggagggcccagaatggagccttgagggtcaggcagcgttcagaaaagcctaggaggggaagtaggaatgggaagccagcatcttccaggaagccccgcccccaccccagcccagccggtctccattgtcccagccaggcccaattagcacctggctcctgcaggggccaattagacaggggctgaggtcagctgccggccaaggccctgccacccctccaagcttcaccaagccaagcacaaaagctttctaggcatcatctctgctgcagcaggaagggaaagaaagaacagaagaaagggaaaattcactccttttgtttctttgccataaccttgggctgaacaaagaagcaactgcctcccctccctgggagggcagcttctgtggagcaggaagtctgttttaaacagcaatttgcacagatttgttgtggttgggaggcccagatgacattcgaggggaaccaggagcagagacctggggtgagcagggccctggttctagaaactcctgtgactccccactgcgctctgttcagaagcagagcttccgggcctggctggtgcaaacaggtgggcctgctccagctctctagccagacagacctgtgtactttgctgcctccaaagagcccagcccacatgggcctccacaccttccctcagtgttccccacctctgaagtcccacccaatccagtcaaatctcacctgcacctcaaaggcccagctccacccctcccctgcaggatcccctccccaaccctacccctggccttgacttgcactcctagggtgtgagccatgtcccacacaaggcctgcctcccaccgggaactctctgagtgcagggtctccccacccccaacagagctgagcttaggggtacaaacagcagctgccaggccctgctggggagcaggtggaagggagatatatgccagagtccaaaatggggtttgggaagctggggccaccctggggtggtgacaggtggagaaggggacccaccagtgccattgcctcctccaggctcccacccccagggcaatgccacatcgcacagaccaccctgccctcacctccctaaccctgccctctgtgtctcaggagcgcagcctctcccactgggctatgcccttgccgcttcgatatcccacccagccaatgaggctctcagtcctccctcgcctgccctctggtggtgatgaggttccagagtgaatggagggaaagaaagaagcttgtcctcatggccagtgggttctattgtccttcagtggctgggaagggagcttggctgggtgggcagtggcaaagaactgagaggccagggtcccagtggcattggcccgtgtgtttctgggagtaaggggacttcttagccatggtgagccccaacccctgggaaaacactagtccctttcagcaaattttcaggcacaacctccatcctccccgacttgtccctgagacggcccctcagaactgggcttttgctccctggtctctggaactggaggaggccagcatcaatttgccagctgaattttccattgtattttaaagaaatgtggttaattcgctttattttattttatcttattttatttatttatttatttttgagatggagtcttgctctgttgcccaggctggagttcagaggcacgatctcagctcagtgcaacctccgccccacccccgcctgccccccagttcaagcgattctcccacctcatcctcccaagtagctgggattacaggcatccaccaccatgcctggctaatttttgtatttttagtagagatggggtttcaccatgttggccaggctggtctcaaactgctgacctcaggtgatccacctcccttagcctcccaaagtgctgagattacaggcatgagccactgtgcccggtgtactttttgtatttttagtagagagggggtttcactgtgttggctaggctggtcttgaactcctgaccgtgagtgatccgcccccctcggctcccaaagtgctgggattacaggcgtgaaccaccgcaccgggccaagaaatgtggttaattccctttaaaagtattgggaaatttagattagccaagagagacctctctgacattcaaaggacacctacaggagttctgtttggcaaatctggcaggagcagggtctgggtcaaaggatttgcctgagtaagtcagggaggcagggaggcccttccctgccatcaaggtctttaggagctgaagggggagcatgtgcgtggcccttggcagatgaggagtgccaggctggtgtaggcgagaaacagcttctgggcagaggtagggaaggctttgaagataggggcccagaaggctgggcccatgggtggagtggccagggctaaattctgaaagggggtctagctgtgctgaaagaggtggaaattcaaagttggaaatttaccatgagggccagtgggagtcattggaggggtctggaggccagagaggatgttccagttacctattgcaataacaaactaccccaaaatgttatcatttaaaacgataattttttcttttattatcacatctcatagctttgtgggtcaggaactcagccacggcacagcaggtctaagtcctcagctgggacgacctacgggcaggggcgggagcagccagggctgggtgggcctcgctctctcccatacacttagtttgggcttcctcacagtctcagggcagcaaggaattagcagctagcagggaagaattggggttactgcaagatgggtctcatcccaagcccctgtcctcaccactcagccccaacatcttccctggagctaacccaggatagaggccccaggttcaagattcactgagtgacttcaggcaaatctctgcacctctctggtcccaatatcagaacttgtgagatgggggttccagggctagaggtcttggaaggctggctggaccacctggaggaaggacatgtgctcctggaactggggagagagacagctccgcacacaccttccccacaatatgagctgtgggccactcaggttggcctcatcccaccacaggctgaagctgagtgtctgtgggaggcggctgccctctgctgactgcaaaggcaaaccacatgcagatggcctgggcctgccagcgatggatcctggggatccggggaaccctgagattgggtggccgcccaaggaaggggacagaggagagggtgtgtgcctggtccagcaaacccaccctctgcacccacttcaacactagccagactgccacccacactacctcagacccagcaacctgtctcaggcctccttctctgggagagtgaagcccctccccgctcctacccctgctccagcccatacctcccctatgcatccctccctcttaccttctaagtctccaggaaatcctctctctccaccactatgcctctccttgaccctgttttcctagctacctttgacccttctcaacctcactgtcccctcagaccttacccacagcacccagcattcagagcactggccaaggtcacttcctccaggccacaccaagaggctccctctgcagatccggaaactgctaagccttctctcctttttccaaaattcttttaaattgtgaaatgtaacccatttcacaatttaagaaaaattgcattgaacatatagaacataattattataaattattatatagcaaatgtccatgaaaccaccacccaggtcaggaaacagcatcaccagcatcctcacgcccctcatgcccctcccagccacacccctcctctcctggatgtaatcactctgccagctttctgtccttgctttgcttctttatttttttattttttaattattttttttatttttgggacacagtcttgctctatcacccaggctgaagtgcagtggcataatctcagctcactgcaacctccgcctcccgggttcaagtgattctcaggcctcggcctgccaagtagctgggattacaggcacccgccaccacgcccggctattttttgggcttttgtgtagaaatggggtttcaccatgttagtcaggctggtctcaagcttctgacctggagtgacctgcctgcctcagcctcccaaagtgctgggattaaagggttaagctgccggttggttcacgcctgtaatcccagcactttgggaggccaaggtgggcggatcatgaggtcaggagttcgagactagcctgaccaacatggtgaaaccccgtctctactaaaaatacaaaaaaaattagcccggcatagtggcaggcgcctgtaatcccagctactcaggaggctgaggcaggagaattgcctgaacccgggaggcggttacagtgagccaagatcacaccactgcactccagcctaggcaatagaaagagactccatctcaaaaaaaaaaaaaaaaaaaaaaagtgtgagccactgtgcctgacctgctttgcttctttatactgtcgctacctgagcatgcctctcgaatcactctggcctaaattttctatttttaccttcatggagagggcaccgtgacatacacattgctttgcacacggctcttttgctcaccttgatgtatgtgaggttcacccacatcatggtttcttattgctctgaagtatcccgctgtatgggtctccacctgcccctatctctgccccataattcctcactcacttgccagttctttaatgtttttatgaaggtgagttttgctttgtgtcccattcagaccatctctagcggcgggttcatctccatcatccaagccgcaagactcaagcggaaggtggttgtcctccttttgaagccctcttgccagcctgctctcgccgcttttcctcctacctctctggcaattgcgctagtcctgagagctcctctcctaccaccccttgtccttgaaccccctcctcactccacagttgccagacgctgaaaatctgctcccttcccaaggctccaatggaaccagggctgtcctgccacctgtcccccaccaggattcactccaggcttgatcaccatcagccactgctggcctcctgcacctgaggccctgcaggtacctcacccctaacacgctcctcccccaacccagctccccctccttcccactccagacctgcgcctcctccacccaaagaccccagctcctcctctcctcatcccccacctcctccttctcccctcttcctccttcccactccaggcatgcacctctaccaaaaggccccagacttctcccactcctccccctcctcccccacctcctcctcctccacactacaggcatgcacctcctccacccaaagaccctagccccctgccaacctcctgctctgccatccccaaccctcctcttcgttgttcacttcactctgtcatgctgagtcctccttggtctgcctccacccagcaagggtccctggctccctgctctgggcctccattcatttctctgtccatcttggtggcctgaggcatcttgccacaaaccccctccagcttaggcccttcactggcctgcaggatggaatccaagctcctgagattggccacacccctacttactccccaaccagcactctgccctccaggaagtcaccgactttgttcctgatcatacactctctctcctccctgcctttgccacagtgtctcctctgcccaagagccctctcccctaccccgggtaacacctgctcaccctcctagagtgagctcaggctatcaccacctccaggaaggcttcctagacctggggctaggaaaagagactcctgtaagctctcctctgtcacagatgtcactgccatctccttggtgtagatgggagaccatcacaagcagggacggtctgggctggtctgggctccatggccccagtgtggacatggccttcagcaactgctgatgactgtgctgcttccaatgtagcctttacactgagtctctgtgaccttgggaacactacttccaatctcagcttccccattttacaatgagtttataaggaccctaagtagccacaggtgtcattggatgcagtgcctcagattctgccagaagcacttcttatttttttgcggggggtgggtaagggttaagcattaccctctttaggcctcctgcacccaaggccctgcaggtaccttacccccaacacaccctccctaacccagctcctccttctccccactcccagcataaaaacaaagacaatcgccattcctcctccttcgtgggaactggtcctcagtttctatacaatgaaagtagtcacatcatcatatcttctgtgcccactgcccagggttataataagaaccattaaaagtgcgacggcaggcagaatggctcatgcctataatcccagcactttgggaggtcaaggtaggaggatctcttgaggctaggagttcaagaccagcctgggcaacatagcaaggccccatctttacaaaaaatttaaaaattagccaggcatggtggcacacacctgtagtcccagctacttgggaggctgagtcaggaggaccacttgagcccagaagttcgaggttgcagtgagctatgatcatgccactgcactctagcctgggtgacagagtaagtctccatcttggaaaacaagaaagcactcagaaggtggtggaggaaaaagagatgctgttgccaggcaccctgtgtgccagagcctgggctggcactgttcatgccccctctctctccacagcaaccccccttggggtggggtgattttcccattccacggatgaggacgctaaggctcagagaacagcctcccttccagagccaaagcgaaggtgtcggtgcagcaaaggccaccagcgctcagtggcagtggggcaattcaaacccaaggacacctgacatttctcacctgggcaggatctgatagctgggtcttggatggggaaagcgcagtgtcaatgggtgaggagaatgcagtgggcactagccttaggcacaatggctttggagtcagtccttctagaggaggctaagcctagggacaagacagggaagtggctggtgcctgaccctcccccagcagactggaaagtggggagggggctggaggggagggattggagcaggggagtcagcaggaccacaacaggaatctgggccatggtgtccttcctgttctcaaggctgggctgtgacgcagagcatggccctgggggttggggaggcccagctccaggctgtagggagtggtcagggctgctcatctgcaggcagtgtcctcccagaccagctgtgctgctcaaggtcactgctgtgcgggtgggggaagccgaggagggaaagcaggtccttcagtttcccacagatgtagagggaagagagcatacagactgaggggtaagccagggccgagatccctctccatgccctgggggagccctctctctcagagagcagccaggcttggtgggggagggggataggcacctgtggaggcctataggactagtctccgaggagtggagtccagcagggaccgtctgactgagacagggacgcggcctcaccagaagccatgctctccctccatctccttcctcgctctgggccccagctttctttgtctgtcaaagcgaggtgttaataacagagctctgggccaggtgcggtggctcattcctctaatctcagcactttgggaggctgaggcgggcagattacctgaggtcaggagttcgagactagcctgaccaacatggtgaaactccatctctactaaaaagacaaaaattagctgggcgtggtggtgcacgcctgtagtcccagctacttgggaggctgaggccagagaatggcttgaacctgggaggcagagtttgcagagagccaagattgtgccactgcactccagcctgggtgatggagtgagactccgtcacaaaacaaaaataaaaataacagagctctgctcatgccccaaaacagctgagttggagaacaggagggtcttagaaaaaatgaccctctgaatgagaagagggggtgatcagacccatggggtgggctgaggaactggcagccccctcccccaggactcactccatgagcatgctcacaacccggttatggacaggatcgtattaatttgccacatgcactttcctttcacaatagagcgtggccatctctgtgtgtcagtataataaaatctgggtcatcctttgtgaccacagcctgtggtgcagagactgagcatgccctcatataagaccacaagctgtgctgcagtgagcatccctgcatgcattttcctggatgtgtgtgtgcgtgtttcgctggaagccaagaaaacccatttggatgctgctgtaattgtccagggcagatatgctaagagcttgaaccaggctgggcaaagaaagaaggggccaaatttcctttgccaaaatatcgtgtgcttcctttggtcagtcccccatcagtaatgggctgccataaactgaagatttagagcacagcaaaggaagggcctgggagctctgggggcagcaaggaggaagaggaaggggtctgacctgttgattaaagcagtgattagaatagaaatgggtgtggaggagagcagcagcctccaaattatacctgcctgggcaggggcttcacgcaccaactcttgagcctcacagcaacaccaggcatctccgtgtgaggactctgaggctcagaaaggtgaaggggcctggctgaactcacactgcatgtgagtggccaagctggcctgctgatctgggcctgactgcaaagccctgtgtgtgtgtggtctctagacagagtctctccattaacaatgctgtccgaggacaccagatgggcagatctggaggagccaagacctggaactcaacaggggcaagtgctggagagatgaacctggcactggtgcaattagagggagcccaaccagaaggctagacagtggcaggtgacaagtggtgtctggtgggcccctgctgccaggagacccctgctctcgaagccatggcctgccatgcagcaggtgggaggcagtggctgagaaggcaggccatatccgcagtcagcatgaggcccaggtggttgctgggggccgagctctgcttcctggaggtgtgagtccccacccgtatgtacacagcctcccacagcttcaggaagcccacagccacaggggctcagcaaacgcaggagcaaactcacttccccatgcccatttcctcccccatcccagctcccacctgctgttcctccatccagacctctctggcttcacatcgaggttgcagtgagctatgatggtgccactgcacgatccttttctattttgtgctgttcagatttaagaaactccctttgtgaaactttataaataacagtagggaatttctgcttataaaacaaatgcatataaatatagcctattaattttcatatatatatatatatacatgcacatgggcaggcatgattttttctctcgattggggattgcactgatcattcctttttgtagcctgcttttatcacttctcagcgtattgtgaagtgtccacatatggaggcctcatggcagaattgcacggctcttcagaacagaggctcaagtccctgcaggcctggatttcagaccctggctctatcactaatcagtcttgtaactgagcaagttactcacctctctgggccttggtttccgcattggtataacggagataatagtacctatccacgcaggtctgatgagaggactgagggagggcacataaaaagcttagaagaagacctggaacacagtgaatgctcaatgagcatcagacattaggattgctgttgttcctgacctcatggctgactccagcccccagccccacctcataccccacatcctgtagctggatcccagcctccactaagctctaacctgggtctcccagggtgaccttgggtcctctgactactgagctgtttggagggctgatgcccagtcaccttccaagtggcatccagtgggatttctgagaggttcttccctgggttctcagtgacgtgaggaatgagaggagttagaagatggggaaggaggagggaaaaggtgaagaaatagctatgatcgagccagaccctgcaaacctggccctggatcttctcaagtctccattgcccataggcctcctcccctgtgtccacacctggggtttccccctgagttggtatcacaggacgtgatgtggccccggggagagaacattagtgtggctgccctcacatggccaggatgggtgaggatcaagtcataaccacccttccagggagctgctaagacttagggccatggcttggggctcctggtgctcactggccttgtgggggacccactgactttcaagtgtagatgtggatgtgggaccagggttgctatggggcagtgggctcagctctgggctctgggatccacaggagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacgggtgaggatgtgcaggccaccaagggcacccgggcttctgcctgggcccaggctccaggttgtgcaatagggtggctgggagcttctcccagatgtgcatgctgctggactctggcaaataggagcccctcgcccacagacactcacacagtccctgcccagctgggtcctctcagggatgggaaacagagaatccagtcccgtcccaagccctcgggccaagggatatctgccttcctgctactgaccatgctgatttgagctgggagaggcttcctccctgagccagctccccaacccacctaacagtgtccatgaagcagaaactgctgctgagtgagctggatatgaagaaactgagggacagggtgcagcatttgcagaatgagctgattcgagtgagctggggcttgtgggggcagaggggagggagctatggtgggggagcatcggggtgagaagagtctgggaggagaagggagaacaggcacagagggaatggaagcacggaagaaagggggaccagcctggtggaggattcagcagaggggccgaggtggaccctcagggccaaggtggactcccaggcacccattctctccccttctctcctcccccatctcacagaagaatgatcgagagaaggagctgctccttctgtatcaggcccagcagccacaggccgctctgctgaagcagtaccagggcaagctgcagaagatgaaggcgctggaggagactgtgcggcaccaagagaaggcaggtggcagaggggctgcccccgaggccaactgatgatggcagagtagggagcccctgggccagcccagcctctgctctgctctccaggtgatcgagaagatggagcgggtgctggaggacaggctgcaggacaggagcaagccccctcctctgaacaggcagcagggaaagccctacacgggtgggtccacaccctgatgtgatcagctccccagcttctgctccacccctggaggccctgccttcctggagcctctcagcttcaggagaacctgcgaagaggtcccctgcactcagttatgtctgtgggcctgggagacccaggattgccctgctcccctcctcattcaggcgccccatccagagatcccctgagctccctccttccctggaagcccctcagaacacaattgggatgcagtgtgagccaggctagaaagagggtggacctccagaggagggccctgcagactagcacagcagagagggccttcccctgaagaagggccacctggggcaacacttcccagctcctagccccaggatccgtcgaattatttccccataccgccaaagattctgcctctgcaaagcaaacaaacaaaaatactttgattaaatcaatgatctggggccaggcgcaatggttcatgcctgtaatcccagcactttgggaggccgaggagggcagatcacttgaggtcaggagttcaagaccagcctggccaacatggtgaaaccccatctctactaaaaatacaaaaattagctgggcatggtggcgggcacctataatcccagctacttgggaggctgaggcaggagaatcacttgagcccaggaggcagaggttgctgtgagccaagattgtgccactgtactccggcctgggtgacagagggagactccgcctcaaaataaataaataaataaatgatttggaggttttcttccccatcgatattaaccaaaagccacctaaaactgccaatcagcctctgataagcagaaaggaccaggtaacaccatatcaggccagcccaaagcaagggatttccctgagcctgcctgtgcaacctcacccagggcccctgtgtgcccagccctgtgcttagccttcaccgctgagggtctcaggggcaggagggtgtttctaggagcctttagaatgcaatgaaagctgggctggcctttcaggaagcctgaggtcatccaggagtctggatgagactgagaaggcaacctagggaggggaaacagccagatcaaaggcccagggagtgagaagaattccaggatcagagaagggaggaagagagagaggtgaggagctgaaatacactgaagacaaatgaggagttagagagaacgttgaggtcaggttctaaagagcctagaaggacagcctgtgtgcacctgatcccactggtggtagggagccattgaaggcttgggagtagaggggaggggtggcagattgaagcaaaatgctggagcagatcaggacagggacatgggaagcaggagagcccatctcaccaacatctgtggccgtgtctctaggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggtaagaggcccttgacctgggcctgcctatgccggtcactgggtgcccagaaatcacccatggtacaacccaagttgaagatcaagaccaggagctaagcttcccagggtctccagtctgcctgggggctcctggaatcagctctcaggccttggtctttttctcctgcggaatgtgtgtccccgaacacttcacctttaacctcatctagcatcccaggagaaagcaagccccttgttgacccttggtccctgaaccctgacccctttttcacctggctggcctccacctggaccctacacaggcctctcaaaactcccttctggagcattccctggtcttggtgcagccttggagagcccttttccatcccaggtggaccccggggagttgggagcaggaggagacttgacagagaggctacaagagacgcatggcccaggccactcagagtgcacagagaccctgcccgcacaggtgggtggcccagggcccagaaatgcccaggccctgctccacctctgaagatgcttcaggggccccttgctttacataaaccccaaagcagaacatttggaatcacagaatattgggcagggcaggggcacaggagagttttctctccatcccaggactcgccggaggtgagttctgttgaaagcacacctgactcatggacatccaggtaaagtgtgagggatgaggtcaactgcctcacaggttcttcacttcactcaaagactcccagtgcgttaattatagggggctccctaatgcattttacattaaaaaaaatgttgtgtcaaaacttcgtattctcaaaatctgtgtgggaaacagctgtgaaaaaagcacatgccagaccctgttctgaacttccagaagagggttcggcccaggtctgacgctctgcctcgggagctcagtctgaactcaggcctgactggtttcttcctcaataccttatggtttcccaagctcacactgccacagcctccagctggggccaaatgtgagtttgtgctttgcccacaggatctcctctctggtacttcagacaagttcaacctcctggccaagctggaacacgctcagagccggatcctgtccctggaaagccaggtgggtgagatgcaggagttgatgaggctggatcaggctcaccacacagcctataaccagggctcagtgtgtgagcagagtctaggctcaatctatgaccaggatcaaggcttagtgtgtggccagggtcggggttcagtgtgcaaccagggtcagggctcagtgtacaaccagggttagggttcagtgtgtaaccagggtcagggttcagtgtacaaccagggttagagttcagtgtgttaccagggttagggttcaatgtgcaaccagggtcagggttcagtgtacaaccagggttagggttcagtgtgtgaccagggtcagggttcagtgtacaatcagggtcagggctcagtgtacaaccagggttagggttcagtgtgtgaccagggtcagggttcagtgtacatccagggtcagggttcagtgtgtgaccagggttagggttcagtgtgtgaccagggtcagggttcagtgtacaaccagggtcagggttcagtgtgcgaccagggttagggttcagtatacaaccagggtcagggttcagtgtgcagccagggttaggattcagtgtgtgaccagagtcagcgttcagtgtgcaaccagggtcagggttccgtgtacaacgaggttagggttctgtgtatgaccagggttagggttctgtgtatgaccagggttagggttcagtgtatatccagggtcagggttcattgtgtgaccagggtcaggctctgtctatgaccagaatcagggatcagtgtggactcaggatcagagctcagtatgttgttgaaatgtccatctgtgtcttggtcaggctgcctgactgtttggccccctcaccctcaccccgccacccctgaggtctcgggaaggtgtcaagcccacatggcccagagctttgctttctgcctggacagcaggctcaggccctggttgtcctggccatcagggattagccctgctgcccatggtcctccaattgtccctctctgtgtctgcagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctgtgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcaaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcacgcaccccgctttgcacaccacagagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgtagctctgtgagcattttcctctttcctggagcagggcagcctgggggccctgcttcctcctcctagacctcactctgggcctgggcctgggtcttctgctgcagccttacagcctcccgcctgccccaggagccagcatctttggaaagccaagggccacagtggacccaggagggtggagagaagaggccttccaaagcaggggccagggagacgggccccttccagacccggagaagaagcaaggccaccagagaccagctctgttgggaaatacgagggaggcttgtccttttcatctgccccaaaacatctatcatgtctgatattccttctttcaagtttggtttgtctgtctcttggaaagggaaagacttggaggcttgaagccttcctgtggcagtcacgtatcattgtgaaatactccattaagccactaggctgagctggcaatgatgtgtccaaatgtagccggggcaggagagcagattgggccaggggaaaggaggcacctacagggagtcaggaggcccaggttctgggggcaaacaggctgtgtgacctcaagggacccaagcaacctctctggacttcagtttccccatctattccatgtagagcttgacctcattggctgtaagcctctttccagctataacatttctgagtcaaagctgactcaggaccagagaagaaaaaggacacaggaaggaaagacaaagacaacagggaagaggattttgtggtggggaaagcagaagggctccaagagtggatccagatcccacagcttcgggcaggagaggccaggccagctggaccactggcctcagctggactagctcccccacctgcctgcaggacttagacttggatagccgagggccaagaggaatcaggtcaggagttgggagaccccaagggattagggggcggaagtcgagaccagtgtcattcagtccaaatgacaaaccagcggctctgctgcagaatagtatccccacctcccacccttggacaagggggcgcaagcccccagagcaagaacacgaggcctggagcaagcccagaggaggcccgggaatggtaaaggaagcaggctggcctctcatccccagtcagccacctcacaccagcccttcagtagcaggggttctcacccacagttctcggcctttgccatgcccaggactctggctgggccttggcaggaagtcctcatgccccacagggaactcccacccagagttcacccaagcagagccctgtgcgagccttacccctgtggggcaggtccactcagaaaggcagtactggcccacacttcttggggccacccacagaactccccagttctcctttgtccttctgcctgatgcttctgtagctcctggcacagtagcagttgcctcccctcctctgccccactctgcctcaccccttgccccagggagcctggagttgattctgctggctcctgaactgccatgggtgagggggtcccagcagaggtggcttcaagtgtggctacctggggtctcctgagcatgcccagatcctgctttaacacaggaagcatctccacgggagtgatgaacacctaatgagtctgatggaacgcaagacaccacatggttcagctgtttattgtctccatggggtgggtgaagaggagtggcccagctgagctgaggaaggtgaccactgagaacccattcaacctgctgagcaggctgggcagaaaggagcaggacttgggacagacgactgaagatgcagagaccccatgggccccacccctgggccttcctcccatgtggctgcaggccatcctctctgatcactgctgggttgcttcctggttaaagggccagaaggtgaaggagatgggcttttcaggcatcagaatgaggttgaatgtggtgcccacatcgctgaggtgttggatttcaactctgaagttctccagcatctgagaaaggcagatggtaggtttaggggagggcaggggaggatctgtctccctagccaggccaattcacccataggcagtgcctgtggagtgtgatttgaggagttccaaggagttcaccaccagctcctggtgtaaccctgcacagtgcctgataatgcacccttagtgctgcatttccttgatttaggcctagaccttaacttgtctacaaacctcagtcctatcccatcccatcaccaccatggggaatggatggccaggggcatcagtgggtgatgagtggttgagcccgaaagagggggcagcagagaactgtgggagagagcgagagcaagtaactggaggtagatgcgccccagcactgacatccttgggctctggacagagataggaggaggaagattggtgccttcattagggccagggccagcccagggtgcctagatgtccccagcttgactcacattgatgaggaagatggtcatctctagctcagcgatccgccgtcccagacactgccgcacaccccagccaaagcccaagttccggaagtaggtgatgttcttgtctttgctcagccatcgggttgggtcaaaattttccgggtcgaagaagaaggtgggctctcggcccagagcatagatggccacttgcaccagtgtctggggcaaggtgatcagaggcctgagtaagccccacttccccacagccctgagcacaaaacccccttccctagtcccctgccctctcaccaccactcccactccccagcatggctgcccagctctccagggcaggacattctgcccactgtgcagccttgaacaaggccccgcccctctgtaatccttacccaccaaatggggatggctgaagacccaaggccaggatgattgtcccaccctttcctcagacccaggcaaatcatgaagtctccctcctaaccctgggttccaataacatcctagaggtcaccgcccaccatgcccaccacctctgcccttcattcagacttagactgctgccatcaagggccccaccagggccccagtgccaccctctgtctgcaattccagcctgccccagccctctctgactggcagagcctgcagcctgctggctgcacctaccttggcaggaatcatgtaatctcgaagaaccaagtcatttacaagatatctctgcagggtcacggagatggggtgaagtctgcgggaggagggcactcagaagctgatggccccaaaggctggacacagccgccggagccccacaccctgtgtggcatctcagccctagctgcagcagcctggggggacctgggggtagggccctggctctatttctttctcctccagacttttcacttcctgcttccaacctcctccaccagcccatcctcgtaaccctttccccgggcacttccctggccctgcccagggattggagttgggggcggcatgggtggttgtgggcttgccttagtgtctccttgatgctggctttgaggagggggaccagctgtagcatcgtggccatgtctccctgggcctggtgccgcgcagccaagacctctgcccgcagcatatcctgcaccttcaggttgcgtgccatctcatacaagtgccactgcagggtcatggacgtctggtggggagtagggtatacagaagaccaggagggcctgtcactccggggccccttgaggtccttgaccccatggtaaattttcatttccaagaacctctttctccccgaaccccatcccagtctccaagaccatcctctgcaagagcaaaacacattccattgtctaaaaggcaaatgtccaagaagcctttcttgccggccaggcaggaacattcagggcagcacttgtccctgccctcgtccctcatgtcaccaaaaacccacccatgtccacagtgagtagagtgtcagctacacagccaatgccttcttccaaagaattccagaggcccttagaggccaaatccttctgtaatgattgcactccagaatgactgccattccttttgaaatgccttgttaaacaaccacccctctttccagtagaacttcctaaaaccttaggcttcacctatagcaacatggcttcaagtaaggctcaaagaagctgaaaccagaccagccggatgtttcctatcagtgttgcaattagggtgtggtgtgtgttgaaattaatcagctaatctcaacgtaagccagaggctgtgaccactagcccttcgccagagatctgagtgaccctcatcaaaccccacagtcccagattcctcaatgatgacaaaccaggcccgtttgggactccagcctggagcagccctccctcctggggactaggacatgggttgttgacacattatcttaccaaggatcatatttttgtccaacagacttagacacccacctccctcctcctggcaggggcaacaatgacaagctgtgaggtaccatttattaagcatatattatatggcaggcagggtcctaagctgtttacatatgttacctcgtttaatactcacaaacaaacctctaaggtatgttaccatcatccccctttttcagatgcggaaactgaaacaacacacagctccttctcagcttaaaatccttgcctggctccccagagcctccagatgaaatacagaggctcaggcctgagccacagggcccctcaacacctgcctgctgctccccaataccccactccccacctctctccaacacacacctaatgttccagctacatggagtggcacacagcccctgaagcccagaagtcttccccacgctaggtcctcttcctggaattcccttccccgcctaagaaggaaggatgtgctccctctgcaagactctaatcaaatgtgtgtattcatctcagtactgccaaggcctgccatagagatgtacttgggatttaataaggtggttaactatgttactagctgtgtgacctcgaccaagttatttaacctctctgtgctctactttcctcatctgaaaaagggggatgatggtaacataccttagagggttgtttgtgagtattaaatgaggtaacatatgtaaacagcttaggaccctgcctgccatatagtatgtgcttaataaatgtgacctcacagtaatcgtttctttggtgccggtgagtgatttttgaagatctcttctacgtaatagacaatgaactatgtttaaggtatgctcaaaggctccatttgcagtctgtctcagggatggaaactccttcatcagagtgtaacacagatataatacctgggaatgaaagtgattcacccagggggcttgacatgtgcttctccctagtcctgaaatgctattccttctctctcctcctggcaacagcctgcaagacacgcacgttgaattttagctcctctgtggagccttctccgtgtccttcatggccacattagccactccccacctctcagctttgtcagtggcaggtgcttgcctctgtcactgcagtgtgctattcctccgttcacactgctgcctccctgttataggctgagctgtataccccctcccaaaattcatctgctgaagtcctaaccctcagaacctcaaatgtgactatatttggagatagaacctttaaagattttaaagtaaaatgaagtccttgaggaggatcctaatccagttctgattagtgtcctcatgaggagagacaattctgacacagacacagagggaagcccatgtgagacagagggagaagacggccatctacaagccaaggaaagaggcctttagaatgcaccaaccctgccaacaccttgaccttgaacttccagcctccggaactgtgagaaaatcaatgtttgttgtttaaatcgcccagtcaatgccattttgttacagcggccctagcaaaccagtacacccctcccctctgagccacgtgaggacatttgaggtctactgtattccttttgagatggagtctcacactaccacctgagctggagtgcagtggtgcgatctcggctcaccacaatctctgcctcacgggttcaagcgattctcctgcctcagcctcctgagtagctgggattgtaggtgcccaccaccaggcccagctaattttttgtatttttagtagagatggggtttcactatgttggccaggctggtctcgaacttctgacctcatgatccgcccacctctgcctcccaaagtgctgggattacaggcatgagccactgcgcccggccaggactgattattcttaatatccaaagaaagaagtttctagggtgccatgctgctatggaaagagcactggggatgcctctgggcgttgggggcaccgtagggtactgaggtctggaaaggggaggaggaaggacaacaaaaagaccatggacggcagagcccacagcaaatgcctcggcctcccaatgtttccgggctcctgcctgcttccctggatttgagtgagtgtgttctccaccaggagctgggggcattgtcctccatcagcagggctctgatagagcaagcctccagaggggacctcctcctgtggagactctacgtggaacctggacctcaccaccatgcccggccactcctctctcacaggcaaagaaaaatagctgatcatcctcaaatcatgccctgggtgacttgactttgaccccaccatcttaggagattagcgctttggaaatggaggcaaggaggaagacatatcctacatgagtaggaacgccttgaacaacagggtttcagacaacgaggggcctggtggggaaggggcacgtgggcacagggggcaacaaggtgccgcccctacagccacctcaccgtgtccacccctcctgccagcatctctgtgacgttggccttgatgtcctcgaaggacatcttgctgtctcccaggagtctgtagaggatgccacggtaatcgtggtgaacacttcctttctgtctcaattcccagtagaagttctgggtgtatatgtcagctgtggggaaggaggaaagaaaaaagagtgaggttccctgcaggcgggtgggaaggagggcagtctgtggtgaaaggtggcaccaagggcctggggattccggagccctgtgcttcttaggctgccgttttactgagcacgtactctgtactaagcccttcatatctgttttttcatcgaattcttggggtatgtgacatcatccccattttacagataacagaggtgcagagacatagtcacttgcccaaggtcacatggctgtaaggggcagaggtgggatttgactctgccataccctgacgagccttctccacccaaccttccccatctctcccacccaagtccctgtcatccagcacagccgtggctcagacactggtcctttgccctctggggagcatgagctcctttgaagaagatcacagatgtctttgctcctctttttccagaaaaatctaataatccccaacagccagccttccatccgccatttccaggggtcccagggccttcctgacacccacgcctgcccgccacagtgtgggtttcctacaggtcaagtcagcgcccattgacatagcgtgggacaaaggagccggctgaggcctggggctccgaggaggagagcacagccagagaagccctcacctttactgaaaatcacgtcccatgcagccacatggtccttccaggtcttggtcctgaacagacggaacaggtctgggggaaggttgagcatggggacgctggtgtggaacatctggtagatggcatcaatgaatcgctgggcctcggggttcactacttcctccagcatcccctggcgctccccaaaaatgacgttagtgatggctgcagggagaggaagaggctgaggagccatttctgacggggccatctgagagccacaactcccagggactcctccaccctcacctccctcagcacaaaggatctcttgcccctaccctcagcctccttcagtaaataaattgaggcctgagtcccaaagggctaagatgcaaggctgagaaagctgacctctggcaaccacacaggtcctgcagaggggcatgtggaggacctgaaaggtgggaagcagggtctccagcagagctgagagagggcctagcccaggatgcaactgctctgcccaggcttccaccaagagagattcctcatctgtaattggctgaattggctaaatacttcctgaaacaggtcagaaaggagactgagggtcataaatccctggataattaaccatccaggacctagtcttgctggacctaagaagttacaacagcctcaagttttccccacctaccaggtgagtaatttgaatactgatttcatacaaagctctgggcaccccaaatctcttgctgtgaccacacaatcttcatcaagccacagggcctttgtatgtgtggttccctctacctatactgcctgacttccttaccccatctagataactcctacagattcctcaatgcctacctcagattaaccactgaactctcctctaccctaccagactccaaaggtctatggcccaggaggtggagacttgcagaatgaaggtccaagccaagctctggctttggcggatggtggcaatagggacctgtactttggggacccttgctcctacagcacaaatgccagatgagagagaatgccagatgagagaaccccagagcaaggggtctcactctgttgcccagggtggtcttaaattgcctctgagtagcaggcagtggaggacatgatcagcggctcatcccagaagtcagtctcaatgcctctgcagggtctgtactgaacctcaaggtaagagagtgaacactgagtcctcccacccccatgcccactgccagccaggtgcaagcccccttacactcaaaggcaaagcggaacaggtcatcactgatgtcccccgagtaatttccggagcccgccttcttgatgcgcctgtgcaggacactgacgaagtcccgagacactgcatccaacaggggcaaaaagttcttggtggcctctggagccatcacctcctggttcagggccacccggtctttcttccaggctgccgacttcctgagaaaacatgggcccacaagccctcatggtcacagaccccaggcctggtgaacacagagggggctgactcagttttcccaggaagctgagtcacagctcacagcatccagcactcccaccagggcctctgccctcacctctccgagcaccctctgcctctcacctcctccctgctctgcctggctgggagaagagaaaggaaaaaagagagtgaaggggaacaaaactccaactcccctccactccctctgctgagggccaggaactgatattcttagaaccctttgtgtaactttcagtctctccagtctttgcctcagctgcaggcatgccttccatgccactcccacttcctcctggccgatgctcacctttgacactccagggcccctctatataacattttctgactcttgcacaaacaaaattgaccagcctctcctcctctgcacccccaacacgtcccattactcacttctgtcgggggacctcaggtgccccgaactgggttggtcataataaaccttaattcatgcacactcttgaaattcatcaatccatgcaaagtcctcttcgtgacttgggggtgtttttgttgataagaatattatcacaaacttaccacccaccatagaaactaggaacttgacagtaacttacacttgccctcctggtccttccacatcctttgttcccttctaaggagaccacccactagaatcccttgctctcatttgtgtctaattttatctgatctccatttattcccaaaaggtactattacaaaatatatactagtgtttaacttcttttaaaaagctgtcggtcagacacagtggctcacgcctgtaatcccagcattttgggagaccgaggcaggtggatcacctgaggtcaggagttcgagaccagcctggccaacatggtgaaaccccgtctctactgaaaatacaaaaattagctgggcatggtggcgggcatctataatcccagctacgccggagcttgaggcaatagaatcacttgaacccgggaggcggaggttggagtgagccaagatcgtgccattgcactccagcctgggtgacagagcaagactctgcctcaaaaaaaaaaaaaaaaaaaaagaaagaaagaaagaaaagctgtcatgctttgccagacttgcttttttcacttagttgcaccgttccaagtatcatctgtattgctgtgggagactgagtcccttcattttgactggtgtgtaccacaattcactcacttataatcctattgggcatttcagtagctttctggtttttaatatcatgaacggtaccactgcaaaccttctactacacatcccccaaagcagggatactctttggagtatatacctgaaatcaaactgctatgtcacaggtatgcaaatattccattttaggagaaaatgtccaaccattttccaaagtagtggctccagtttacactcccaccagtaacagatgagagccccagttgctctgtagccttacccacacttgatatggttacgttttaccttttcttttcttttttttttttttttttgagacaggatccagctctgtcacccagcctggagtgcagtggtgccatctctcgtcacagcaacctctgcttcctaggctcaagtagttctctggcctcagcctgccaagtagctgagaacacaggcatgtgccaccacatcggctaattttttattttttattttttgtagagatggggtctcactgtgttgcccagggtggtcttgaactcctgagctcaagcaatctgtccgccttggcctcccaaagtgctgggattacaggcatgagccaatgcgccctgaccctcattttacatttttgatggggtgggtatggtggctcatgcctataatcctagcactttggaaggctgaagcgggaagattgcttgagcccaggggtttgagaccagcctgggcaacatggcaaaatctcatctatactaaaaatgtaaaaattggctgggtgtggtgacacgcacctgtaatcccagctacttgggaggctgaggtgggaggatcacctgtgccggggggcagaggctgctgtgagccatgatcaaaccactgcactccagcctggatgacacaatgagatcccatctcaaaataaaaaaaaatttatgaacaatttcgtagaaaacagtatccactacacttaaatacactgatctgtccccatgtaggacaaatgtctcactgcccctttagcctgtatgggactcacggtggcaggtccctgctctatttgtcactgtatctccagttcctggcacaagtcctgattcatcaaggatgctcagtaaggtgggactcagtgagcaaaccagtcagtgagaactttgccagatctttaattattcattaggatcttcagcatggccatttccctgaaggctggcagagcaattcatcatcatcatcatcatcatcaccatcatttgttttagggaggcaggaaaatgacggggattcacctagaggccctgctaggaggcacagggcaagcctggcctcagcccctcacccccagcctctgccctctccacagctccccaccacctccctccagtccctgggagatggcccaggactcacttcaacaggactcctatgggtctctggtaatactggtgataggcgacccagggcgggatgaggaatcgttctgggttggggccctcggacttaaagagaagggccacatcttcagggtcgatgacataaaccgactccacgttgccgagcttctccctggaggggtgggggagaggggctgatggaaggatccgaggagagctatggatacaggctcagcacagctgcctcacagttccacaacttgctgactgtgggacctgagtcgaggcccttaacccctctgagtctcagtttcctcttctgtaaaatggagacaaatacagtacctgtctcgcagcgctgctgaaggacaagacaataggaagtatatggatgtgacctttgttaaacattctacaagtgagagctttatgatcactgttgctgctgtcccacagcacatccccagggccagcccaaagccacccccgagccttccatggaccagcaagtcctccactccttgcgcattcttcctgtgtccacacctacagcagccccagcttctcacctgtccacagagctcagaaccatggcacactttcatgtcactgctagagtgactcactatagcttgcaaggtaggccatattccaggccaaatccctgtcagactctacaactgaaattctgagagtggccaccctgaccctaagagtcagaggccacccaacaacacgctttgtctctattaaaataaaacttcagtaaaacatcaagccccaacatacaggcaggggagacaggcttgcaaatcactttgcagacaatctgtattaaatacaactgggtttttgttgttattgttgttttgagacagggtctctgttacccaggctggagtgcagtggtgtgatcacggctcactgcagccctgacctcccaggctcaagcgaccctctcacctcagcccggccaagtacctgggactacaggcaccaccatgcttaatttttgtgttttttgtagagatgaggttttgccatgttgcccaggctggtctcaaacttctgggctcaagagatcctcccacctcagcctcccaaagtgctgggatggcaggtttgagccaatgtgcctacccacatacaactgttacatatgactggtgttcttacatgaagagatgaggacacggatacacaaagaggaaggaccatgtcaacacacggggaaaagatagcatctaactccaaggagagaggcctcagaagaaagcaagcaactcagccaaaaccttgatctctgacttctagtttccagaactgccagaaaattaattctgttgtttaagcaaaaaataagaaataaaaatacaactactaaaaaacaacagaaaattccacttcttgctagcctctgccttttatcgaagaaaattaagatacacttttaggcaaaatagcataaaaacatggagatacaagccaagtgtgctcatgtgtgtgcatgttctctctctctctcctctcatagtgctgctttaaccactgagccagaaagcctgggcctaccttgatgagtttcaggccttcacttgttctgtggcctcccagaaaatcccctcagtgtttttccagctaccatgtgtctttgcactaactagctccatacccctaaccaagttcagccaagcccttgaactgctattatcatgatcaattccacttctgggaatctagcccaaggcaatgatctgacatcagcaacaatgcttgatggataaggatgtccattgcagcctcatgtctaacagcaaaaaagtcaagagtaggttgtatgttcactttaaagaacccgcgaaaaaaaaaatccatactgtgaactactatgctgccttttaaaattatattagaggccaggcacagtggctcacacctgtaatcccagtactttgggaggctgaggagggagagggaggatcacttgcgcccaggaattcaaggctacagtgagcctatgatggcaccactgcactccaccctgggagacagagcaagaccctgtttcaaaaaaagtaaatattaataagatagatcaagaaaaaggaagaagatataaataaacgaaacgagatctttccccagaaaagtctgaggaccactgaacatcactttctcttaaaatataaaataattttatattagagagagaaaaaaggaaagaattccttgatatattgttgtgagacaacataagcagcatatgtagtatattcacatacctcatgatacttaaatgttaaatcaattggaattgattgtatctgacttcaatttttcatttgtgtttctctgtattttctaaattgctctgtataaaacaagaacagcctttgtgttaggaaaaaaacccacaaaagttgtattttaaattcctcacatttattcagaagtttattgtttattagctataagttcaagtataatgacacacagagctggaagtcagacaattccagttcctgccctggctttgctctcatgagttgtgtgacattgacaagacccttcttctcactgggcctcagtttccccatctgtaaagtggggaaataataacaccaactacagggatatgttgcaagattcagatggaagtgactcagaaaacagaaagataattagggtctggaggcagggaacataaggccaattcacacttgagctgtgacaggaaatatcctctccatagggcgtatgctgtaaatgactttgtaactttacttcatcctctccatttacataaggcatatggaattaaccaatggaatgctctaaggggtatttaaactcccaaaaattctgttaacggggcccctgagctcctacactcaggcccctcccacaccgtggtgtgcattttcatgttcaatacatcccttcatcccttccgtgctttgtttgtgcgttttgtcaaattctttgttcaagacaccaagaacctggacaccctccaccggtaacatgtattttggccagccagccaggaggaagaggtaagcccaaagtttgggattcgtttttctccctttcctttctgctccatacaggagctctctctttctcttttctgttccaacttgggacccttgctgggccccacctaaacacggagacaactgcaggtttctggccgtggccagtgaaactaaggggtttccacgtggagaagcagcctgactgccaccgcccggttcgcttaagggacctgggtcttttttatgttttttttctctttttttgtctctttctatttcagtctttcagcggctgtttcctagtagctccttggaaattgaggctggggtcaccagtactgcctgaaggtctacgaatgaaagggaataattgcgctgccccaaagcgggagggactttttttaaaaatcttttttgcctatggttcctgatccctacatgcggtgctgctcggagcaaactcataaatgtttctgggggcttaaaccttactttcttatgctaaattcttcccttatagtgctcaactagctaaggacaaaaaaagcccacgcagcatccagttcacattacagttcatggctactcttataaagttcatagtatgctccagaggggaaagcctgcatgtgatgcccacctaaagccagagacgtctgggaccctaagattggaccccacaggaggatgctctgtgggtcctgcggaccccagccactccaaagaggatgctcttggcagaggttctgaggtctagccctccttagaattttctctccgcagttgcaatgctgtttggccccaacattgtttggaatctgaagtttactgttgaattggaaagtggaatagagttgcatgtatccaggcttttgtgctgcagctctaagcagggggcctggttaacatgtgacaccctgctttgaagtcgtgggaggtttggcctttaaaaatcaaactgccatggagactgctttagccaaaattttggttcacagccttcattggattatctgttggggcaaaaactggcaagcttgtattgctatctcatggctaaggttccaagctattgaatcttcgtttatgtgtgtgtatacatgtctagatgtgtttatttgtatgtacacattgttatatgttgtgtctaccaaattgccttataagtaaaagagcactcataaattaagtaaataagtctaagcaattttcaagttcacgtgacttaaagtataactttactaaacaagctagctttaaaattattggtggaataaaaatagaaatgccttcagtattatcagtatacattttgtttgaattttatgtttgtctttgctatctttttttttttttttttttttttgagacagagtctcactctgtcacccaggctagagtgcagtggtgtgatctcggctcactgcaacctccgccttctgggttcaaacaattctcctgcctcagcctcctaagaagctgggaccacaggcacacgccaccacgcccagctaatttttaaattttttaatagagacaaggtttcaccatattggccaggctggtcttgaactcttgaccttgtgatctgcctgcctcagcctcccaaagcactgggattacaggcatgagccaccactagatattcttaaatgtcagtgaattcaacctgggagctgcttggggcgagcctgcctccccttctattcaaagtctcactgagataaatgcatatctgattggttcctttggaaaggctaatcagaaactcaaaagaatgtaaacatctgtctcccacctgtgatctgaaagcctccaagcccactccttgccttgagttgtcccacctttcaggaccaaaccaatgttcattttacatatgttaattagtgtctcatgtctcccttgttaaaagtaaaaattgagtacagcaaatgggataaatgctttaggtaaactttttgtgtaaattaaaaccttaaagttatttttggcactcatttaatatctgggtcatttccaagtaagaaagggttgtgatatggggaaatatgtttctaaaattgtggaattgttcttatctataaatgcccatatctgatatttcaggatttcttgctttttagggtttcactaaaattttacattacaaaggataaggtttctagttaacacgtaattctgtatacaaaaagtgcctgaaagggttattactaaaaaaaggaaagaataattttgtctaattcagaagttatctaaaagttagttcaagttacagttttgaaaaggttatttatgaaacaatgtagtaaggaaccattaagtaggggagaaagatgaggtacagtttaaataataaaatattctttaaaacctgataaagaattggaaacatttggctaattaacatttttatagttaaagctcttagtcttgattaaagtaagaagtattgtaaaaatgcattggcagtttggcaactcttttttttaatatagttaagcatgaagctggatttagtgtggaaccaaattccacatacatgcttacattgcttcatactatgtttactgttttgcatggatagtgctggagtacttattggtcatacgcctaaagtgaatttgttaattgcacaggatgtatgataatattagtgaacttaaggatactgaattgtgtatcaggaataaaatattcattatgtgggtttttgggggccctatgtaacactgtagcctccagggtaaattgaataagaaaatttagggttggtttcctgcttatttgtttttgcttctagttttcatttgtttgccatttgttctcctctgactttgcttgtgtatgcatgtatataaaaaccatgatttttcttagttcctagtggaaggttttcatttagttctgtgttcctgtgcatttctagcaagtcatcattcattccatttttctggaattcccaagctacctttgttgggcctgcaggaattaatggagcatactagcttttttatccttaaactaactttttggattttaggcttcctgatactttaagtgtgttgagtatactctcacaaatagaattttagtcatatttctctcactctgcctagtttctccaaaatttgtaaactatttatgaatattcttaattcattgcaatgtgtttgtttgcatacagtcaagcagggtccctggggccactcagggagagaatgtcaggcctctgagcccaagctaagccgtcatatcccctgtgacctgcacgtatacatccagatggcctgaaataactgaagaatcacaaagaagtgaaaatggcctgttcctgccttaactgataacattaccttgtgaaattccttctcctggctcttctggctcaaaagctcccccactgagcaccttgtgacccccacccctgccagccaaaaaacaaccccctttgactgtaattttccattacctacccaaatcctataaaacagccccacccctatctccttttgctgactcttttcggattcagcctgcctgcacccaggtgattaaaaagctttattgctcacacaaagcctgtttggtggtctcttcacagggacacgcatgaaatttggtgccatgactcggatcaggggacctcccttgggagatcaatcccctgtcctcctgctctttgctcagtgagaaagatccacctatgacctcaggtcctcagaccaaccagcccaaggaacatcccaccaattttaaacccggtaagcagcctctttttactctcttctccaacctctctcactatctctcaacctctttctcctttcaatcttggcgccatctttcaatctctcccttcccttaatttcagttcctttccttttctggcagagacagaggagacgtgttttatccgtgaacccaaaactccagcgctggtcacagactcgggaagacagtcttcccttggtgtttaatcactgcggggatgcctgcttgattattcacccacatttcagaggtgtttgatcaccacggggacacctgccttgatccttcacccttagtggcaagcaccactaatttggggggcaagcacctcccttctctccgtgtctctaccctcccttttctctccactttcctggggggcaggcatcccccacaccttctctccatgtctctatcctctcttttctctgggcttacctccttcactatgggcaaacttccacccctccattcctccctcttctcccttagcctgtgttctcaagaatttaaaacctcttcaactcacacgtgacctaaaacctaaacatcttattttcttctgcaatgccacttaaccccaatacaaactcaacaatggttccaaatagccagaaaacggcactttcgatttctccatcctacaagatctagataattcttgtcataaaatgggcaaatggtctgaggtacctgacacccaggcattctttgttccctccctagtctatttccaatgcaattggtcccaaatcttcttttccctcccacctgtcccttcagtcccaaccccaagtgttgttgagtctttccaatcttccttttctaccgacccatctgacctctcccctcatccccagactgctcctcaggtcactccccagccaggctgaatcaggctccaattcttcctcagtttctgctcctccaccctataatccttctatcaccccctctccccaaacccagtccagcttacagtttcgttctgcaactagccctcccccatctgcccagtaatttcctcttaaaaaggtggctggagctaaaggcatagtcaaggttaatgctcctttttctttatccgaactctcccaaatcagttagtgtttaggctctttttcctcaaatataaaaacccagcccagttcatggctcatttggcagcaaccctgagacgctttacagccctagaccctgaagggtcagaaggctgtcttattctcaatatgcattttatcacccagtcagcccctgacattagaaaaaagcttcaaaaattagaatccggccctcaaacctcgcaatgggaattaatcaaccttgccttcaaggtgtacaataatagaaaggaggcagccagacagcaacacatttctgagttacaattacttgcctctgctgtgagacaaaacccagccgcatctccagcatacaagaacttcaaaacgcctgaactgcagcggccaggcattcctccaggaccacctgccccaggatcttgcttcaagtgctggaaatctggccactgggccaagtattgcctgcagcctgggattcctcctaagccatgtcccatctgtgcaggaccccactggaaactggactgtccaactcacccagcagccactcccagagcccctggaactctggcccaaggctatctgactgactccttcccagatcttctccgcttagcggctgaagactgatgctgcccaatcgcctcagaagcttcctggatcatcacagatgctttaggtaactcttacagtggagggtaagtccgtccccttcttaatcaatatggaggctaccaactccacattaccttcttttcaagggcctatttcctttgcctccacaactattgtgggtattgacagccaggcttctaaacctcttaaaacttcccaactctggtgccaacttggacaatattcttttatgcactcctttttagttatccccacctgcccagttcccttattaggtcaagacattttaactaaattatctgcttccctgactattcctgggctacagccacaccttattgccacccttttccccagtttaaagcctccttcacatcctccccttgtatctccccaccttaatccacacatatgggacatgtctactccctccttggtgactgatcatgcaccccttaccatcccattaaaacctaatcacccttaccctgttcaatgctaatatcctatcccacagcatgctttaaaaagattaaagcctgttatcacttgcctgttacagcatggccttttaaagcctataatctctccttataattcccccattttacctgttcaaaaaccagacaggtcttacaggttagtgcaggatctgtgccttatcaaccaaattgttttgcctatccaccccatggtgccaaactcatatatgctcctatcctccatacctccctccacaacccattattctgttctggatctcaaacatgctttctctactattcctttgcacccttcatcccagcctctcttcactttcacttggactgaccctgacacccatcaggctcagcaaattacctgggctgtactgctgcaagtcttcacggacaggccccattacttcagtgaaccccaatttcttcctcatccattacctatctcaacataattcttcatgaaaacacacatgctctccctgctgatcacgtccagctaatctcacaaaccctaaccccttctacaaagcaacaatgcctttccttcctaggcatggttagatactccacctttggatacctagttttaccatcctgactaaaccattatataaacttaaaaatgcaaacttagctgatcccatagatcctaaattctttcgccactcctctttctgttccttaaaaacagccctagaagctgctcccacactagctctctctaactcatccaaccctttttcattacacacagctgaagtgcagggctgtgcggtcagaattcttacacaagagccaggaccgcgcccggcagcctttctatccaaacaacttgaccttactgttttagcctagccctcatgtctgtgtacggcagctgtcgctgctttaatacttttagaggccctcaaaatcacaaactgtgctcaactcactctctccagttctcataacttccaaaatctattttcttcctcacacctgatgcatatactttctgccccgctccactacctctcagcaagctgaactcattgccttaactggagccctaacccttgcaaatgaattacacgtcaatatttatactgactctaaagatgccttccatatcctgcaccaccatgctgttgtatgggctgaaagaggtctcctcactacacaagggtcctccatcttaatgcctctttaataaaaactcttctcaaggccgctttacttccaaaggaagctggagtcattcactgcaagggccatcaaaaggcatcagatcccattgctctgggcaatgcttatgctgataaggtagctaaaaagcagctagcattccaacttctatccctcacagccagtttttctccttctcatcggtcactcccacctactcccctactaaaacttccacctatcaatctcttcccacacaaggcaaatggttcttagaccaaggaaaatatctccttccagcctcacaggcccattctattctgtcgtcatttcataacctcttccatgtaggttacaagccactagcccacctcttagaacctctcatttcctttccatcatggaaatctatccacaaggaaatcacttctcagggttccatctgctagtctactactcctcaggaccctcccttccctacacatcaagctcagggatttgcctctgcccaggactggcaaattgactttactcacatgccccaagtcaggaaactaaaatacctcttggtctaggtagacacgttcaccggttgggtagagacctttcccgtagggtctgaaaaggccaccacgatcatttcttcccttctgtcagacataattcctcggtttggccttcctacctctatacagtctgataacagaccagcctttattagtcaaatcactcaagcagtttctcaggctcttggtattcagtgaaaccttcataccccttaccgtcttcaatcttcaggaaaggtaaaacggactaatggtcttttaaaaacacacctcaccaaactcagcctccaacttaaaaaaaggactctgtcaagaatagagcccaaaaactcaccaaccaaacaagtaattacactgaatccccttgggcactctctaatcggatgtcctgggtcctcccaattcttagtcctttaatacctgtttttctccttctcttattcagaccttgtgtcttccatttagtttttcagttcatacaaaattgcatccaggccatcaccaatcattctacatgacaaatgctccttttaacaaccccacaatatcaccccttaccacaaaatcttcctttggcttaatctctcccactctaggttcccacactgcccttaatcctgcttgaagcagccctgagaaacattgcccattatctctccataccacccccaaaatttttgctgccccaacacttcaacactattttatgttatttttcttactaatataagaagacaggaatatcaggcctctgagcccaagctaagccatcatgtcccctgtgacctgcacgtatgcacccagatggcctgaagtaactgaaggatcacaaaagaagtgaaaacggcctgttcctgccttaactgatgacattaccttgtgaaattccttctcctggctcatcctggctcaaaagctcccccactgagcaccttgtgtcccctgcccgtgcctgccaaagaacaacccctttgactgtaattttccatgacctacccaaatcctataaaacggccccacccctatctcccttcgctgactctctttacggacttagcccacctgcacccaggtgattaaaaagctttattgctcacacaaagcctgttcagtggtctcttcacagggacacgcgtgaaagagagaaccctgaaatctggcatgccggtgaaaggataagaatttcttatgagtcagtctctgggctctttccctctatgcaaactggttaaatataaagtagaagtcacgtatatctcctctgtaagattttaaattaattggtttaataataataaaagcttaagtcaaatattttgtcagaaaagtagaaagtgtaatgccttttagttcatgtgactttagcaatagttgggaaataaagacagttttcaagattattggaaaaatacagttgtcttcaaaatgtaaacatgtggtgtacattatgttcaaatactaggtttgctaaatcctttaacatcataagctactcctttggcttttgaaaattgtttaacttgcctgctttccagctaggtaaggcctggggacacgtggagttagccatgcccctagctgtgctggaagtagtcaaaccttatcagaaactttatcagaacttaccagttttttttgtttttgtttttgttttgacagagtctcactctgtcccccaggctggagtgcagtggcgcaatctcggctcacccacaatctccatctcccagattcaagcaattctctgccctagcctcctgagtagctggaattacagacgcccgccaccacacctggctaattttttattattatttttagtagagatggggttttaccatcttggctaggctggtcttgaactcctgacctcatgatccacccgcctcggcctcccaaagtgctgggattacaggagtgagccaccgcgcctggcctaacttaccaggttttatgttaaaattcgccattataggccagtcacagtgcctcgcacctgtaatcccagcatttggggaggccgaggcaggtggatcacctaaggtcaggagttcaagaccagcctgaccaacatggtgaaacccccatctctagtaaaaatacaaaattagctgggcaaggtggtgcctgcctgtaatcccagctactggggaggctgaggcaggagaatcatttgaactcaggaggcagaggttgaagtgagccgagatcatgccattgcactccagcctgggcaacaagagtgaaactctgtctcaaaaaaaacaaatttgccattataacatgcaattaagactactagaaacagttttacatgcaaggtgtataagaacagtagaaagtgttgggggtttttttgtgtgtgtggaaggttacaaaaggtttttgcttctttaaaatttctgagtcatcattttggcaaaataaatagtttacggtaatctggaattccaaaatcaaacttcagtttcaaaattgtctttcctaatgcctggctttctagatgaatcagagggcccctgaaaacatccagaaaagaggtaaacaggattatttgacatgtttaggtacatgggattgacaaaatgatgttaaatcttctttaggttatatttttgtgaataatatattccaaaattgtatgggatttctcaaattctaatgtctaagtatatgttaccaatcacaattataattatgttaagttattgtaaaccacaaaaatgaccaaattttcttgtataaagctactaacccacgtaaaacaacaacaacaaaaaattaattacatatcaagaaaagactttcatgttaaaccagctaatactgaaattgtttaaaatagtttataacctgtcgctttgcagatgccgtcactgccaccaggagccctgtactatcagccatggtcaaccccaccgtgttctttgacatcgcagtcacggcgagcccttgggtcacgtctcctttgagctgtttgcagacaagattccaaaaacagcagaaaactttcatgctctgagcactggagaggaaggatttggttataagggttcctgctttcacataattattccaggatttatgtgtcagggtggtgacttcatatgccataatggcactggtggcaagtccatctatggggagaaatttgatgatgagaacttcatcctaaggcatacacgtcctggcatcttgtccatggcaaatgctggatccaatacaaacggttcccagtttttcatctgcactgacaagactgagtggtggatggcaagcatgtggtctttggcaaggtgaaagaaggcatgaatattgtggaggccacggagcgctttgggtccaggaatggcaagaccaggaagaagatcaccattgctgactgtggacaactctaataagtttgacttgtgttttatcttaaccaccagaccattccttctgtagctcaggacagcaccctccaccccatttgctcgcagtatcctagaatctttgtgctctcgctgcagttcccttccatgcctagctggactgcagagttgagttaaagtttatgattatgaaataaaaactaaataacaacaaaaaattgtttataaccaatgcttgatcccatattcctaggaaaacaattaaagcttcaggtatatttggtcttctggtcagccatttaaacattttataaagggatttcattccattgttattttccatgcatgttttctggttgtagaaaagctttcccatgcaagagggctgatgttataacagtagattattatgctacagtgtattttcaccagattaaaaaaaaaagctttttatggtttgaatctgctggaaacatcagagaaagactgtccttgccatctacactataacaaaacttcaggaccttgaactttgggttcataatctcacaactgagaagggcccctccatgctcttggagctgtgcacccactggaatgcttaaggtaaaactaactagggaaatttctcccaagaagaagatgacatcattgatgtgaacagcttttcccaagttcacagattaagacttctactatcatgaaactcttatttttgaatattttttcttgcttatgccttctacgaacaatagaagtggaaaaggggtctgttatgtgcacttatggggaacatttttatttgtgaaggagtttgcagccagccttatacatggataaaggcccaatgtatgtaagaaactttaatggtagatgtgttagctcataatcaatcaaaaacaaaaaattgattcactccacataacccacatcgtgggttaaagagaacattgccagaagtccttcactcttctgaaagggcatcatttgttaggtcctttttccatggtttaaagtaaaagaagcaatgattagaaatgtatccctcatgataggttccatagcaaattctactctaaaggctacagactctaaattctcttgtgaaagttataatagaattggctaaacagcgaagtatctgtgcagctgctggcacttgtggcctatacagaaatacatcaaatgaagactatagaaattcagtggtaggagactgacaaagaaattgattagtcaagtctctctctgttgcccaggctgaagtgcagtggcgtgatcttggctcactgcaacctccgactcccaggttcaagcaatcctcctgccttggcctcccaagtagctgggattacaggtgcacgtgaccacacccagccaatttttgtattttagtagagatggggtttcaccacgttggccaggctcatcttgaactcctgacctcaagtgagccacctcacccagccgtgagtaaactgtatctagctcattcttagatccatttgattttaggaggtttggtttatggggaccttgggtaaggagtatactcccaaattcttggtattatcctcctaatagccataataatggtctccctgacgagctgtatgctctcaaaggttttaaatgcttgcatgagccatctctagaatgtcatatggtctctcttcaactggaataacaggagctcaaagaaatatgcaaccatgaggacaccataacctataaatgacatgctgagaccagaaacccaaaatgatggtaactgagagtggcactgaggccctaggttttggtcacactctcacctaagtgaaaacctgatcaaaaagggaatttttttcaacaaaattctgggaggccgttgttttggactgatctcatgcactaggccccaacaaaccaaacaaaaccaaaatggggccactcatgccaagactttaaggaaacacatagattctagaaaagactaggttttgttttttcttctgcaaatcactacaacaaacatttctgacagtataggtatccaccccctaaagtttccattaaatcttttaaccaaattcatttcctctcacctagagaccatcaagcttcagatgatcatgtaacaaaggttccagccagttccaagtgaagacaccacccctggacatcaagaagctacccttcctccactagatagagcagggtgagagttccatgatccccaataggtagggactatgccccaagccagcatgaagcagttacagaaaaaagaccatcggtccctctgcctcccataaagatttatggggatcacatctcttgaaggggcagatgaggcaggaaaatagggtctgaagtgtgaagatcgattcacacttcagctataacaggaaatatcctctccatagggtgtatgactatgtaacttgaatacttcatcctctccatttacataaggtgtatctgaagtaaccaatggaatcctctgggggtaaatgccccacaattctgtaacgggacctttgagcccctacgctccgcctgctcccacactgtggtgtgtatgttcattttcaataaatcccttcattccttccttactttgtctgtgcattttgtccaattctttgttcaagacgccaagaacctggacaccctccaccggtaacaaaggggcttaataaaataaggagttgctactgagggtctaggaagtggtgaaaagggaagagaggaggaagcaaggataactagagatctatgtgaagtgagcacgggacagaagcactaataggcctaggagagagggggaggaaggagagacccagcggggcgcaacctcccaagcccagcactcaaccttgaatagggtggggtgcggggtggggggagctccctgccaccaaccagctatcaaaaggggcagtttggactttaaaggagttgtgagagagggagggagcagctgaagccccaacacaaactagcctgccttctcacccacccccagcccagtcatcaagccggccaacacatcttacccttccctcttcgtgactgacccattggaatgctctgagttgtaaagacctttcacttaaaggaaaacgtactgtccctcctggtctcccctcccagcccccaaccacccctgcgccacctccgttccctctcaaccggactcttagcaaagaacccaggtgtggctgaaaggctgcccaccgtgggaacagctttagcagttttcccaggaaaaagccacaagccctggaggcacagaggcccaaagacaaaaaaaaaaaaaaaaggcctttcctcctagcaggaagcaagcccgattcttgggaaagggaagggacagactcagagcctcagggccaaggggtgagatccagcaccccagcaggacaggaatctagctgggtgacctctctgagcctcagtctcctcctctgaccatggggacaacaaacttcgcttgcaaggtgtgcggagggtaacggatgtagggaggcatttagtagggcttgttctctaaccacctctctccgagagtttcaaagggagtgggatctggggaaggttgaggcctcaggcctgggaactaggaatactttcccttttacccaccaccatcccaggcctggaagaagatcagaagttggacaggagaggtccggccgcgcggacgtcaccttagcgcgccactgtcggctccggtgggctcgggtgagctcgggtgaacgcagcgagcgagggcagaggccagcagaggcgaggagtggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccggggggcggatgggctcgggctgtgtcgaggggaggcggaggtgagcgacccgcgaagagcgcaggagcaggccgggggccacgctagggcggacccaatttcggaatagcgcggcccgggcggcggcgtgcgctgggaggaatgctgggtctgtcgctagcgccaaacttgaccacgctgcgaccttttcactctgtgctctgaccttcaaatctccctcccccgattttttttttttttttttttttgagacagagtttcgcttttgttgcccagggcgggagtgcagtgacatgatctcggctcactgcaacctccacctcctgggttcgggcgagtgtcctgcctcagcctcccgagtagctgggattatagacccccgccaccatgcccggctaattttttttattttatttatttatttatttatttatttatttatttttgtagtagagacagggtttcaccatgttggccgggttgatctcgaactcctgtcctcaagtgatccgcctgcctcagcctcccaaagtgctgggattacaagcgtgagccaccgcacccggccttctcccaatttttaaaactcgctggctgggctgacagctacagggccaggaattcaaaacttagcctcaccagtctcccctcctcagaccgaggaggttgttttgttttgtttgagacagaatctcactctgtcgcccaggctggattgcaatggtgcgatctcggctcactgcaacctctgcctctccggttcaagccattctcctgcttcagcctcccgagtagctgggattacaggcgcctgccaccacacccagctaatttttgtatttttagtagagacggggtttcatcatgttggccaggatggtctcgaactcttgatctcaagtgatccgcccacctcggcctcccaaagtgctgggattatgggtgtgagccaccatgcctggccagacctggggtttggacccattaaagagcttccttacagatggctggcggtcttgccaccaattgtttcaaaagtagatgtctggtttagagtacttaagacattcacagattcaaatgttgaattttgaaatatccctgatatatttctgtattgtattaccaaaaaaaaaaaaaaaaaagaagttagacaggagtttggaaccagagaacagcctgttgggggagtggggactacagcagggctacccaggcccctcctcctccctgtcccttcggctcccaccctctgccaggcttacctgtaaatcgggccatacttctggaaattctggacatggtgaaggtggactttgtgtgtgcccgtctccctccagaaatggtacaggtttagccagccattgtcaccaggagaggggatctcattgaaggggcgaggactgcgggtggagatgccagctccctcgccagtgggcaccctgagacgccccagcccctccctgggggcactcagaaaggtctggcagcctttgaccaggactgagcgtgggggaagacccttggccagcatgctgtccccacagctgtgactgtacctgctccacttcagcggggactgctaggatgactgtagccctgggccaccagggccaagattataactaccagctcaaggccataccagaagctgataaaatgttcacgtccttcctcctgctgcaggctcaaacccgcagacagctcctcccctactcggtatgaaggttcagtctggaatttctgcagcgtgaggttctccaaaggacagggagacccctctgtctctgccctcagtgccagccctagcagactcctgaaatatctgcctgtgcttttgcctgagctggggcctcccactggcccctgcagcggagtccatgccctggcagccattggtcaagactgcagacaacctgtgtttgggggaaatgaggggcccaagagaaggtcagagctatcttgccagcttgggcaacatacgtcttagttatggccccactgtatagacacacatcattgaacaacagggataagttctgagaaatgcatccttaggctattttattttattttattttattttattttattttattttaagagagtttcattcttgttgcccaggctggagcgcaatggcacagtttcaccttggaaccctaatcctcgtcgtctctccccagttgacccagatttggggctgtaattcagtacagctgactcagaggggctctgggtcccttgagctgaggtctgtggtcaggctccactctggacacactctaagaccttggcaaatctggttgccatggaactcaggatgtcagctcttccctgtccacacacttgatctgtgctgctttcccctcagagctgcttccataccccctcccatcatatcatatccccagacccatccttccagcccaggtcagcccccacacccaccccccatcaccctgcacctaccactttcccaaacaacaagggtcagtcacctgtagagttttcaagtcatttcaacaaaattacagcccacttggtaaaaatgtgtaggtcagaaaacatacatgtgccatgtagagcatttcatgacagcaatctacactataccttatacttatcattggaaggtacaacttcttgctttttttccccaaaatcttattttctggcaaataaggcatttaaaacacacatctaagagacagaaaatagactggtggttgcttagagctagggggatagaggaattagaggatgggacataaagtgtgtagggattcttaggatgatgaaaatgaaaatattctaaagtatattgtggtaattattgaacaactctctgatacactaaaagccattgaattgcatactttaaatgggtgaattgtatggtgtgtgaattatatctcaatagagctgttaccaaacacacacacacacacacacacacgagtgacatcctcctggcctcttctgttgtatgtgtcagcccatagatcacccacaatggcaaaagttgtccttacacagccacttgaccccagactccaatactgttgaaccactttcaacaaatttagagcaacagtttttagaagaaaaaaaaaaagtacttatcaagagtggttgttgctcttcccgctggagtgaccactacctcatcagtcatgaaccttctgataaagagagtatggagaaagcctgttttgcctcactgatgaccttgagcctggaatgacatcagccaaggaaggcagtgtctcacgagcagcggcagggtgatgagcttccacaaagaaaagcagtcttccaaggactagtttttcctccaagggtctcagcactgaggtgacatttataactttctgacttaaagtcaatcccattgttctacgcagccccacattcctccctcagaaggagccctaatcgatgtggcatggaagaacttgtggtcctcttggcagccaccccaacttccgttcaggcctccgcacctcccccagtgttgtggggcactgaccgcctccccagaagtggcccgggctggaggttattgcctcatcctctccaatggccatggtcacatcacagcataggccagcgattcagtttgggccaatgaaacacagggaaaggtttgctgtggcttctgggagaatagctccctcacttctctgaaagagcttccagaaacacatcactcactccaaacaaggctgaatgtattagctgtttactgctgcttaacaaattatcccaaaatttagtggcttaaaacaataaatgtttattatctcacagcttccgagggtgcagcacccaggagcagcttttctgggtgactgggtggctgggtggctgggtgactgggtggctgggtggctgagtggctcatgctcagggtttctcacaagcggctgccatccctgaagcttgaccagggtgtaggatcagcttccaagctcagtggattaaactggccctgcttcaaaacttttcagtggctgtttcaggactattgagaagattaatgaatgatacatacatttcaaaatatatatattacacatatacatgtgtatattacataatttttccctccctctctctgttcttgccagtgcccaaactgaaattttcaccctctcaaaagtgatgggaagttagggtccaaccctcaccaagccccttacgatgggcaagtgaatcctctgctaggtgaggttagcctagtgctcggctatgccaaagtccttcttggctctctcaagacaggcccatacttatagtgctttctcctcccactcctgcctcccacattctgtaactatcctatcattctcagagtagagggtgtacacatttagacccatctaaacgttgcctaggacggggaacatgattttattcattgcaggcagcttggatggataaacagaaaatccaaatcacagacttaaagaagatagaagtgtattctctctcccataaaggatgtccaaggctgggcagtccagggtgagtgtgtcagtcccagcaaaatgccaggctccatcttcctgcttcaccacgaagacatttggttggcatttctaaggccacccgatggtccaagctgctgctggagcattaaccgtgttgctggccagaaggcggaagaactcaagaagaccaaaaggggccctccctgaagagccagcttcatttaagccccttcctcaaagtcccacacgagtccaaccatatctgattggtgggaacttaaccacattgaggcaggagaatagggaattagggcaaccaaggattaaggtaggaacaaaagaagagcaggtgcagccagttcacataagcaaaaggcacagcaggtacagccaattctaggcaggattaggcaacatacaggccacatcttcacttctgtgataaccacaggccaagtcgccacttaagcctctaattggtcacggatcaatccttcattggatgtaactgattggaggcctctggagggcaccgggggtgttcatgttctttagcttaataaaatctctaattgaaggggctcctgagccacttgctcaagcccactcttgctctgtgaattgtacttgcacatcttcaataaatctgtgccttcattactccattctttcgttgctttgtcttttgttgctttgtgcgttttgttcaattctttaacatgccaagaacctggacaactcagtcaagaccttccattcagtaaccacatgactgtacctaggtacagggaggtaggtacagggaggctggacaatgtcgttttgctctggatggcaatacatccgctagcagaggtgctggccagaccatagacataataatacagttttgtatcatgaaacaagcaacggttttggagccacatggactcaggttcaaatcctagttcaaccactgagtggtcgcgtggcatagggcaagacacttgagctacttgagacttaattttttcatatttaaaatggagataatcagacctgcctctcagagctgttgcaagataaaaaaaagcacttaaaagattcagaggttctcaaagtagcccacctaatatcattgccttaaacatcaccctcttgctcagcttagggtatggacaccatacatgaaaattaggtgattctttccctgtttgttttcacatgcacagctcagggtatttcactaagtcagatggtccccccgactccaccctatttctttctctgagggcatttcatctgtttcggtgtcaccccactctaacagtttaaagggaggagggagaggcaaggacctaagatgtttggagagaaatcagccctagagatgggactcaaggttatggcatttctcagcttaagtatcagatgtggctgttaaaactattattaaatagattccttttgctgtttggggtttttcctgtttgtttgtttgtttggccttgggaggggtcatgtggccatatggtaaagagacattcccaaggaaggaatgaaacacattgttcctgcccgggccagggcttatgtagtcagggattatgaagactgaatgttctgtgtcctggaggaaaggggtccctgctttggggactgtttctttttatggatcctgggctattccttctgtccaacaagagtgaaatgaagggaaatacgggacagagttgacatagctttaggggcaggagtaattggggtaaaggaggggagaagactggacccagaagtcaaaggcccagagcccccggcaaaggagtgttgccaggttgggagcctctgcaaagggcatctctgagggctgttcctaggggcccacccattgcagccctcctatgagaacttaactccacatggtgaactggaacctgagccctaatcttagctacccagggcagcctctccctgctcctctaaatcctcatcactcctgtaagtccagaggaacccccacaccccaacttgaagggtgaatgagtacccaggcactccctgcctgggtgcacactgtggctccttgtccccctctatacattgcccaggctggctttgaactcctgggctcaagcaattctcctggctcggcctcctgagtagctgggaatacaggcgcgtgccaccgcgttcagcttcatttttatttttacagcttcacttcacttcctcagtgcaaacatgttaaaatattaaaaatttgctgtaaagtttttgaaaggatatttataattttgctcttgaaaccatttggctaggagtgactgatttaaattacaattgggaattcttgtgaaatgagaaaaacctagcccacacattctttcagatgtaatgaaatttttatgaatactaaatttaacagttaatgaggttgatataatgttacagttggacacttgattaagaatttattgatttccattttgcagtgttcttatttgagagccaatcattttttcttcagctgtgaaatattcacatgggcccttgggaggcccccgctgcgggcttctctagcgggcagtacataagtaaccaggccaacagctcttccctgtcctccccctgacacacctcgcacccctttacacaggcacataaggaaaaacacccatcgtggctggaccatggagacagagtccagttccagaggaggaagaggatggggccagtcagacaagggcacagaagccatgccatgccatgtcatgtaagcaagaagcttcttactgcaaccagtggctggggctgctaagggcactaagattcaagaccagtgagccacggaggttggcatgggcacctcttccctcctggggacagtaggtagtgggggcaggaggggaagggccacctgcctggtttacatagtcggccacagagcggtggcccacacttattcgacgactatagcctcagtgttccaggcaggtgtgcatggggccagcgggctatgagaggcttccacgtggcacaaggacagcaccccacaaggagaacatgaaaaagctaacacagtagcacaggcaagtgcacagtaccccagcctcccctcggaaccagagggcggagtggactgaggccaccctcagccaggtctgcggcagaagctgaggcagagaaatgccactttgtccttgctccagtctctctctcagccattcagataccgcttccttcactccagagcctcagccggcgcctctcagatcaaaccttgtgccactaggtggagccaaagcccacagcaacagcgccgggctcggacacccagccgcccgcgtgcaggaaggaggtgggctcgcgaggcaggggactgggggccccgggctgagtctgggccctaccggggggccaggaaaggagtgggagagccagccacagcccacagtggacttatttggtttacatggtccgttccgtccgaactcgcactgtaggctaaatggtcccagagccaaccccggcagccgcaaatccccgtttgtcagataaggaggctgagggcctgaggggaggatccaggagagccagaacagggctgaagccagagcccgcgcccctgtccacagagccttcccctgcaccgcttccgggatgtatcccctgcccgtggggagggcgcacgagaagaaggtgcggcttccagaagggagatcctgggaacgaggccgggagacacgcttggctccggagcctaggactggctccggggcacgagccgcagtcccctccagcacctcctggtgggggccgcagctgggatgctggcttcgggcgccggcggccggagcagcggaaagcatccacctacagaggctgcggtggagggggcggggcgggcgcggacccggaggcgccgcattggacgagggggttgctggggttctcggattggctggccatgagggggcgggaccaaggccagggctgagaggcgtgaggacctggagcgtgaacgcgtggggaaggcgcagagacctggcgcaggtgttgcggagccttctgagactggcctaagctgcagaattgatcgagcatctggagtggccatcggccgtgttgcccgcagacacaggtgtgctgcgacagaccaagctccagggtccctcaggtagccaggtgtgcggcacagctttgtccctcccagaactcagtttccccagcagggggcccggggactattccaatccagtactctggcctgcccctcccctcgctctcactgacctcccagcagccagaccaggtaggtatccaggctccttcctatcctgccccctgccccgctccatcctcatctttcccttaaagaaacctctctccaaggtccacggttacatcacatacagctttgcacacccagtgcccagcacagaacccccaccctctgtggttgtcctttcgcttctcgcaaggtccatgggagcaggggaccaggctgggacaacatgtggccccacctggttgctataaaagctcaggtaaggaagtttacagaaatatgttggggttactgcacctgtaaaaagtgaaaatggccaattatcatcaatgtcaagaagaaaaattgcccttgttgccctttcactgtagtaaagtgctgcttccaacaaaccagcacacaaatgccaaccacaggtgcattccgcttgggaggatgggggagaaactagttgtttgactctgtacaagaaccaatcaccaggtttccttaaatggcacactttctttgaaatctgaagcaagaaattacctctccggacacaaccaagttcatctcgtgtcctctcaggacatacagccgggctccactagagggcagcagaaagatggagatgctcgagagaaaaggagacttaagttagttctcaccatccgtggagggtgtgaggaacccaataaaaaccgtactggtattagttcctatttgttgactggttactctaggccagccatccctctgactgatctgttaaaaaaaaaaattaagtaatttgggccggacgtggtggctcatgcctgtaatcccaacactttgggaggccgaggtgggtggatcacctgaggtcagcagttcaagactagcctggccaacatggtgaaaccctgactctattaaaaatacaaaattagccggccatagtggtgcatgcctgtaaccccagctacttgggagactgaggcaggagaatcgcttgaacccaggagggtggcagtgatccgagatcgcaccactacactccagcttgggcaacaagagtgaaacttggtctcaaaaaaaaattaatttgatcctgccattaaccctatcaaggtggatacaattgtgttaaccccattctacagctgaggaaaaaaacaagttgaataacttgcctaaggtcacacagccaataagaagcaaatctgggatatgaaccctgaagtagagctataaatctgacattcataaacctatgcaattttgcttccgttgaagagggagggaaggatggcgagcagaggtggcagctgaggcccccacagatattacccttgtgggctctttaaggccagttccagaagcaggcaccagacaggagcatctagctaattaaggaccttgggtcatcaggcaggtagggtcagaaaatctgagctcaacctgcacataaaccccacacaccttgcaggaacctgtcctagcccacccatcaccatgggtggcccagctctccaataccctgggtgcctgccaccatggtgaacccttgtaaccactgtgtcccctctggcttagatgtgtgaaattgaccttgacccactctcttccttaccttataggcagccttgcctgcctccaccatcagccaggatcgggcctcctcatgtcagtcaagaagatgccaatcagcagcagcaactgctgccaagaagctggagtccaacaaggatcaaggggatgctggtgggatcctttccagggcaaccttgagaagagtttcaggccagagcctaatcctttcctgattttcttcccaatttaacatttactgagccgctactgtgggcaggcaccttgctgagtgcacaagggggacttgctgggtgatcttgagcacactctttaccacccccacctcagctcttggttagtttctcttctgtaaactaaggttgcagagaccaggggttctttactcgggactgaagggtcccctaaaattgggtgtgtgtgagaacatctttctggggcagggtttctcagcctcagcactattgatacttagggccagatcattcttagatagatccctcccagaacacacctgtgggctggcatttgcgtattggtttgtttgaagtagcactctgctgtagtgaaagggcaacaaaggggcaatttttcttcttgacactgacaataattgaccatttccagtttttataggtgtgttgtgacctttaactccaacacatccctgcaaacacccttagcccaaaatctgacctgtgcattgcaaaatgccaaaacccactaaatgcctctctgaagcctcccagccccacggcctttccacccactccacctgctgtggccaggctgggaggggtgcaggaaggtggcacactgccatgtacaatttggaagaggaagagccaggaacccctccaggcccagctctctgtgagccctgccaaggccacctacacctgcctgactctctggggcccctcagccctggcctgggaaagaggcttcgcccaaatccaagatgcaggcccctgccacagggcttacctacacccctgtgagagccctgggtaggggtcagaaaatggggcagaggccagagccagcactgggggcagaagcaggcagtccctcctcccatggttaagcctgcatcctctctcctcctgcgcggtggcccttcctcactgagcacctgccaaatctgccaggtgcgaagcctgctgtcagggccagaaagtcagaggcaaattcaggggtgagctgaacagtgtttaacaaccaggtctctggactggggtgaggggccctgatttgtagtctttgcctatttctgtggtgcaaatattcctaccctggcagatataaagccagcagtattttgtcactgagcgtggagctggttcacaacatcacaaagtgtgtgcaccaccaggtgcaatagacacaaattaccttacgagcatgaataatggtaacatatagtaaaataattaggaaatgatgagttgctagtgggtatttccttttttaacaaaatgtatttaaggttatataatttaagtaccgacaatgactgtgcttaacaactcgttcgcaaaattctgaaaatgtggccaccagcacctatgagccggtaccagctggctgcaggcccatcactgggaattgagtgtggtccctgctctctgaaggcgacaggtctacccagggtgggccggtctgtggggggacagagggatgcatgggggccacggagaaccagaggagacactctgtgcaggggttcagggaaggcttcttggaggaggcagcattatagagaacaaaggggagggtaaatatatcccagaaaagggtaaggagagagtgccaggctagagaggacactggggaaagaccaggagaaaacaaagtgtttggcgtggtccaaaaactaaaaatgtgtgtctcagtctggctgatgggatggctgggttccagcccaggttctgctgctgatgcctctgtcacttggaccaagtccactccattctctaggcttctcgcctctgtcaaattggggtccgaaccagatgggttccaggcccgctggtgatctagacccccaagaagtctgcagaggggccttgtgaacatgtatatagctcatggaggaagtctggcccacaactgacacttcacaaccagatcttcccctccctcctcctctccccttcacccggttcccccaggtgatcctggaaattctggtttggcttcagaaagtaactataattacagccttttttttttttttttttttgagacagagtttcgttcttatcgcccaggctggagtgcagtgacttgatcttggctcactgcaacctccacctcctgggttcaagcgattctcctacctcagcctcctaagtagctgggattacagggggacctgccgccatgcctggctaatttttttgtattttttagtagagacgggtttcgccatgttggccataattacagtcatttatagaacactttgctgcctctcctaattaccaagctgtgcaattccagttacgcatgtaaggaaacatctcaggaacccctccctggggccagcctgtcaaccgcagcccccaggccagctggaatggagtgggagtgcccgtggctgctgctgacgtctccctcctggcttcctttcatgccagaccaggaaggaaaccttggttcaaaggcctgccctggggtgggtgtgggatgaagagagacagggaaagtccctcaagatgatgagcttgcgacatgggggaggggagagggactccttctggtgatgcagaaggcctccgtctacacagcaggtgagtcttagaatgccggggcgggtcgtggtttcacagcatgagttagagcttgttccccaggaaaggggctgtttaagtttagaaagcaatggtccttccactaggtacaggttccccggcctcatgtccatcaccaccactgaagctcccttagcaacagccctcaccctgcagagcagccatccagccctgcctctgatgcctcctgtgactgggattagtaccccaagcctctgtgacatttgggtactccattaatgagaaagcttttcttccatcaagataagcttccctctgtgcaatttcttttttgttgttgtttggagattttgttgttgttgttgttttgttttgtttttttgaaacagagtcttactctgttgcccaggctggagtgcagtggcatgatctcgactaactgcagcctctggctcccgggttcaagagtttctcccacctcagcctcctgagtagctgggactataggcacacactaccacacctggctaattttcgtgtttttagtagagacagggtttcgccatgttggccaggctggtctcgaactcctgacctcaggtgatccacccgcctcagcttcccaaagttctgggattacaggcatgacctaccacatccagcctcctctgtgcaatttttttccgttttctttttctttttcttttttttgagatggagtcttgctctgtcgcccaggctggagtgcagtggtgcgatctcggctcactgtaacctccgcctcccaggttcaagcgattctctgcctcagcctgccaagtagctgggattacaggtgcccgccaccacatccggctaatatttttttttttttttttttgagacggagtctcgcttctttgcccaggttggagtgcaatggcacaatcttggctcactgcaacctccgcctcccaggttcaagcaattctcctgcctcacctcaccagtagctgggattacaggtgcccaccaccacgaccaactaaattttgtattttttagtagagatggggtttcaccctgttgcccaggctggtgtcaaactcctgacttcaagtgatccacctacctcggcctcccaaagtgctgggattacaggcactagccaccacgcccagcctatatttttagtagagacggggtttcaccatgttggccaggctggtcttgtactcctgacctcatgatccacccacctcggcctcccaaagtgctgggattacaggcacgagccaccacagccagcctatttttttagtagagacagggtttcaccatgttggccaggctggtcttgaactcctgacttcatgatccacccacctcggcctcccaaagtgctgagattacaggcatgagtcatcacgccccacctcctcttttttttctacccacaggtcccatctcaagtctctggggctactactccctctgccctgggtgtgccaatggatactgtcccccctactggtcctctcctggacaggtgtccagctcccctaaacctcgcctggttccttagccccaccagtttctgagacagccctgatgtggaggctccctgggacttctcactgtacataccacctcccgccaggtgcccacactcagtcctaggcacagagctggcaatcccaaggggctccactcctgagccccagcatcccacctcccacaactcgaccatctgggtggcccccaggcccacacccatgccacacccaaatccaaccccaccagcttcctctgcccctgcccctcaccccaggcccctttcatccagtcttcaaagcgtcaaactgctgctccccctgctccttcttccaagtgtctccaaaccccacccctctcttcccagaccccgagccctgcccatcaggccaccatcctctgtcccctaaattctgaaaaggcccctccctgctctccccgcctaaacccgccccctcccatgtgtcctgagagcagcatagcgtggaggttaggggcagggctccagtgcattccatcccctgctcctccactcactgactgtgtggccttaagcaagctgctcaacctctctgtgcatcgttgtcttaatagtatctctctcctagagttgcctgtgaatagtctggttgccaaggaattcagagtggccgatagaggacagaagggaggggtaaaacaaagcagaaaggggcacaggagccaggtccttaagtccttaagaccttcaatgctcaactaaggcctgggaaatttctcctgagatgagtggagagccttcaggatagtcttaagtctctgatcaatgttgtgcctttggaatgtcttggtgcctatggtgcctatggaatgtcttgctttctttcctgcagagactgagagcccctcctgtcccaggggtgctgagaggtctgtctctggctcccccaccgctcccatgtctctgctgggactggtaagtcatggagctatgcccggcagagttctcttgccagactccaggcctctctcaccacaggagatcaggactggactcccaggggtctgacctgacttccaaccccaggagggtgggtggtgtccagcgagggcttgtctaggtcgtccagccttccgctgttggcctcagggaccatccaggcagcctgcccaagttactcttgacccctcctctgacacagactctccacctacctacaaagctctttcacaaatgtgtcattattttgtttaatcctcataacaactctgggagttgggtgttattatcccattttacagttggcaaactggataatgtatgatgtcttacctactcgctaggagcccagtcacaacggttcatgcctgagtgggaggaggattgggggtgctcctccacccacctcagccagccaggcccagcactgagtgaggggccaagtgggaggggaggcagcctgtggcggcgggaggggggcccagggaagtggagggcaggtgggggctgctggcactgggacctgccaagtagagagcgaggccagaaggggctgggaggccttgagggcagggagagcaggaacgggaatgaagaggcaggctaggagcaggctccaaatctgaaacctgggaggaacctccttgagtcaccctactctttgtacagatcaggaaattgaggcccacccagtcaggaagagaaattcgtctaaaaccactcagcctgccagagaccaagccagaatctgtgccagagcgcacccaggctgttcctggagaacccaggaaccagccccacggggccaatcagctggcactgggctgaccagcaggcactgaatgaaacttctagcctccgggcctctctgggtggccagcagggggcggtactgccccaggagtgacagctcccagactcccagccactgccctcaggcccatcccaaggtcccagggcagaaccagggctggggacacagaaggcataggtgggaggcagggtttctggggtgggaagaacagcacacagagctgagcatgggactccccggccccattctgatgccagctccttctaacctgagcgagggaggaaacaagcccttcctttctccttgcacctccaccagttgagagaacattctagaaatgcacccagctccatccaaagtctgctctctcgagaggggaaggggctggagaagagactgtctcccaggccacaggtttccacagaaagttgtcctgcaaaggaggctagacctaaggagaaacttctagaggcctctatactgagtatccaacctcaattccgggagtgtccctttcccaaaataatgctctaggagaaggtggggaaagggtggccaactgcagtgctatgtgaagacaggggctagatgtccttattgctgtttcaggaccctcttaggtgcgacaagagagaattttctccaggatggctaaagaagagcaggggcatgggggagtgagcagggccgcaggggtcaagaagatgagccactctggcccccaggagagatggccagggtgcagggggctccgtgtcacccccatcagccctgggacccttcccaatggcgagggcttgtattcctaaccaaacttctggatctggtcccagcgggaacccctgctataatgagtgcccccaaggcctcccttcaaaatcccaggagtccagcttctcggggcaaaagccccacagcagctggcaatacaagatctaggaggcaggggatcttgaggccccaggtcagaaaggccccacgcacctgcctctcccaagatttaaaataccagggggctaggggttcccatcccctgctactaggcttcgtggtggtcctcagccccaagcccactgtgccctgtgcagcatggacagatggtctccaaggggcccctttcagcaccactccccttggtttcccatcaatgccaccatacaccaaagttcacacactgtctactggaaagcccctgtcagggccagttgtcctacaattaactcttcagttctcccaggctgatggttccaccacacagagagcagacagggtgggcaggggcttggggagtcacagcaggcacccagggacagaggggcaaggaaaatggagatgggggcacattcagggggtggggacagcatcctggcaggtcccgggcctgcaccacctggaggagccggtgactcacggggctgacagaagaactgaaaccagacaggagagtgcaggaaggaggaagaaacacccaccaggtaacctgtgtcctcagacatgtgcacttccaggccagagtttctatgaatcagtgtctctagacacaaccaccttgatcccttccgttgcctcatgctgacgtctgagtctggcccgtggccatctaaacccccgcactctggttcaaccaccatcaggcccacatagcagctgcttcagatcaaaaatctcctcttcaggggctttttcaccaagctgatggtaaaggcaggactcctgggtcccggtgtccactgcagccactctggcttccccttagcccctctgcaccccctgctcaccacctggccagtgtttctgctcttccttctgcctagcattcccctaccacccctgctttgcctagcaggtacctactcatccttcaggtttcaacccatgtcacctcctccagtgagctttctctgacctctcacctaagtcaaatcccccattacatgtgctcctggcaccatgcacccctctctgagccctttgtagagtttagttgtgtggttagtgatgagtgcctgcctcctgtactacagctgaagctccaggagggcagggaccagggcctggtctagttcaccctccattgtctctgcagcatgtggcagagtcagtgctaggcacatagaaggccctcagtaaacgtgctgtgaatgagtgggttccccagccagctggatgtcccacggtttcccccaccccaccccatctggctctagctcctctctgtgacccttttcatctgcagtccttggagcctcctaatggttgggctctgtggtggggaccaggcaacctgcccctggggcctcaagatcaaggcaagacacaagactcaatacccctccaacaggttacaggggcagcctcagtggcaccaattgctctgacccgtgactcagaggaagccagtcctccagagcccacatccagtccacatcctccttgatgattttgcatccagctgctgttccaatctcagggcctatggccctcagggactatccagcctccacctagaaatcagacgaccagaaatggttaggacccagcccaaggtcacacagcatagctgtcacagagccgcaccaagaatccagggcgccaactctagcatagggttctccccatgctataataaatgtagctatttttaggaagtgaattagcaagtcaaatatgaagtctactaataataccacatttctgcttttcagagtcttcatcaccttatttgctcctgcaacatcagggtgggctgggcactgaagtaggtggtgagctcatctgaaaggtgtggtccagagagaggaagtgactggtcctgaaacgcaataagcccagccttcctgcccgccctgctcagtggtactcccagagagggtgcagtgccccagaagtccccttcccagggcctggctggcagcctcccacctgggcaggctcctcggggcactcagaccagccgctgcctccctcgcctgttgtcctcttgaccctcccaccccatcccccaagctgaggtcagcctcctgcctttcctggcccctggcagaccttgcttctgtgctagctccagcccaaacctgcattctcacagcctgtgggcctcaggtggcctcaaggcctggcatccagttgtattttttcccctgcaaattccttagcacatgccaggggtagctctgagcaggaaggcacgggcagccagctttgcagcctgagctcccctcaacttgggacctcagttccccatcaaaagggacaacagcctcatcccaagaggggctggagttagatccagcccctagtcctgcagccccatctcctaccccttccccctcccccacagaagctcctcagacatctggcagcaccagacagggctggatggacggaaacatgaggtcagatcctcaattgcttcctgagcccttcccagaggagcagggcgcttcccaactgggaaacagctgagctgctccataaaggaaaccggagaggcggggagggatggagaccattgctggcagaggaagcgacagcgcccctatttctcagatgggcaactgagccacaagccataggccagcatgctgtggccaccacaagcccccacctcttgtgaaagtctctactgagcccaagggcctagcatgagccaaggagggggttgggctatggctaaaaggatatctgggccagctcccaggagccttgactcccaggacagggacctgtagggatgggtccttcactcagactcatgctggggaattctgcagtcaggaaggcttcccggagaagggtgctgtggggggctcaagggcaacaaggagggaggaaggcattgagatgggctcagcaggtgcaaagggcagagcagaggaggcgctcagagatccccctcaggtaaccgacctggcctgtctcgcctcccggcaccggctggcttgcagaggaagatctgggctcattgtccattgtaagctgggtatgtcccagtagctcaggctcctggaccctgctgggccagcagggaggggcgttgtagcaggagggagacaggccaggccatcctgatgaggagagaggagaaggaggggcctccccagggtggcaggcacaagcctgtccagggaaacccacagctgcacagggggcaagtgggtgcctctccctctatccattatctggcaggatgagatgggcactctccttgcctaggcccagacctggtccccacagccgggaccccccacccggcattgtcctccctagggagccatgctggttgtgggactgcggccatgcctggcaggggatggtgccgatgctgacacagcaagaaccaggccagccgtgaacaaagaaacatgggaaggggccacgtctgcaggagtcgttcctgaggtggcggccagcaccgtggactgtaggctgaggaggcacaggacggcctctccctgagtgttccagccagcatgttcctgatcagatactcgggggccaaagctgatcaaggccctcggggcacagctcagtccaaaaatccccatcacctccccccagggcccaacccccttcactcgtgacagaaaaggcctctgaatcacctctcaaccctgacagcagggtccgctcaccacccccactttttttgccatgatccccctcagggtgggaggcgagactggacaggaacaggggagcccagaagggcccatcctgggcccaaaggcagacagcacccatacagcaggggctgcagtgccctgattggcttgtggcaggtgttgtgggggaggcacccagtagcagggcagctggccaggtgtgggagccctgacgttgggcctgtcacacagcatcagggaaggagctgctagtaccggtggggcgagggctgggagcctcggggaagcggtggcttttcagctgagagagcgagaaacattggctgaagtggagttggtgccccactttccaggagggctgcccactgcccgcagggcccccggtcagggcgggagggctcggcaccgagaggtccaccgagccagaccaggcagagagagcacatggaccggcggagaccaaggtcccagagaggtggggaacaggaggcgccccctcccctgccacatgaggaaagtgggcatgctgggcaggaagggaggggatggtgccagagaagagtgccagcgtccagggtgagggaatgccagcaccatagactgtgggtggggcaaggtaggcaagtccagtgtggctccagggtacctcagatgctgagatgtaagcagggtagggacattttatccatagccaggttctgggagtgcccggggacagcattacccttagatgcaagcaagaaggagccctgccctggcacctgcattctagaggattccactccagccttccactggccttgcccctccaacagggaaataaagtccatgagccaaggaaatgtgtccacccgagccccacatcccccctccaaatgcagaaccccagaattccctgcccacagggccccaaatctaactccacagcccacgtgggcctttccgctgggcctgccttcctgagaaccgacctgcagcgggtgtgcacaccccaaggcctcgggagtggccaaggggcagccactgctacgtatatggatgggtctgggaaggtcacacactgcccaagggggagcccgggatgggagctggggttggctcagcctctgcctgccacattccagtcctgcattccaggagcccaagaattctaagtacaaacctggtcctcagggtgttatgaaggtgtatttgctaatgtaggaggatagagcatatcctatttagaggttgttggcttgatttataactttgaaatatccagacatatagtatgtgggcctccatttttactcctgccctgggcccaggcaatgttaggggtaggatcagagggcaagccctggcccctgccccacccctcaggagacccctgctctccagccagtgagcgctgccgaaggagggctgggcaggaagccagcagccgagggagcccatatgcacctgtggacctagcttcagggctggtgggacctagcaggctgggtccttggggctaggagcaggggaacccgagagagcgcttctcccagggttgagcttctgcttgaagctgggaaagccacagagaggctgagcttgtggcccagggacacccagcctggatgcggctgctgtgccctccccctggaggtccctcctgcttccaaggctcacccacctgtgcatccagctcggagctcagggtgcttcgatcccttttttgagttcattcctgtggccaagcccttcccccacggtttcccatgctggcacctcaggaggatcctgccccttgttccctacccagcttcaaccccttcctccgaggctccaagccccctcacccccctcactgcaaatcacctttcttccattggagccaggatcttagctcagggagcgaccccagccccagtatacaaagagaagcctgcggcccacagtcccagagcgaggctgcagctgagcccaggctaggacgggtctcctgccccaccccttcagctcagggggcatcacccacctctttggagcctcacagacccccctggttcaaatttccactaacactctctgtgatctcccacaagctgctttatattctgagctccttcatttatgaaatgaagataataaattttgccttgtaaagtcgttagagggattagataaaatacacgcataggccaggccctatgccaagaacaccttagggctgagacctccttccctgcctcactctggcaatggacattactgagcagcaccaggatcccgaggcccagacagatgtgcctcttgccctccaggagcttccctcatgctgggaaaacagacaccagccaggaacccgcaggaggctcccagagacggggagtgtccaggagggagacgaagctggaggcaggaggggagggcaaggggttgagaaggctggtcaaggagggcctctctaagaatatgccctgaggacctaagggaaccagttgtgcagcatgtggaagaagaatgttctagagagggggaactcaggacggtgccttgcaggttctcagaaacgcctggcgcttatctgagcacacactcacggaccctgttaccacaccacagcggggcctctgtgtggggctgataaggccagaaaagatctcaagatattttctttccttttctgtgagtggcctgagataggctgtgtggggacatttggctcacggcctgcctcacaggccccccccgtcaccagggcaccatggagcactcactgctggacctcccagtggggactcgggattggcccccgaggggggctgccagccagtgctgggggcccatgcgtgacggggctgacctggctcccctgtcgtgacccacagaggcctgctctctgcttgtgcagtctctgcctgctcgagtgtacagcgtacaggctctgggctcagagatgagggctggaagccagctatgtcaccttcattccctcacctgtaaaatgggggtgctgacagtaacatcgtcctcagagggttcctgtaaaggagtgggggagatggtgctagagcctggctcatccaaacgccaggcaaggtggctcacgcctgtaatcccagcactttaggaggccaaggtgggcagattgcttgaggtcaggagtccaagaccagcctggccaacatggcgaaacccccgtctctactaaaaacacaaaaaattagctggatgtggtggcgtgcgcctgtaatcccagctactcaggaggctgaggcaggagaacagcttaaacccgggaggtggagtttgcagtgaggcaagatcgcgctgctgcactccagtctgggtgacagagtgagactccacctcaaaaacaaaaacaaacaaacaaacaaaagctcagtaggtgctacttcctttcttacaggacctgtgcctcctgggatgacccccaccatccacccctaggcaccaggactgagtcggctctgaaaagaaatggggaatgaagctttgggacttggttcctgccttcagggagccaatggtccagccagggggattagggttcatgtcccttcctgggcctccaggaggtcatgaccttcaaagcaagaatgaggaagcccacgatggtagcgtggggccctgcatgaagtgcctgtgacgggagatggaagaactctgtcatatgtccgtgagagtgaaaggaacctcaagcattcaaggaaaccaaaccggtacccaagatagatgaagagatcaggaatttaccaggtcacagaggcttcttggcagccacctgcaggagacggataacaccatggccagggcccccatgctccataccgtgtctgtgacctccacagactcactccacaatgtgactttgggtaggtcacagtacctgtacggcctcagcttccccacctgtcagatgggaagaacaacagcgccctccccatgaagccatcatgagcaccacaccaggtaaatcatgacctgctctcgtgcatgcagggatgtcaatgaagacgagttccttttccctgaagtgatgaaagggacttttagaaaagaggaagtgggtggattcttaggaaaccttagttccatcccaggcaagtggctctgatgattcagtaggtgacttccaggtgttcccaggaggcgcaagctaccaaagtcatgtcctctcacctgaattttcatccagcccaaccctgcctctggacacctatcccctcttgggacctcgaggccaggcctggagaggatgtgaacgcctggaggccctcccaagcccaagcaggaggtagacgcagggacagtgggcatcttccatcaggcagagcttggccaagattccagcagcacccaaagcctgctgagcaactcacagatgcccatgcctggcaggctggtctccatggtcaggccccagcctctctcttctgggcccctctcatcctgctccccaaagtcccacaggcttccctgcctccatgactttgccaaggccacccacctgcccccgtacactcctgcttccacctctgtgcctgcaggcctgccctacctggaggccttcccctgtgttctatgggtttctcaccacatggtctcatcagttatctatcaaagcggctgacgctccctccactcctgcctctgcccctccttgcctctgcctgtgttccccctcccatcaccaccttagcctgtctcccctccttcctcaggactcaggagccactgaggctgtggggcacctgccgacattctgcctggcctccctggcttctcagccttcccccaccgcctactgctgcctctgggcatcaaaccagctgcttgagtctttcccatcccacaggacccctctctcaatagccccacacccccacacctccagcctctgccctcggctctggaaagcacggtctccacccactgcctccattaaccccctcctccccatccccttaattcctgggatctaacccctgccccaacatcccaccgaggccactgatcacctctctgctgttatgtctggggcacttcactgccacccctgcctccactcctcaacaccattccaaagcacagacccttttttctttctcttcttaaaacatgtgcccatactcctggctcctgaaacgcccacccagatttcctgtcacctccctgcccactccatcactgtccccttcaaggttccacttcctcctcctggggccaccctcaaagaagccccacccaggggtctgtccttggcctttctcccctcccttgcctccaccctgggagacagacctctcccacccctagcctgcccctcctcctgcatcctcaagccccccaccctctggctattgaggtccagaccacctccaggatgtcccttgagatgccctcccttctctctcccttgtcctcagcccagatgctgaaaggggcaccagctttcacccctcctgatttcatccagtctcaagccgttagatgctgtctgtactgtccacacccaaacagacgcctgactgtcctccctcccccagccaggcctctcctcagccgcccacatgacactccacttggatgtataacaagcatctcagccgttccagctcccgctccccacagcaccccaacccgcttcccccaccaccgcattctccccacccccggctggcagctttctccttcctgatgctcagaccaaaagccttcgaggcatcccagacccctctccctctcccatccactggcaaaccctactgctctaatctcaaaggagacccagagtcagactgccgcccccaccctgggccaggcccccatcatttctcatctggatcattgcaggagcttcctaattggtctccctgctcccaccttttcactcctgcccccaggtgttcccagcacagtggccagagccgtcctgttcagatatgtcactggatcgcacctctccagttgacgcttcccaatggctcctgtgtcgctctcaggaaaagccggggaattattgcgtgccctggcctccttgcctgcatcctctgctctcctccctgcaccctcctctctctggctgcactgcagaggcctcccctggggtatcagttgaggcaggctggggtgtgctgtggtgaccatccctactcactgggccttaaaacagagaggggcatttctcattccagcttcacgtcatgagggtcagcagggagggctacgctgcatcgtcctctctcatgaccatgtcggggacatctggagcatcacctgcttccaggcagggtgaagggaatgtggaatcactcgctgactcctgcatgcttcagctcggaagtggcacgcatctcttccactcgtatctcactggccaaagcagattacacagctgggcctaaccccaaatggaagaagtgtagcccttccctgtttccagaagaagagacaggcactgatggacaggggtgacagcctccccgctgctgttcctcgaacgcgccagacacgccccagccccgggcctttgccctggctgttccctctgcctggagtgcccttccccaaacacctgcacagctcgcccctcaccttctttcagtctttgttcaaatgtcaccttcttgatgacgctttccctgaccacctcacttaaaacttcagatgtctcctggacacgggctgccaatcccccttacctttactttagctttccacggttctaacagattacctaattacatatttcttatgtctattactattgtctgtttccatcagctagaaggaaagccccttgagggcaggggcatttgttggttttggtgactgatgtaagcccagctcccaggacagtacctggcacccagtaggcactctatacttttgctgcatgaatgagtgaatggattaggggccccactcaccaccaggtctcgttcccacatccttcagagcttttcaatctacacttgaatccccaacccaaactcgctgccttccccaggccctcactgtttctcgtctgggtccccaactcataacagcccctgactgtccccggtctccagcaatccccttccaatccaacaccgctgtgaaaggcaggatagcaaggtgattctggcgtgggctcagggtcctttctctggctctgctgtttaccagcagtgtgactttggactggttccttaaccttcctgtgctccagttccacatgttgtgataatagcacttctctcataggggttacagtgctgagaggtttaaatgagatgctgcatgcaaagcacattataaatgtggattattgctttacacttgccagatcttggtaccagacaaaggagatccgaatctgctgaaaactgtcccttggctcctggtagttttcagtttcttctctgcacccaggggccctcccaagctggtctccttctcacttgcctggtctgtcccttcttgctcccggtcccaccaaactccccagggcctcctgagcccgtcatgctgcctcctgccctggcctgggcattgggtgttttctctactcttcactgacttttacttgctttcttacttaacagaaatcccagagcttttttgcactttcatacacagaaaactttcagatttttttttcgagacagggtctcgctttgttgcccaggctggagtgcagtggtgtgatctcagctcactgcaacctccgcctcccaggttcaagcaattctcgtgcctcagcctcccgagtacctggtgcacaccaccacgcctggataatttttgtatttttagtagagacagggttttgccatgttggccaggctggtcttcaactcctgacctcaagtaatctgcccacctcagcctcccaaagcgctgggattacaggcgtgagccaccgcacccagtctcacattctttttagagctgtcttgaattccatcatggggacataccattgggatatatcagtcccaagctgatggctattaatgtttttgatcttctgccatcacaagtatgcagcttggtgtgtgtgcatctgtcatattcgttcgggtgtctctgtaagacagactcctggaagtgggattactgggtcaaaggtagctagtaaagcacgacgggccttgccagcccagtgtgctccccaccagacccaggatctagccccaagtctgagtgatgcagaattcacgccctcacctctgtgccatcctgcctccttcagcagtagggctggagcgcatggtgaggggccagttctactttctgcctcagtcaggatcggtccacttgagcgtgatatgtgggggccgagccgggaggcgttggagctagccgaggagatgaggccagcccccaaacacttccagaacactctgagccttcatgaaggctgcaggagggagcatggcctcttgcccacattctccccacctgggatcttctctctggcggctgcctctgcctccccatcagcgccagagcaggactggcagtggcaccccaggcaccagtgagcaggctacagggtccgtccccacctagggctgcatggtcagaccccttgaagagggaatggcagaacctcaagaccttgggtgggagggcagcccaggagagccagccccaggccatgccatggctccgtggctcatgtgggcagccccccactggccctcacagaggcagagctgagtcagcagccagggtcggggtgcctctgaggcccaggcctacttcactgggaggtgtccctgcacagaagtgagagggctcaggaggggcctggctctctgcctctgctgcttcaggaaaagtcctgctccttggctgagccctcagggtccttctccagccccctgcccaccgcctgccctccggtctcctacaccccctcacactccagtcagtcatgtggaaatgcttgcagttctccacatgggttattccactgcctgcctccacgcctctgaccacgcagctccttcttttccagctaactcccacttgtccgcaaagacaattcaagagtcccttggagcagcctgttcgcacctatgcactcacacagcaccttgtttgtttagacccgcccagtgcctcacagcaaccccatctgggttcactgtcagagctctgagcccacggggctactcgtcccaaaggcatacagcatgtcccaacatctgacttcgaagctgggacaggcctggctccgggagggacagaggcttctacctggggtagctgagctgtccaaagaagtttcagccatgtcgagcccctggcgttgccgaaatcccccaccccacggtgccacagcaccagggcagcccctaggaaaagccagcccctcagaggccctgtgctaaagaccagaaattgcccctgggtctccgcaggagttctgcaatggggaagtgagccctcctgaggcctggctggcaggaggctcttcaaggccagcatcatgtggacttcccccaaccactcgcgtttctgcacagcagccacggagacctgggggctgctgaaaaacgagatcagaaggcaacgtcagcctgagtgggctgaaacctgagatgaggaaatgagaagacgtcagggggctggaggacatgggtttgaggacagccagcacccagcactgcagctgaggcctcctgagggagccagagggaaagcaagtcccctccctgcggcctgagtctctgccagtgcccagcactcccaaaggatccaccccaacctgagagaccccaaagacattggagcagccccagacacctcctcccagggccacaaaggcccctgacaagcccacagcagtccaaggcctccaactggagtcatctttggtaaatctggggcccatcagcacccactgcccttcctggtgccctaagcatgctggcagggggactggaaactgcatcccagtttgcagtgggtgtatgtctcatacacccacaatacctgatgtgggcgtgactcaccttggggacctgtgagtcaataagggtgtatgagtaaggggcagagcatttcaacttagtcccatagcacatgagctcactaagcaaacattacctatgtctagatttggggccagtcactacccactggaggctgtgggctccaaggtatggcagcaggggaggccagccaggctctgcccagcttgcccctccttgtgaggacggacccagccaggcctcccgcatccgcccttagactgggggaccctgggtgggggtagaaagggggactgaaagtggtgtctggagttaagcccatctcctcatcccccaccatggggatcaagatgggggctaagagtcaccccaccaccaccccaacccactctgaacgcaaaacagaaggggacaagcaaaacagaactgaaactgggcaaaggagaaacaggtctgggcccgccccagggacctctgtatctcaccccttacccatacacatcctgaccagggcctctcccccagcctgggaaaacctttcaagcttggccctctctcacctgggctctctcagcctcctgccctcccccatcttccctgctcccagcctcatgctgccccaggcctcaccccatcagagctaaaaggaccccaggctgggcatctgtagatcagggatctggtctccctctgccactaccttttgggatgacctttgggaagtcattcccttctctgagccacagtttcctcatctggcctgggctgtgggcatagaatctgcaggtgagggctctaatgggtgagtttcaggccaggctgagacttttcacattataacactgaggcacccagcaccttgactaccactcatcctggggacttgggaagggacagaggctgggattggacagtaacagccaagaccttcccagggcacaaacgctgcctccctgaagcctgccctgactgtccatgcaggtcactcccatcacttcacctcctccttccctccactcagcaccagccaccactgggtcacatctatgtccctttggctctgcaagagcagcctggacccctgcatcccctaccccagcacaggcctgacaccaagcaggggctcaacaaaatatgtgttgaaggccaggcacagtgactcatgtctgaaatctcagcactttgggaggccaaggccaacagatctcttgagttcaggagttcgagaccagcctcggtaatgtggtgaaacctcatctccacaaaagatacacaaaattatctgggtgtggtggcatgcacctgcagtcccagctgcgcgggaggctgatgtgggaggattgcttgagaccaggagacggagattgcagtgagccaaaattgcaccactgtattccagcctgggtgacagagcaagaccctgtctcaatgtctctctctctctctctctctgtgtgtgtgtgtgtgtgtgtgtgtgtgtgtgttgaaagaataaaggcagagaaaataacaagtgttggtgagactgtggcaagattagagccctcacactctgatggcggggatgtaaaatggtatcacctctgtggaaagcagtttgtcagttgcccaaaacgttgaacacagagttaccatgggattctgcagtcccactcccaggtaaatagatgttccaaagagttgaaaacatctgatcacacaaaaacttgtacacaaatattcatacagcgttattctggatattattataacagccgaaaagtgggaacaatgtccatgtccatcaactgaggcacagataagcaacatggcctagccacacaatgagctctcattcagcagtgagaagatggggcgtcctggttcaggctaccacatgataacccctgaaaacagtatgctaagtgaaagaagtcagacacaaaaggtgacatgtacaattccatttatatgaaatgcctagaagctggatgcagtggctcacgcctgtagtcccaactatttgggaggcccaggcaggaggattacttgagcccaggagtttgaatccagcctggaaaacatagcgcgacctcatctctgaataaattatttaatttaattttttaaaaaatgtccagaagagacaaatgcatagagacagaaagtacattagttgggggacaaggaaaggggaagtaactgctaacaggcacgaggtttcttgggggtgatggaatgttccagagttagctagaggtaggtgtcatagagcattatgaatatactcaaaaccactgcaatgtgcattttgaaatggcaaaatttgtgttatatgaacctttactcaataaatacataaataaataaataataaataaataaataaataaataaataaataaaaaggcaacaacagccaccccagggacaggtttggaaagccaaacttgtctgactggctgggtggcttgtctatttgtgtgtttcttaaaacagcatcctacaggagaactattctttgctcagggaaacccccaccccctcactccactcctacctcgagacaaggcctctgaggagcagatgggaggagaggggctctggggaaacatagggggcattgcagtggggtgctgccctctccttgggcaggtgcccccatgatgagcagactcaaggtccagctacagtcccagctctggtacaggtcctgtccctttcctcagtttccccatctgcagtctgcctcccggggtctttctgaggtcagtatgtagcatgacagagcctgagaactgccaaactgccatgttctctcagagacccctttttggcatgcattccagatgtgggaccagaggttgggaagttcttcctttggtctgaccacagtattccacttggagacagcagtgggaagaggccttccactgagtcaccctgactcaactttcatcagcttcaggccccccgtgggggtccttcccccaccggatgctcactttgctgtaatggggcaggatgtgggttccctgctgtgggagagcagcccccacagcagctgctccctaagatggttctggcaggaaccaatgagaggagaaagctgatcctcaacccctgcaggggccctgcagcccaagcagagggcctctcagcccacctcggtcccaagtaggacagattgacaggtgacctccctgtctcagagcctcagggtgtcttggaacaagtgatcccatcatcttcctctgaggtccaagactcgggtgctaatggactctgtgtagggaaccctggtcactggggcagactctgtcccagacctgatctttgccattttgccagagtggcccacctgactgcttctctctgctgtgtgtatcacttgtattaaccgcgaacccagcaaagagagcaggagcttgggccgggcacagtggctcacacatgtaatcccagcattctgggaggctgaagcaggtggatgacttgaggtcaggagtttgagacaagcctggtcaacatggtgaaaccccgtatctactaaaaattaaaaaaaaaaaaaaattaaccaggcgtggtgtaatcccagctactcaagaggctgaggcaagagaatcactcgaactcgggaggcagaggttgcagtgagtcaagatcgtgccaccgcactccagcctaggcaacagaacaagatcctatctcaaaaaaaaaaaaaaaaagtaaaagtagaacccctgtttcttgaggacaaagattagatgcatctttttgttgtgaaattttggtaaactacttactctttctcagcctcagttctttgaactatgaaatggagacaatagtaatagtatcaacctcaaagggctggtgagaaaactaaccaagacaattcacacaaagtttcagaacagtcccgggcaggtgcgtgacttacgcatttggcttttgttcaccactattactacttgcttattgaagctgagccaggtggctgagcaatgtccctttctggcaaggagggtggaggcaagtgtcacatttcagaaagatccctgggctcctgttgaatctgtccccacaccaaaacatgcccgtgggggctctagctcctgccccagcagcgaaaggggctcctccttctctggtgcccagtcctagctcacctgctcttcacaagcctcctcccagcacagcctgcaccacacaggtgctcagtaagggggttgctctgaacagggagcaggcccacatgctgagagtggtggaggcgtgcaggctctgatgaccacctgaacccagactccagggcaggacaggtccttacagaccgtaagggcttcctgcctaccctcttcccatgcagttacctcaaccctgggacaccaggaaggttgagcattccaggaaagccccgacccacccaggaaacccaagtacctggtggggcctcatctggcccattgtcctgaaaggacaggaataaaggctctctcctcatggccacacaccctagggacgtccagcctccagctttctgtgggtggggcaaatgactgaggaggcttccctccctgcaggcgcctccctctggggcctcctgtggtccagtcgtccctggtccccagctctcaggtgggtcatagggcatctcagcaggaccaccaggaagagcatcaggaggggaaggagccagagagccctccaggccagtgcactgctaactcaacatctcatcttcctatctcgtcccttctgctcacctccggagactccccctcccctctcatgctcttcactggcaggttatgatggcccagagatccccaccagagtcccagatatcagtggggatcccagcctattcctccaagctcccagttgccagtgacagggaggcagaaacagcctggaaattaactgtgggttctccctgagcctgtggatacatggaaagagagcttcaccaccacccccttctctgaatatacatacaggatctgaggagggaggattctgtgtggatgcatgtgtgcacagatgtgcatgtttgtacgtgtgtatgggtgagcaggtcatacgtgtggtcccatgtgcccacctgttgtatatatgcatgcttgttttgtgtaagtgagcataagaggtcaagccagagagagaaataggaacaaggagagacagagagagagagaatagaaacagagaccaacagggaaacagaatgagactgagacagagaacaacagaaggccagacaggtagacaagccacagttccatcttccctggtgctggctgccaaggcagacaactctcctctcacttcattgatgttctgcctgtgtttatacccatgattggggtggagttcaggaaaggatgtatcagggctaggacgcccccacctccacactcacagggccagtcagggccctctgcaggggctgccatttcctcaagctgaggaatgggcttggatccctcggatgccttccagggtgcaggggcgctcccagtgactgggctcttgtggtggctggggagggggagctcctctgacaggccccatgctgggggaaacgtcctgagactgacctatcacgggctgacatgcacaccaaggaggtctcacatctgctgggaaatgaggggctggtggaggtgagaaaacctcaagttctaatgccttcccaacaccttcacctcacctgagaagcttctagattccacccacccctgtttccttgggggagggtgttgtgtggaggtgggaagaggcaggagtccaggttctaggccaggctctgaaggggcaggtagctcagagcaagaggctggccttgcacctgctctgcctaatgggacagtaatgcccacgatggcattccgcctctgagggctgtggtgaggctgtggagagatgtcagggacaagaaaaggccttggaaaccagctgtgggaagaacagcccatgagctcagcatttcccctggcttccccgaaagccggcccccaggagaggaaggtgactgtgacttctgccgccaccacttcctgcagctgggaccctgctcactcagaatgtggaaccgtcatgggccagcagtgtcacctgcacactcactcctgccaccaggaaacccttctgcagggcaggtccccaagccccgtatctcaggttctgaccaggatgtgtcctcagcagtggtcgcccgacattgatgggagggacgggtcccagctgggcatcaggatatggagggtttcattccagctctgccaccaaggtactggttgcctcgaggcattccccttgctggacctcattgaggagacttcctgtattgctaagcaggcaggaaccccagaagctcagagccggaaggcaccagggcttcccacaagatgtggaggacccaaaacagggagacaggccctggcacctaagcgttccttctgggctctacacaaggtgtgggtggcaccagagctactgcaggctacttgatccaaggggcagtcctgctccaccgtgggctggacgaagacatcatctactccagggcatccacgcgtggggtgggagccaacagacctgcggtgctgccttccagcttgggactggcccccgtactccatcccgtgcacccagcccttccggctcaccccttccatggcatgttgtgctctctcgcaccccatgctttgcatgtgctggtttcattacctgcaacaccttcaccccacttgtgtctggctagcgtcccctccagaatggagagtggacaaaacatggggtctggaattccaggggtcagggcccaggctgttaggaaaggcagagtgtgaagcagaccctcagcaggcctcacagcagggagtgctgagctcagggttctcaggggccaggatgggacagacgccgaggagatgggggtcggtagctggggcagattgtgcagacagtctggattgtggaggagctgccgggcgcagggccccacttggcgcgggcggctgtgggggaggctgaaactgcagactatttttaggctcctgctgaattgagagatgaggatgctctgggctacaagccctcattcgctggggaaagactaagggggccccagttcccccgatctgcccccagagctcaaagtctccagagcttcctcttttgtctctagggaccaagggctggggtcaggaagtggactggaagtatccccagcaccctagataggcaaacacccacaagaagtgatttccataccatttgcacactgccctgcttcctgatcagaaggaacggaaacgttccctttcagaagaccctcagcggagcagtgcattcaccagagtccactttcacctgccccactgggtatcaggagagtcccaggagagcgacacaagctctaaagtcagaaagcacaaacgggggttgttagcactgtggtgtagcatccgctaggctcggggtagcaaataagttccatctgatcaattgctggtgactcctaaggagaaatgctggtgaggatccattcattcattccacaaataatttactgaccacctactgtgtgctaggtgctactctaggtgctatgaaatttagctgtgaacaaaaaaagacaaaattccctgcccccgcagagcagatattccgtaacagtgttgtccaacagaaatacaatatgagccacacacataatttaaaatgttccagtagccacactagataaaagttaaagaagaccaggagcggtggctcacgcctgtaatcccagcattttgggaggccaaggcgggcagatcatttgaggtcaggagttggagaccagcctggccaacatggtgaaaccccgtctctactgaaaatacaaacattagccgggcgtggtggcgggcgcctgtaatctcagctactcgggaggctgaggtaggagaatcgcttaacctgggaggcgaaggttgtggtgagccaaggtcctgccactgcacttcattctgtgctacagagcaagactccatctaaaaaacaaaacaacaacaacaaaaaaagttaaagaaataggtggaattaatttttgtatgttatctagccaaatatatcttatatctgaaatattatcatttctttttttcttttttttttgagacagagtttcattcttgttgcccaggctggagtaaaatggagcaatctcagctcactgcaacctttgcctcccaggttcaggcgattctcctgcctcagcctcccaaataactgggattacaggtacacgccaccatgcccacctaatttttgtatttttagtagagacagggtttcaccatgttagccaggctggtctcaaactcctgacctcaggtgatctactgacctcagcctcccaaagctctgggattacaggtgtgagccaccacgcccaacctctaatattatcatttcaaagtgtaatcgatgtaaaaatttaaggtcatttttttcatattatgttttcaaaatccagtgtgttgtttatacttacagcacatctcaattcagatgagccctatttcaagtgcccagtagcccccagagaatgcaagttctgaagaaaatcactcatatgagctcaggaaaggaatgccacaattgatcagcaatgcctgctccaggcataggctacagctgaatcaagctgcaagccatgtgtttccccaccatgatataggctcagccccaaaggacgtgttcacctctacctaagcccttctgagctcatttattttgcccaacttgaaagaactgccagagttctgggaccttgacttggttcgagtgcagcggttctggtgtgaacaccaccctacagaaacgccccagcatactaacagggccagcgcctcccgagtgtggttctgtgctccttcccttggtgggggctgactcatggccattggtgaccctgagaatgtggattttgtttttgtttttctcccaaggtctcttcctcccagagttaaccaatattgagataaaagtgtttccgagccagatttagccatttcagccccattccactggcccaagcctacagacctcctgtctggcactgtagccaggatggctgcactttcttttccagtaagcagaaggctaaaattggaccatttaaggagctagaaacacctggaaatggtgaggagtgggtctttggtgtaagagatggggtgtaagaaaacacggatctcaggctcccattatcctcaccattattatcattatcatctaccccacccctgctcaaaatccttcaattgctccctagtgtctgcaggataaagatcttgctttagttcccaggatcgggaactgctggagtcatccagtctcacctctagatactctcccttctctcatcttattcattcattcagtaagaatgtcctgagcacctaatatgtgccaggcactgttctaggtactagagatacagctgtgaacaaaactgccaaggatttctggcttcatggagctcactttactccagcgagcccataacaccccaggccctctcacactcccaggcctttgtaaatgctgttccctctccattcagtcactctcctcctggggaacttctacacatcctctaaggccctactcaaagccttccctgagcactccgctcaatgggttaggttcctcctctgagctcccacctcccacctaggaccgtcacacgtatggtcactgtccagcccacagcccttccctaccaggctttaagtgtctccagggcaggggctgtgccttctcccccagggaccccagagcttgcttccaggtgcaccctcccaaagatcaggagtgaacaggctgaggcattagtgtaggggggatccaggattcctctggagaattccatgtcattctgaaatctttgcctgggagcatcttcctcctggcattccaggggagggaatcacaggagcaaatgcagagcggttccagcaaaggaaggtagaagtctgaggagagatgggaagggtatgatttgatgtagcagagagacaagaggacagcagccttccctcggggagagaggatgacaggacatgtggatgggggataaaccgtaatgactctacattcctaaagtgggagggaggcagaacgaaatctgcagttccctgctgccttccccaggagagctgagctttcagtctcgtccctcttcctcctccccaacgagaatgcacaagagaggggagaaggatgggcctggttcctgcccctggcctggctctggtccctggcctggccctcaagaagccagtgctgggactgtggatatcgtgtggttatggctagagcagatcctcccaccacccgggcccagcctaaccgtcctgcccacacaccgccagctagaggcctgctgtgctgcttgtccattggggaaaacagggcaggaggcttgtgcctggctggcctcatccctgccagctcatttacatggaatttacacgggctcatttcatgccttaatgcacacggcttccctcccagcccagcctctcctggtgcctccacagagacaatggagtgggttccatcactcaaatcccctgccatggacccatcagagcaccaggagcatctctggaaagagggaggctgctgaggcccagagaggacagggaactcagtggagaccaccagcagcactccaggagggaccaaggcttaagcccacactttgtccactcgccgctcagaccatttggggctggaattcactcccatcctttgctttgccaccagcctccagcttgctgagcaggagcctgtgaaacccccatcctgatgccgatgcttggctgtgcactggaatacagacggactgggacagacgagatgtgcaggaaagggtccacagaagcccaggtccagccctgccttttacacaggagagaaatgaggctcgggaaaggcgagggtctgcccaggaccacaaacgccaaaaatggtggcagcagccccaggtctctgccccagctgcccagggctcttctgggtcccccaaactcccaaagacccctggtcccatgtacctgctgagaccttggtcccccagggcatgccgagtgttgggggagaaaaggatggggagaatcctcaggaatgggctggctatgagagtgcagagcaaactgaagtgggagggagcactatgggtgggggcaattccagtcctgtggggtttgccagagccaaccagaagctgggctcggacagagaagtaaactgccccaagtctgccatggacccctccagcagtcactgctcaggaaaaacgcctagcagaccccaaaggcctaggtccttgcctccagggacaggggacagagaagggaacaagggggaggggaggcctctgggcttctatctggacttctatctgcagtgctccctactgtccctgcccttcatcccaggaccactgctctcatcctgacctccacccgccaccagacagcctcctaactaactcccctgcatccttccaccccagcctcagaggctccttcctgcataaacttctgtgttctaaaacctatttacttgatcttggagggagtcctgagtttctacaactcaaatcctacctcatcactcataaaccctccccacaggtccctccctactctccaaccctcacccagacccctaccctgcctggagcaaatcccattcccacatctcttcagccggcaccagcctcctgcacacacactcaaggccacagcatcccacagggtcgcatttgatcagcttgccctccagaactgccccttgaaggcagggagtcctgaggctgtttctagcatgacccaggccaggccttccagggggaagtggtgggaggtgaaggctgggaatggggaaaaggggtgcacgtgctattggggctctggggtcaaggctcgagcaagcagcacgctgctgaggagtcgtgggttcaggtccccattcctgcctctcactagctacagccctgctgagctggctcctgggccctaaccaggacatgaaagaatgcatgtgatgctcacgcagccagggggtggcgagtaataaacaggagcccccaccaacaccccctgaccaggacagctttgcaggcaaggaacaggcgcaggtaaataaatagcttgtttattagtaatatgttacattattaaagtgcattgagaagaggtgcaggggccaaagctggaaggccactggccccagccactgccctgggtggccagacacagccggagaagggcccagctcccccctgaaatggatggacagggctgggggcagggccgcctgcctggagagctcggcccaggccatccccaccggaattttcacagtttagcctaagttataacatgtcctgagcgaaggtgggaggctaggagcatggaagcacagcccctggggaagggggctgagaggaagggaggaggccccccgccccccaaccctcaacgccaagggcagagtcctggaacctccccctgaggacccggctcgtccttccaaatgaacacggtgaaactagggctcagttttctccttcattctcccgtttccctcaccccaccccctcccataaccacccccaacactaggggctccaacaacgtccccctcagaccgggctcccagggcagagccagctcatgccactctccaagaacccatgcccgtctccagactcttatctcatccccgggagcctcagactgggatcacccccgctccccaacccatcccttcccagcccctccctttcccacccacccccccgcatgtagttttggtattttcatacagatgcagtcggaagtagctatacatgaaataagcctaacataaaaatagagctttttccgtccttccgtccggaaagcaaacatccttcaataaacatgcaaggcggctgtcctgtgggacccaggaccagagagggagctgcagaggacagggctggacagagggtagccctgggtcttcaggaacaccagccacccagccatgagagagggaggggaaggaggcaatgtgggtaccaagagtccagaaggactcaggcctcagccccagggtcgagatggagtcccagctctcctatccaaacccactccccgacccatgggctcttgggctgggagcatcgctgcatttagtcaagtttgaggagtctgaaaaatattttccagaagataaagtcttgggtcatcgatgccccagcttcacagtcggtgccctcattctcagcccctcaccatccgtgcgccacctggggcccagcagccgcctgcggctggacgtctccaggcctggcatcctccactgggttattctgtcccctggaagaagtggcaggcaaggagctcccgggccagccggctctgagtgtgagacgttctagtgccctgggctgcagaagcctgaggcatgcccagcctcgggaggccctagtggaccagcaagccaagagtgagtgtgggcagcacccccagccagagggaggcggccagggcacaggcatgacccagcaggtgctcggccatgatgccgtcctcgggcagcagctgccagtgctgagcctcgcggaagtaggagccctcctgggcctcgcagaagtagtggccgtactgctgcgccgtgaggttctcgatgaacaggatgcagttggggctctggtgaccaggttcgcagctctgctccacgttctccttgtggcgccatgagtaggtggcgtggcgggattccatggggcagctcaggtagtagcgagagtttggggccagggaaaccttctgcagtggggccttgtctggggaggcagtggggaagcagccgtgaggagggacaaagagctcccaggggaggatgtgtcctccccacggactgggatcccaggacaaggcttctgaatgaacgtggggaacccagccctcagcgtcctccttttttctcccgtctcgctcatcccaccaagagggctccctctgcaggactgtatcctgccccatgtacctggggcccacaggacaaggccatgtctccctcagaccaggacaatcagggcagggcagtaccccactcattgggccacagccgccagcagggccagatcaggtacctggtttggggttgggacactccttgtgtggctcggctggattaatggattgcagcactgacctggagtgggaaggacgaaagaggatcagcagatacaaggctgcagacctgaccctcctatccttaccccagtgcagttccagcagagaggagggtcccacaagaaaggcccagtaccgccacctcctccagcccgacaacacctccccctctcccatgcccaccttctcccagggacgagggatcccggccaacgtaccgttcggagctgtagatggagatgcagcggccttggtcccagccgcagtaggggtctcgggacatgaggcaaccgtggcagcccccgccatagacctcacacaggtccaggggcacctggctcacctcccactgggagctcacatacagcttcctctggaaggacagcaggattgggtcaggcccgggccccaccccacactcagtcctaaatgtccaggccctaaggcctagaagctcttaaaagaacacacaaatcacatgcaaaggagccctgtcctcagctgcagtcactgcatagcccatgggacgcagtgggggaaggctcacccgctcagcatccagcgacatggtctggatggcagccgcgcggcggaagggctggatctccatgatgttgaaggcgaagctgtgctcctgctcccccggttccaccaccttgtggatagtgcccctgtctgtgtatggtggacagagggtcagtgggcgggagtcccactgaggggccaggcagctttcctctaggccggggaggggtgggaagtcacaactcaggcaagggtcacaggactggtgtgggcagggcgaggagagcgtgactggggaagaatgtgggagcctaagggcagcctggaaccttccaaggctgatccagagaggccatcccaggaggcccaggggtccctggatacggcctccaacattcccaaggctgcacgggaagaacagaagcaggagccccacaccagcaaggtcagtgcggctgctgtccatgcatcacctcgtttaaccctccacagccctgcgaggtggctgtcatcttccccactccacagataaggaaatcaggctcagaaaggctaagccacttgctcaaggtcacacagctggtgagcagcagagaccgagttggaacccaaatctgtcagagcccaaccactcagctgcttctacaactcccctgcctcctggactcttagggaatatatttactttaaatacattttttttttattttggagtaattttagattcccagaaaagttgcaaagatagtacagagagctccaatctacccttctccagttccccctaatgttaccatcttacataaccacggtatatttgtcacaactaggcaactgacattggtgcattactattaacaaaactacagactttatttggatttcactagtttttccacaaatgtccttcttctgttctaggatccaattcaggactccacgttgcatttgatcttaggggatatcttaattttataaaatcttagatctaaaaaggatcttggattctaaatcaagagttcccaaggtcttataaccgagctgcctgcctcctagaccaatgctctctccgttcacaattagggaccaatgggcaccctgacccctggtcctcccaatcctacctcacctgctctcccagtttctagaatagcctacctccctctctccctccctcccaatttcccagggcatcacctgccccaaaaaagcagtcagatgattgcctgcctaggatgtttcctctacacatccgtgatcctcatctgtggactctgagatgtggccagatgctccttgggcctgataaggccccaccccagccactgccttcacagacatactgccctatacctccttccaaaccagccccagtaacagcatacccttggcaaaattctcaggaaaagagccaatacttctcccagttgtgagagcctcccattctctgcagaggacttagaaagctctatttttcagtctagcccaaatacgaatgatgcaggctccaaaatggtgcctcctccactgcccttagaacgaagacaccttctctaatcactcaagtgtgctcacctcccaagtctgcaggaagggaatccatggcccaagtccagccttccttgtcctagctcctgctcccagttccgcactgtgtgacctctcctcttctgctccccagtgccctgccatccctggctgaccacaacagctgtgccagccactactggagccaagcaaggatgggggcccaagggtgtagccgggatgaatagggagtaaagaggcagggaatcaggacccaggccctgccctgtgggaaattcctctccccaaggcttccaggagccaaacaatggtgctggggttccagtttcctacaaggtcaccaaagccgagacagttccaaggtgaagcagcaacaggagatcacatggggaatgtgaacaactgaggttgggcgcctgggcctgaattgaatggccccaggggtgctagaggccctttccagtctcaaggaaggcagctggcatgggaagctgcgacaaacccaactcaggactggctcctccgtgtcctgtggctttccagaaagcaggagcatctcccacggcattccacccagcttcccccagcagggcctactccagggaagaagagaagctgcccctgtcctctgtgagatggcaaaggttctgccccctggaactccttcctcatacctaatttgtgccccatcaactcctcaaatgtttcctctcacctgcacaatcccaaagacaggcgcagggcctgactccctcattctgcctggcagaggccagtatccctgtggttcaggcccctcctcctcatttgccacgtctcttcctaccatcttcttccctgagtcagacatctggaccaaaggtgcacctggctttgctcagactctccagatttccgcctccaaatcccagtgcttgcttttctcccatccccctttccctcttgcccctacctcctccaggaagctctccctgcctgactcttccacacccacacacattaacccctgacaactccagtcactcaattattccttccacatgtaaagatccaaccagatgttaactacattattccttacacctttcatgcccgtttttacaaagcaaactgagggtcccggggtagcctctcacctgtagttaggtaaagcacatgaaaggtctccccgtggctggcttgcatgcggtggacggccactttctggtagtggtatttagagtggaacaatggcgtcttcagaggccccatgggctccaccctctgcgccacctctgggtgacggtcagccacctggaaggtctctgtgggtatcggctgctggtctgggaggcactgggcaaggagagcaggcccaggtcagtggggtggtgggaggtgaggcagaaggagggctgggcctgggccacggctggtgtcacgctcaccttgccaggccgcgggttgggaaggcttgagtggtagcccttgagtgaggaggtacggaagaccttgtcaatgtcaccgagggaatacacacagacggctgagtagttcctgcagtgacatggagaccagctcaatggggggcccagaacccacccatccacctccactcacccaggccagccttgtgcctggcactgagttgccaaccaccactgaaaatggggagggatggagaggaggaaggagaggagttcagcctaatttctttgtgctgcaatttaaaaccacaaacttgtatcctgttacagaatcactgagtctagaggccatctgctctacccaaccccaaggcaggaggaaccccatcataggctgagcagttctctagccctccctgggcacaggctgtggggtgctgatgccccaggaggccagacccccaaccccttcccagcctgggggaccccactcacccaggagccacagagcagggtcttggcttcctccactctatccctaactctccccacacacacccaacacttccgcctgccgtgtgttcaatcaatgagagtgattaagaagtgtgaattatcgggctcaggcagtgcctgagcaggtgtaatagcacccagctccccgagagatgcttcagcagcttcctcctgggcccagtgtccactctcggcacaagcaggtggtgggacacacaggcacaagtgcagtcatgagtgtgcatatagggcatgcacacacacccatgagtgcagactcactcacacaacagtacatacatcgcactggctgtccccccaccccacacccagcaacagcccagcctcttgagcctgcagcccctgctcctgccacaccagggaggccctcagcagggcccaaggcctcctgtccctactggacactgaaccaatgccagccccggccccaggacaagggccactcaccaggggttggagaaaacaccatagaccctggtgtccctccactggccgctggggtcagggagcaggaagacgtcttgcagcctgttgaagttcttgttggtggcagcatcactgcataccagcatggctttcagaaaagtgttccacttggagactgacagtgaactttccccaccctggtccccctggaagggtagaggggagaagaggcccctcagcacctgcccgggcttccccacacaccccaggaaaccactgccagcaatatcaacacctgggcccagaggaggaaggcaggctgtgaggggccaggacctgccgggggtgccccaggactcagggcaggtctccagatgagactccagcaagcaggcctggctgatccagagcccagggccagcagtgcccagggtcagggcaggtgagagtgccaggtccccacagagcagacggactcagacacacatttactgactcacacacccacacacgtggcacagcacattcacacaggcaaaacacacacacacacacacacacaccccatcatacacacgctcacacgccatcatacgtgcacaggagctcagccacctttacccacacacagacacatgatgctccatgcacacacagctgctcccacagtccctgacacagacccactcatacatccacacaacttctacatgcacacggacacacagaactcaccctcactcaggcctattcatgcacagacacgtagccagcagccctcacgcccctgctcaccctgcacaactgggccacacgggacacattgagaggagcctcaggattcttgtcaggattgtcctctcggaagaagtagtagatcttgtcatcgtaagcctggtcttggtgcacgatggtggctttgatgaactgtgggtctgccagggacagaggcgagtgggcgtaaggctgggaagcttgcccgggagaccatcccaaccctgcacactctcctccctccttcgggtctgcacaaaccatggcaaatcagatctggaataggactcagaacatcaggtccaactccccgaggggccctagaccctgcacctccaccccacacctgttttgccctcttcctacaaagatgtcatcggcccaggagcaatgacttcatgcctggggactgggggaaggtccctgggggcccctatgtcacttctgctcaattggcagagccctgatgaggagggagttgggggctgcctccacgtgaactcagcagaggataaactttggctcctggggaccctgcactgggtctggggctccctctgtttgtgttcctgaagagggctgggcccatcccactgctataccttgtctgttcctctgctcccagccaaccctaacttctcaggcctataccaaggtcctgctttcctgcatggccccagcggccctcagggagccctcccagaaacatcaggatcccatctgccaccttaagtgctcacacccccttgcccaccctcagcccagccggagcctgactcactctgcatgacagtatcactggtgtacagctcactctcgccccggatgcggcggaaccgagggatcttcccattgtattcctgcttccggatggtggaatacacctcgtcccctggggtcagtgggagggagaaatgagtaagggcaggcagctcctggaagtccctcctccggacactggacaaagagctgaccactcctctcccagcccagttcagaagcatccccctggggcgcctgctccagcactgccctaccttcaaacagaaccagggagttctcgtccgggctgaagggggcgtagcctctcatctcgccaagtggcaccacagtgccattcacctgtgggagatccagagggttggatggccacataatcccacagccactgcctcccatgacggccagtttctcggccaggagccccatcctcccagggcaaggccagcattggagtctcgccatctccttcccaccatgaggggcagaagcccacgcagtagaaggtgagctgatcaggcacatggggagcagccttctcaccaggttccagcagctggggtgccgggcgttggtgccacaggccagcagcccctcactccgcctctccaggagagtgatgtagttctcgcagtcctgcccggggaagagagaagggaggagagaaattggttgctggaaggccctggcaagcctagcactaggacccccaggatcagggaagaaggtgtcagaagggcttagcataggtgacagcctcccgggacagcccagagtgtgtgcagctgacgccatcccctaagcacagaggaccacgtctccccatcagtctgggactcgtggggcagggccatgcttccttccttagaccctcagggtctcctctccctttaccaagtggctcagacccctccataccccctcccccactcacccgcttatccagacaggacccctttgtggagccgatattcacctgggggaaggggagaagcattagttcaatctgccaggggtgaggtacccctgaaatgctttccacacagcctcaggataagccccaaaggaagcaaccattattctcatctgacagatgagcaactggggctctgagagggtgagtgatctacctgaggtcaaacagggtctcatatccagagctgaggcccagagggttcagaagaccaggcatgggctctggggcccagcttccagcctgggctttccgcagcagcgctgcccagctggccaggcccattagctcctgtttttctccacaccgccccagctccccactccaatctggactacctttagggagcctcccccaggagccatttataggatacggaggtgggggcagtttaggaagagaagccagctccctcggattccctgaggacccttggcagggccagaggggagataagagggtagggggggtgttgggggaagagagaggctcaccgtgcgcacagatgcgttcttgccctcggggaagtcaaagaggtagaccttgccacgtcctcccacccacacagaggagctgcctggctcgtggaaaagcaccgtgtgcggctcagtctggccaaagtccacccggtcctgccctacatggcctgaggaggagacaattagtagaaacattgaagccaggtcccgagagagaagactctgggtcccctccacatggcacactggaaccagtgcttggtgctcagggtcctggcagggcgtcagacaagctctgggctggggtggtacccagactcagagagtcaaggacaggagaagtaagagatcctccggtgggctccagcaaccagctgtcctcacccacagcacggcccctcccctagtgtggcagcctctccttccttcacagtatgtgtgatctcagagtggggaaggatttagggacctcttgggggaacagaccccctcctctggcacacacttttgagggctgggctaaggcaggaggaccagggctccttggccatgctctgggaggttctctgctgccctaagccaaagcaagcagcgccccccaaccccgggcctttcagcaggcagcagggccttcaagcaccccccttggagtccaggttcccaggaatcacaatgctcagaaccccttctcctccttcaggaatccctctccaacctctcctggcccatccccagccccttagtgagcactagactagaggaggaaaggaatctcaacatctactccgtcccatttcacagatgggaaaacagaggccaagggaggggcagcccaagggcacacggaagcaggtcagtagcagaccctgaaccagagcctgcactcctgcctaccaagctggactctattccatggcccactctggcctggtttcacccatgaggatgctagctctccggggggtgaagatcggctcttcctccccagcaactctgggacaggggaaccttcacagagcacagcctgggactttcagcagaagggctgaccgggaaaattttccccaaaaaagaaactgactgcagccactgcctctggggaggtgtctcatctccagtgacactgctgaggttgtcctggttgcaggagtaaattatagggatgggatggcctgtggttgtgcccccagcaatcagccacacccagcatcttcccacctctgaccagcctgggcctcacctaggaactgggtctgaccactgttttttcagctgcaggaaactctggggcagccagcttggcagtgacacccaagctccagctctgaccaaaaagaactaccatttcctcaactctgcccccgatccctcttattcccattggagccatccctattgattctgcatttaacaggggcaaggagcagctggaccacacactgtgccaccacaccttcattctttaagaaacatcccttcatggccaggtcacccccggaagtgagcattcttcacctcttctgtggcctggcgcactgtgcagagaagaatgctgaggtaccctgggagacatgccaaggtcacaccagcaggcaggacacattagcttgtcccaggctgcagtatcagttctcagcagcatggcaggctacagagagaagtgctgagctcactgtccttgggtggtgtggctctcctggtgcacatcacaaacagcccaactgaacagctccggggatatcagccctccctggcccccaagcctccctccctgtaggcccgagatgtgcagagcaagggctgagaggtactggcacttcggtgggagggagggagagctggcaggtcttgggtgctgccctgctccccctcccttcctgggataaaattagagtgctggggtcacagacacagtcttcctgactcagctcccgtaactccccttccacccgcagcccaaactgcagccaccatcctctgtggcccagccagagatccagacagtctgccgccccaactcccctcctgctcccctcccatccaccgatagccagactggcagccaggaaaaggtgcgtgtctgcatctagagatgctgggctaggacctgagatccatagtccctgggagtcaaagcagaaaagttctagccgtcagactgtgctagccaccttcatcagtcaccttagccccactcctgcaccaaggccacaggcccaggtctccgagggggccggcaaggccaatgtacaactactcaagggaaaagaggcaccagacaggactctgggtgggggcaccctggtctaggaattgcagggctgttgaagagaagaggaaaacagtcctgccctggggagtcgagcctgatggcagagacatgactgggtcctggagagcaaggtctgagggggaggtctggccctaccctgggaatacatctgaggggtcagacagccacaccacagaaaacttccacagctctccagcaaaactgtcttagcatggaccccagggctgcccacaaagtatctgctgaagacatgaagggagggtgagggctgctggcccctgggtaggagctgcagcactagggcccggacaatcccatgcggatctgcaagcctgagcccagttcccttcaaaccctagccacaatggctagggtggaggaagcagggactgttcgtcccattttgcaggaaaacgaacaggagcccaggaccacggcctcccatgacccccaggttcctggccctcccacctctgttcttggtgatgcgtatggactagagggaatgacaccagctcagccccaggacaaggccttggcccattctccaccccagccccagcctgggctcccgcaccgcctgaggccctcaaaaggcctgattgtgcccgggaagtgtcgagcagcagcagctcgatgaatacatgaaaggaagctttgttcaggttggcaggagcgggggctgggggctaaggggcaggagggctgcctggaagtgaaggcagcaccaagccatcagggccaggcctcgagtctctgcccaggcaggggctgagcaaggccaggggctacccctaaaaaggccaggccaagggagtatgtatcatatccctgaacattttctttgtgatgctttatgaacccaaacggagaggtgaggtagataaaagctggatgggccctgaacaggccgggagggaaagccaggcagaggacgcaacctgagcaaaggtggggaaggtggctgtatggaggacagaggccatgcgctgcagcctggcagagtcctaatgagaagaatcgggaaggtgagctgaggcccacgtgtgatgggggagggaagatgcagcctgtccaaggacacactgacccactgcccaccactctcccctgctgcctgaacctacgagcagggccaggagtggaaaatgcctccccatcctctggcgtcccccacctcctggctccccctgcttcccatcctgcttgtctaaaaggagcaccgtctggcaccgtgtccccccctcactccccagcctgacgcattagtggctaagtggtagctaaaagctcccagaataaccaggggctcaggtaggggagggggctagggacatatggggagggcatagcccagaggcaggccaggaacaagacaacccacctcccgccccatgtgattccgagccaatcctcactcgtgctggaccaagaaagcacattcaggctgccccgtacccagccggactccatagttcccctgagtaccatttctcatggtggcagggccagcaaggcccagctccggccagataggagggctgcaaggatggctgggttgtaggagataacctccaccagacacagccgcagggccgggtgctcacagggctctgatcccattggaaagaatggggcctgactccttagggaccctaccctcgatcaccaccccagcagctgaccgactgtggcaagtctgggcctctggcatgcatttcctaactcaggcctgcctggtggagcacgtttcctcttctcattcactctggtgctgtcaccgtctggcccgctgtccccatactcttgttgtttgtgaaagaggagtgcagctccaggggagggcagagtgggaggtgttgttgtccatgaaggggctgggtcccatgctctggtctggcaaagccagccttgcaacctgacccactgacccagtgggccttgaatgtaacctcaaggagccttttgaaagtgggcagagagtcaggctctgaaaatggcaggaatgtgggcacccccacagagaatgcctaagtcaggcagtcagagaggccccgggccaaagagcagaaagcaggccgacctcaggttggagagccagcacatctggcaggagcgtcctcccacagttgtgcccccacccctgcactgccaggcctacctcacaccctcgcccaactacgtgtctggaaaagagagtagagggaaggcccacgtgatgcctaggaattagcctgcagcctctccaccctttggaatcccacatccacatgtcaaggtggaagggagaggatctaaacagtcattgaactgaaggacacagaggccagagaggctgtaccaccggcccaaggacacagagcgagggaagctccaagtttccagtacccattacccagctgcttctctccaggatcacatcctgggcttcctggagagcctctgatttgcaaaaagctgtatattcagcctctccctacttccctgaatcatccctactctacccttccctctcttgctcactaggtgccgagtcactaacctgataactaaagggaatcacccgcccacccaccttccaggtgaggccctgatctcctaggggcctttagtgatcaaagccttaaatccaaaggagtgactaatggtggaagtgtaggtgccgtgcatgtcagagtggtagaggaaacccttccactaggggtgggaatacaggaacaaatgtttctgtctctcctgatatggccaggaagagggtgtgagaagcctggtttccagggtggcaccggctcggtgctaaggataggtcatggttgcaggtgggtcctggcaactctcaggcagggttaggttctagattagctagtcgcctggcaggggcagagcctgtgtgctggggcaggtggtggggcctcgagacagcactcagctcatggaggactgagaagtctaacttgtttatgagctatgagaagagcgagctgtgtgctgggccaaaggggagcatcctcccacccaccaaggtcagctgtgggtgggaggggagtatatctcatgtgtggctcagccctggctccaagaagcctcattatctctttggtggctggacagctggctggctgtgacggtgattggggctgggccttcctgggttcattttcctccctgtggattagctgggtgcgagtcagggtgggtgctggtacttgtttgggcctgggttttatgacccaccaggattcttgaaacaaatcacaaaacaatcagggtgaagtccatgggtctttttgggaaagtgtgactctctgagtgccagagaagtcagacagttttctggaagtggaggcagcagaagaaactgacattctcatctgcttccactgaccagcccaccaaacctccagccaccctgcaaagaaggcaggacaacctgtattgccgttttacaaacaggaaaactaatgcccttccaagccaccaaggtctggatgctctccccatggcaccactgtgctcaaaggaccagaagaaggtttggctattggggagactgtctggggcaaagtcctagggagaagggacagtgtggaaagcaagccccttggtgagaggctgtgctgagcaggattcagggactcagggaaggaaggctggcactgaggcccagctggagtgggtaagatgccctgagcccacgcccagggaaggccggaagcccaggacaaacatcatgtcccatctaccttccagctgttctccagcccagcaggttccaaaagccccagagtggggccgaagtcgctggtggctccttcaaagcagacaaagggtagcggtgcagggcctgcccttgggcccacagccagggcaggggtcggggagagggcggagaatggctacacaaccccaagtggagggagggaggcaggtggaagactgctgagaaacagaaggttccccagtcttagccttagcctgaaccagcaggggagactgagcaagggcagccagccagcaaagcccattagggagaactggcaggggctgggctgccagggctgcattccatcagaaaccagagatgccagaggaggaggaggaagatgatgacgacgatgatgatgcccctaccacccaacccttccatcgcatttactacgtgccaaacactattccaaatgatttttagatatattaactcatttaatcatcactgaactctcatgaagtaggttcttttattatccccattttgcagatgaggaccatgagacacagagaagctgagtaacttacccagcattacacagctagtaaggggtggagcagaggttcatactcaggcaagctgactccagaatctgtgcttataacatcgtattccagagatgagcccttggaggcttccaaggtcagcccttcccagacagatgaggagaccaaagcctaccgagggtgaggcccagttagaggctacttggctaatgaagtcctgacctctgcccgtaacaccctgaagacagtgtgtgcaagtgagcacaggtgtgcaggcccaggtgaatgtagtgaattcctatgctttgatgttgccctggcatccgttttgaatataagctgggttttctcacactagaagcagggctcagtcaaccttgacaccgtttccagctccccacctcctcccagttcctccatgtgctcaatccagatatctaccgtagacagtcgtctcctggtgactgcttccctgtgggatggctacatacagcccacttgattggtcctgctgaccttgtcccacagcccgcatggactgtgcagataggccagtgaccttgtctcaagtcacaacatgacctcctggaactcatgactgcttgctgtaaacccaccaattaaaactccccatggaggccaggcacagtgggtcatgcccataatcccggcgctttgggaggctgaggtgggcagatcatttgaggtcaggagttcgagactagcctggccaacatggtgaaaccccatctctaccaaaaatacaaaaaaattagccagacatggtggtgtgcgcctgtactcccagctacttgggaggctgagacagaagaatcgcttgaacccaggaggcagaggttatagtgagctgagaccacgccactgcactccagcctgggtgacagagcaagactccatctcaaaacaacaacaacaacaaaacaaactccctgtggaaaacttgttttaataacaccatggaccccataaagatgctggcccatagatccccccaccctgcacatgctccctgacctccacctgtgtgtggcttcaggtacaccaggtatccctcaagacctgttagtaacaaaatctttatttccacctgcctctctcttaatcatggaagaggtgctctccatcttaaagatcctaagttacaacagtggggcaggaatcttctcgaggtgcagcgtggggccccggtcctgagtgactgattagaaagacaagtctcccaagatctcgctcagaacataaagtactctgtggggccgggtgccatggctcatgcctgttatcccagcacttcgggagaccaaggcagaaggatcacatgtgttcaggagttagaggctgcagagagctatgaatgcaccactgtactccagcctgggagacagtgagatcctgtctctaagaaaaaaagtactgcatgctctgaagctgaccacagtgaagggcagagtgtgctcaccagccaggtccccactcagccagccctggcgaaaacactcacctccactcctcagctcaaggacccaccatggctcctaactgcccatccaagcagggcccaaaacctcagggcagggcagtcaaggcccacctcatctctgcacagctctgccatggctcatttccatctctgcactttgctcctgttctcccctccctggattgaccttcctccttttctctgtgcacatggatcttacctgtccttgaaaatgtagctaaatcccttggatccaggaagtattccagactgctccagccctcactgcccgtaccttcgaccttgtaccacaaaccatctggcaccaccatcttcgctcagatcatgctgtctgatgggatttcatctggcctatggggccctgaaggtgaggaccaggcttcctcttgctccaagtcttccattcccagggagcagctcagacagtggagagaagcaagactggggcaggccaaactcccatgccagagggacaggtatcttagaacagattcctgggccaccaatggagtgcagaagtcatcacagtgaccttccttcctcgacaggctgggccagagctcctgcctcagcctcccaagtagctgggattacaggcgtgtgccaccacacccagctaatttttttgtatttttagtaaagacggggtttcaccatgttggccaggctggtctcgaactcctgacctcaactgatctgcctaccttggcctcccaaagtgctgggattacaggcgtgagactctgtacaaacaacaatatgaatagctgtctatgctgcactctgcccccaccctatgctcctgcccctagctctagcctggctcctcctcctcccccaggaagccttccttgattgcaccatcccacactgacctttcctgctctcacctcctgtcacagtcctaggctacatctgcaggtcattcctgacctccccaggggtccgccctacttcacaggcagaagactcacctctccaggaatgtgggggctccccaagggcaaacccagggcttctcttcctgcctctcccccagaggagccgaacacagacctaggctggctgccctccatgatgaggggtcacccaggggtgctggcacagagcccaagcctctggctggaagcatggggtgcagaaggcatggcaggatcagcataatcccaggctgtcatgacagttaaaacctgattagcccgagccgggacacagatcaacctgtccttgggacctgaggcccaacccacctgaggaaagaccagaagaggtatatggagctggtccaaatccaaggtcctgaagagaggacactcacagctggtgtggctcctgggaacagacagcactggggcgggaagagtctgggcccaactgggctagcagaggaggaaaggcactgaaggggcccccagcctgggacagagtatgatggcagacagaaagctggaaacaggctgagagctggggcagaagcaggctcagacgactcagccccggtcccagctctgcctctttgggtgatctcgggccagtccctgtcatctctgagcctcagtttccccatctgtggaatgtttggctggcccagctaatctctgacatttcttttctgacatcctaagctcgcgctgtcaggctgtgtgggttggggtcatccaagaaggttcctcagaggaactgagaaagaaccagcagcctcctttctgggcagaaaggaggaggagggtgagtggggtgcagagaggaggcggagccagggagcagtgagggaagaactgtgggagtctaggaggcagtggggccaggccaccatgcagggcctggggaaggcggcagctgtgtgccatgtgttctggatggggtgcagcatagggacagaggtcctccgggaggctgggcacagatctggagagatggcaaggccagggccagggagaataaagggcttggagagccaccccataccattcggggcagagaggggacagtccctcaaggcctggctggctagggaagggggaactctgtcctctgaggaggcagggcccaacaaggtgccgtggccctccatccccctgctttctttctggcctgcctggttccctgaggacaggacagctggccatacacctggtggctggccctccctgcaagggtacggaaccctggctcttctgaaggcaggacaggttaagggccccttcctcccccaaccatggcgaaggaaggctcctggggcagccacgctgggccaaaaaaggaaatcaagagaagtggaaacttttcagtccagagctgccgaccaaagcaggggaagtgcagtcagtctcttgtgacagagccgtgtgaagctgggggtggacaggctatcagctagtggcccatctactccagctactgccccctgagggctgccagacctgccccctgggctgagcttcacatcccaccttgcttggccctcctcaaaaaacagagcccagctttccctgcttcccccagggcgccaccctcagcccagatagtgacctatccatgccacccccaccctgccacctccatgctccttccatctctgcagaggaagagcaggagaagacagagctgagggacagaccttctcacctggagactgtcctgcggtcaggagtcaatggggaaagccatggtctccctggacccagagccagcctcccaccagggaactgtgacggggctatggccttgccagcactcgagaggccttccctgcctgccacggcccttctccagtgggtgcgtccttcctcctcactgctgcgccagtcataggatgacaggtatcccctcacctatgcccatctggacaagtttcaaacttttcgggagcccccaggcccaggctgactcaacgcctcttcacatgggggcccctcacatggcttctctcctctctgtggtcctagctgtaagttcttgggtttaaaatcctactaagtggggtgcttcctcctgttccttccctcccccagctggctcctcctcctgccatttcagcttgctccctcttccaggaagccctccctgattgggaaaattgggttaggcatctcctcagtgcccataactgctctctgttacacattctgttgtacctgcaggtttatctgcccatctacatctacactgagaagtctacaagggcacggaatcatcttgttcctcatcaccagatccccaagctcatccccaagaccagcacaagggtggccccggcaaatgtttgctgaatgaatatgtccacccttgagggcacatgctgatgatccatttcctccaaatgatcctcagcctttggcccacgagagaaaaagataggaaagaacgcgaacttaagggtttcccctgacttcccaggtttcaatttctcctccagatttctcgaaatctaagatttaaacaggccaccacagactctgcccagcccctcccatcccagagagagagaaatcctaagacattaaatctcagaaaaggatgagccccctcccctaccctctttgggcatttggggaaactggggttcagtaaaaggcaaagacttgcccagtcacagagcaaattaggtcacagcctgaaccaggctcccgacctcccagctctctcccctataccatggtcatcattggacctgtgccagcgtccattccaccggacctgctctcagaatcttcactgtccaggacagaggggtcacagagcttggtaggaagctcctggtgacctcaccaagcatctctcttggcttaggaaactccccctctcctccggggaattgcccccccaccatgagactctgtggagggagttcaccttgaaggtgatgaacacatctaagtccccaagggggcaaggatttccactggaaatgctgatgcttgggaagccccagatgtgacctcatcccctggaggaggtaacaacaacctcctgccctggggagcagccccagaatggctccccagcagccaccaagtcaacaataacatcccgttgtttcactggacaaaagcgagggagggcagaaccagccgggcaggttgagactggggatatgggttctgtttccccatggacaggctggttcacctctgaccttggggttccaagccttctttagctcctccaaccactgataaaatggaagaggggtgcacagcttacaaacgcatgccaacctcctgctaagccccagccctcacctgcaatctactcccttacagttcctgcttacaggaagatcaggaccacacatgcacatccttgactggcccatgtgtcagtgacagcccttgggggacaatccctacagcctttcttgctctggcaggctctaagggtcaaagacaagtgtggagctcaaggacacccagcaggtacatgatggcccatctctctccctggcctgagctacgctgtgccagactttcatcaagctgcagaggcagcaatctccctgatcagtgcaggctgggcccctctcagagttccctgctttaatctttctctagaacttggggatccaagcagcagaaaataaagaactttccatacctattccagtccccacagctgtcctgactcaaaactaaaacccccatctatgcctcatagagaaatggctccagaaccaccaccatccctgattttgtcattcctggataccaccatactcccacccaccactggtagacagagctctaggcttccagaaagaccccctcttaccctgttcctgggtttgtcctacccaagcccattcctgtccgattgccatgtgtcaccccacaggagacaggaggcagctgtcagtcgggcacaccatcaccagctggtggccctgggggtggggggcaggtgaatggcagggcctgtctggccagtggggcacctggcactggtgaaggagaccacagactgtcgttggacaagactggtgaacggttggcagaccccagccagcggggctcaacagtgcattactaagcagagggcacagccagtgtggctacagcagtgaactgcgggcgggggggtaggccatggagctgtgctgggagcttcgaaaagtgggtaagaggactgaaagcaactttaaatagcctcagggtgggaactaagtgcccaggatgggatgtatgcattaagtgctaagaagtgggtgtgcattaagtggggtgggggtggggggtcatgggaagactttgggacaggcaaacagagtcaaaatgcaaggggtttgatggagggaaagattccagaacactcagatgtggccatttgtcccctccagagtgcccacacgctatgatgtccaagacagccaaggagactgagggaaggcaaagctgctgggagggcaaaggaagcttgggctggagctgggatggcagaggggtgtgcaggcctcctccatgtacaggcggccggagctctagcagcactgctcggcttcctccaggagcacctcaggctgggtagccgagctggtccccagagcacctcattcatggtccctgaaccacctaaatccttctcccctccctaacccagaacctggactggtcctgtgccagatcagagcccctgcctgcacctgggctcccacactgctcagtgaccttgggcaagtcacattccctcagctactgcggcagttcgggccactcgttttgtgtatggttttttttcccctctgctaataatacctgccccagataatgctcagactcccgcaatccctgcaaactgccaaaggcatcaaaaggctcccggtggggccagacccgaccagttcccccagcccccactgcgagtcccccaccatcacgacaggggggccgcagacacgccaaatttggggacagagccgaatcggactgggggcggggaggcatttgtgtgcaatgcaggggaggggagatcagttcctcgcggcagaaagcctcaaacccccgcctaaccggctttctgtcccatagtacagggtctaaactgaggtgccctgggggagactccagtcccccaggttcttattatctaccctggcctaaaggctgcacccccgccctagatccaccgcctgggggtcccaacggccgtgccccacccaacgggcactgccccccaacgctggagccgatttctggtgacaactgccacgtgcgggcaaggggggagcggccggtcccggcattgctgaggcagcgccctggtaccccaagccgccgcaccgcaccatgtcccgccgctcgctgcaggatgcccacccccttgcctggcccgagctccgggccggggcgggggcgggggcaggcggcggggtctttgttcccgctgccgaagcgcggcggcggcggcaaggggtccgcgccccccttgccggcccagcctgcgccccgcgcgccagcagagcccgcagctcaaaaggagggtacccgggttggggtcccaggcggggaaaggtcctccgccgaagcccccgagccagaggacccagagtggctcggggccgagagaggggcccgccccctcccctggcgcccgggcgttgcggctcctggctgccagggacttggtgcgacttagccggggctccggcccccgccgctcgctcgccgcagcgttacagccggctctggtgtgccagcgtgtacactcacacacactcacccaaacccacacgctccacgcggggacagcgcggggacagcccgggacccgcagagctgcgcgcacgcactccctccgggtgcagcacactccgcacccgccccgcgcagcgtctgatcccgcgcctgaccggccgcgcggcgccgcctacctttccagacggcgaagatgcggggtccgctccttaggtggccctgggcggaggcggcggccgcccagagcagcagcagcagccgcagccgcagcggaagccccaaccgagccggcgggccagggacgcgggcgcgcggtgcgctgggggcggcacgtccgggcggaggaggcgtcatcccgtggccccgggagcgacagcggcaatcagccgagactgagccagcgcccggccgcaggcagacccaagcgccaggaggcggagccagcgctgaccccaccccgcccctccccccgcccctcgcagccttttctcgcctcactggctttcctgagcgagagcggaactgctgggggaaccttcgccaccctctcccgggcaactctacggggaaagcccagctgcggacaagccagacttgtggtcttctgccaggggcggcaggccctatcccctctctgggcctcagttccactccccgcaccccgtaaaaagattggcgtagaagtcgtggaggacctctctccaagggcgcagaggagtccaacacccaacaaccttgctatggccagctaagtggttcgcaccctgaggactatggtcctcggaggatgcgttcgcctaagtggacacggctccctgctgagcctaccagcaggcacaacgatgatatgtggggagcactcagggacccgctgttgctttgcctgggagaacactggaaatttttcatcttggcctggctccttcccctccctctcctttctcctccctttcccagccagcagccttctgggctgcctccccccaagccagctggtgtacgctcagaaaatccaaactcatttccatgtgagtggagggggatataattaggaaggccccttccccaagtagagaggggagcatcccccgtgccccactcactgtgggggagggagggtcaaagcagcttaaggggatctctgcccgcaaagtgcctagggctcagctatctcaggcaacctgaccattcagtggggactcccttggggggtccaggcccagaccctctgcagttacctgagcagtccagccagctctgccatcagctcctcctctcagaactacgtgcctgccctttgtaaaagggtctcctctctctagaccagacagggcccagacctaccacttccacttgtgccccagggaaccatgaatggaaaatccacccagctcagtaagtacttatctagtgtttactggatgtctagctgcactgagaggagacaggccgaggaaggagtagaggtgaacatccaaccttcagaactcacagacctagacacgattcacgcactgcagacaccagcaaaggcggtgggctggctgccctctgccctctgccctgctccatggggccaggaccatttggttgttgtttttacctcctggaaccaggaaagttttgctaccaagaagtttggctttaccattctacattttgcttccagttgtcccctccttcttccctcagagtcctgaggcaccccagcaggccaggaaggtaaactcaaggtacctccagagacagtgcagagtgaggttcctggcccactgggtgaagccaacagcctcctgatacacaggggcacactgccccagagagggaggctgtggacagtctaagagctcctcctcaggcctgcacctaagcctgtggccctgaagccagcagtggagcctggcccaggccagcctctaagatggacattcggtttcacctgctagacaggtattgccctcagtgtctgtcctctctatgcaaagctagggcaaactaagaaatcacctgtctctgccttttggaactaagaattcaaatggattcaaaatcaatgataacactgcccatgtgcatggcaactcacaacacataacccacattcacctacctcatctctgccagtcctccactctcttcctctcactgagggagggagcgtaactccactgcagagaagaaaactgaggtacagggagggacaaggacggacctgcccgaggtcaaccggtaaatggtagaacgaagatgggttttctgactgcaataacaattgctaacactgtggttcctatgtgctgtgccatctcatagcctctcccaactcattcaatcttcgcactcctatgagataggagctattagtcacctccctttacaaatgaagaaatcaaggcacagacaagggatgtgaagtgccaggatcgcacaactagaggcaggacggattgaaactcaggtggtttctcaaggacccacacccttgacttctctctgtgtgatgtaccctggcactgctgcctcctgtctgtggctgaagtctgggtccaaaccatccccagaaggacctagatagggcccaggtcaccaggtgctgagtaggagggcagaccagggaatgggctcaatctcccaatcaacagagtagcagatggaaactggggtagatgccagataattttttttccagactggggggtaggggggaaggaagtagtacttaagaccatcctccccacaagccagccaacctggggacaaagggccaggcgagatggcagcccactctctcggttggctgcaggcagccaggggaggagagaactaagcccatgacttgaggcaataactttataaagggaaaggcagctagactgtggggcaggcactatgaccagagtttaggcatggactttcctgcctcaggcagcataggaaaatcaagtcagaatggtataggtggtgtcagaggcctgcctgcctcattggaggccaaggctggctcttgagcctggaccaagaacaggggcacaattcccactcacagccagtgatgggaagtggaccagcagaggaagcaacacatgtggatgctgacacgtctgatggggaggcacattcttgtccctcccttctccatgattccacattcaggggagggaggaagaaatgatgcagggcttctatcgataagaaaaataccttgagaaggatcacttcctgagccccatggacagctgaggcacagcccaatccaagaaggctccttttggaatgaaagaaatggatacacacagacctgagattcatggtcttgaagcagtggcagaagccccgggcaatccccccaacattccaactaaagcctctcacctttcagggtccaacttaactcatccttccattctccagagttatctgacctcctcctcagccctgattccatggctacacatggccttcacaggagtgacccacctcaaacaagaggcctgtgggagatagaaggattccgtgaggagataacatatgcagacgtgaggtcacccacacacagttcacttcctttcacagatacgatgatccaagaatcccaattcttaggattagaagtagctctcagagggcattcaatccccaacagccccctccatgctagatcccaccccttctttgaggcctcagagcttggtggccattcagacctcctggctactaacagcagcaacaattcctattgcctaccaccattactacctattgcagggggcagagacttggaactgatgagaacgaggggagtgggtgggctggggtctgcagaaccctgtgctgtctataaggcaatttcgactcagctccagcccatggaaccatgaagaagtaaacccagtagtgaaaggtagtatgattttcaagagaagctgaaaattgagggctgggcacggtggctcatgcctgtaatcccagcactttgggaggccaaggcaggtggatcacctgaggtcaggagttcaagatcagcctgcacaatatggtgaaaccccatctctactaaaaaatacaaaaattagccgggcatggtagcgagcgcctgtaattccagctacttgggaggctgaggcaggaaaatcacttaaacccaggaggcggaggttgcagtgaaccaagatcgcaccactgcactccagcatgggacacaagagtgaaactctgtctcaaaaaaaaaaaaaagaaaagaaaagaaaaaagaggccaggggtggtggctcacggctgtaatcccagaactttgggagaccgaggtgggtggatcacaaggtcaatgatttctgtcctaatcattctacatgcatttttatctgacaaggtcaggagttcgagaccagcctggccaaaatggtgaaaccccatttctactaaaaatgtaaacattagccgggcatggtggcacgcaactgtaatcccagctacttgggaggctgaggcaggagaatcacttgaacctgggaggtggaggttgcagtgagctgagattgcgccattgcactccagcctgggtgacagggcgagactccatcaaaaaaaagaaaagaaaattgactctttgttgaaactctctcttttaaaatattggcaaataattcaaaagttaaggaggatggatatgggcaaataaaaacaggtctggggcccatatctgggacccccaacataccatgtgcccactgtgactatctcacaggcacaggcacgacagtcactatacctggcccaactcttggcagaccatgtcaggcaaggagtgccaagaagacacttctcaggctgcccaggccatgcctcaccctcccctcagtgctctgcctgcctccaaacctcagccaggacattcccctcaagtgcctgcctcttcctcctagaccagttcagagatcaccaccttccatacatcagttcagcccactgtgaatggagaacttctcagaactgccaccaccttcttagccctgagggtcgtgctcccagcagcatcccatgcctacatctctgctttctatcctaatcattctacgtgcatttttatctgatcaaccctacctaaattgctaagatctaagtagggccagccaagttaagtaagacaaaggaaaaatccaaagaggaatattcagtcagcagagaagagacagattttttttccttctagcagggcactcagctcacctgaaaacactacaggtcctgtgccttccacagacaaatcagcaacatccttagccccaagccccaaacttggccaacgtggcactgggcttgtggtgggagtgccacctggtggccactctggaacagagccgagtcttagcaaagaccaagtgcatctctgctctctgttctagtcatacattctacatgcacttttctgtgatagacactccccagactttctggagacaaacttctccctcccattcctatgcccctaatccatctctgagcctctattctcactgtccaaagcctgaggcagggcagaatctcatggatgtcacatagaatccatctagactaacaaaatctcctgactagacatggctgggaggccaaagatgaagtctcagcctggatactgactcaagcaaggccctgacccagtccaggcctctgtttctttgtgtacaaaatgagaaagaagagctaaaactccatctcttctcctggtctatcttctctctgtatcagagagagacaaagctttctcattccatcttctgcatttccttctataggatgaattaaatatgcttttaaatgatgtcggccaggcatggtggctcacgcctataatcccagcactttgggaggccgaggcaggtggatcacctgaggtcagaaattcaagaccagcctggccaacatggtgaaaccccgtccctactaaaaatataaaaattagctgaggatggtgttgtgtgcctgtaatcccagttactcaggaggctgaggcaggagaatcacctgacctaggaggtggaggttacagtgagccgagagtgcaccattgtactccagcctgggcaacaagagcaaaactccatctctaaactaaactaaactaaaataaaataaaaataaagtgatgtctataggagagaagatgtcccaggaccctcccagctctgatgtgatccttgggcctgctgaggccacttcagtgaggagatacacatgcaaaagggtggttacccacaaacagttcactttctttcatgaatataatgatccaagaatctcaattcctggagttaggagtagctgtcaaaggggattcagtcctacctgagagccactcacaagactccttatggtggccatgcaggttctgcttacatacctccagtgatgatgagctccctcacaagccagcgttgcccatcttgtttagctctgacacagagctttcttccccagtggaagactcccaaacagtggtcctaaatctgccctctgaggcaacaaggacatgtctaatctctcttcctggaatacggcccttcagtgatttcacagaggtcacatccttctaaatcggctctttattcagggtaaataactccagtttcaaatagatccctcatggggctttccttgagaggctctctaatcctggttgatttctaagacacgatcagtccgtcatttagcaaacttttactgacccctcctaggtgctaaacagtccagattgtgtctctctctttcaaagatcaggcctcagatcagaacacaacacctagtgtggaggctgagcagtaaagggctgaaagactagcttccttcctccttattctagcacctctaaaggcactcttaatgggttgagacaacacgttgttaaatcctcttgatctcagcccagggttatccctgggccaattctcaaccatcagtagtggctctctgggatgctcatttgagaaagattattgaatctgggcccaggagaagaaatgagactcgattctgcataagagcaattaattttctggtcccccttggccgggcgcggtggctcatgcctgtaatcccagcactttgggaggccgaggtgggcggatcacgaggtcaggagatcgagaccatcctggctaacacggtgaaaccccatctctactgaaaatacaaaaaattagctgggcgtggtggcgggcacctgtagtcccagctactcaggaggctgaggcaggagaatggtgtgaacccgggaggcagaggttgccgtgagccgagattgcaccactgcactccagcctgggtgacagagtgaaactctgtctcaaaaaaaaaaaaaaaatttctggtccccactgcaggaccttagactttctttgcttctgtccttgttagggttacttcattgtctgggccctgatgccatctagaacattcactggcccagctctgagtgcctggcatctctgatacacatactcaatatccacttatagaaattgagggaaaacgtcaaacaaggcacaactgacgctccaagaagttaggtcatatgtggaaaagcaatctaaacctcaatctgacttagaagcctaagtcccctccaagacctgagctgccactccaaaggtaagtggttaggagacccttcggccagccaggcacaaggccccaggtgggtgcactgatggaatcatgctgacacaatcccacccaagccctagaaaggccacttccccagcatacaggaagcactcctctgtacatggggctaataatatctagttttcagagtcgctatgaggattaactaagatggcacatgtgagtgcctagctcaatgcctggcacagagaggatgcttgataaataagcactactgtgctgtgtaatgtactattaatattagctagttttgccaagatagagtaggccagtgcctgggttgccacgaaagcatttctagcatagaagttgaattctattcccagcgatctcagagcctatgagaacgagacaggcccaggcccagaggaactaggggcacagctgaactgacctgagcccagcccagggccagaggggaccccacctgctggagaggctgggtaagcagaaagagggaggcctgaataaactccccaacatcctcaacaaacacccagggccaaagtctgtggcaacagcaacaagaagccacctcagggtagggctctgtgagcttggtctggggcccaggccagatgggactgaggcgaggagcagatctggggcccatgtgcccagcaagctgtgccagcccagcccataccagcccagccaaatttgagttatatcaggagaacggatctgttagaaaactcacccatctctacatatttgcatattctattttggggtcttttcctttttttccctcagcttcctagaaaagttcttgtgatcacttccaacttcacctctgctgaactgcaaaaactcacactcaatcccatctctcctctaactactatcctctccctcacaagcaaggtcccctgccctctctgcatccactgcccctcacctattcagtcctcaacccctgctatctggctccggttccattggaatgtctccccaaggtcaccaaggcacaagtcaacaagtccaaggtcagcccttctgttactaggtttgtctgtggcatctgaccccactgagcatgccctctttgtccaggtcctttcactccctcagctttgctgactcctgctctcaccttcccagaagcagcagatcctgcgcccgttccatgcctcacatctatcagtcaccattttctataaagctgaactccttagtgggtatcccttttcctctacctttctctgaaaagcttaattgccttctcacatgacacaggcccagtgttcaacttagaacttcctgatcactacctcagcccaaagacatccaactgtctttaattatacacatccccacctggctgtcctatggcacctcattccaaattgtcaccccagtcccttattcttactgctgcaccaccatccgcctgctcacatcctgcctgcctccccactttcagcccccagagctagtctgtccttcacacctagcagctcccctccacccagctcccctgcagcagctccagttgaggccccctccatgtcccatctggaggatccagccagcctcctagctggtcgcctaccccatctcacttcccacaaatccagcctccacacagctgtcagattatctcacacacagatctggtcccccactgccctgcctgcagctgcctcaggggtgctctttgccctcaggataaagccctagctcctcagccggatctaagccctcatcatctcccattcctccacacttcagaggccaagggcagtgggaggaagggcaccagctctggagtaagacagacctgagtttctgggaccacttgtccacttcctgcccatgagactgtgggcagatgatttcaacccttggaaccttggtgtccccatctgttcagtggagacaacagtatactcgcctttcccaaagatctggtatcaattctaactcctaaagcctctctacctcctcctctccttccccactgccacgccgtcaggtcagcctaccagcagctctaagtggatcactgccacagcctcctccccggcttcctcatgcctgccctccctcagtcttctactcccactatactcaccacacagcagccagaatgacctttctaaaacacacattggactctctcccgattgccattctgtgactcccattgtccagggtaagtctaaattccttacatagcttcaaatgatctagcctctgcccacccacttgccttgcaagccaccctgacaaacagggctacaaaagccaggtttgctccccactcccagccccctcagtacatataccttcgtgcccaattctcccttacccttcaggtctcagcgtagtgccactttctccatgaagctttccctcaccctcacacccccacccctagcccacgttagccccctctcctgtgagcgccacagcccctagacttgcctcgcccagttctcattaggctttaatgcaatcatctgtttgtccatcttaccaacaacacagcattgtcagagcaaagataccgtcatgtttatctggcagagagtggaggctcagtcaatgtttgttgaaaggatgaaaggaggcccggcgcggtggctcatgcctgtaatctcaacactttaggggaccaagacaggtggatcatttgaggtcaggagtttgaaaccagcctggccaacacggcgaaacctcatctctactaaaaatacataaattagctggctatggtggcacatgcctgtagtcgcagctacttgggaagctgaggcaggagcccaggaggtggaggttgcagtgagctgaaatcgtgccactgcaccccagcctgggcgacagagcgagactctgtctcaaaaaaaataaatttttttaaaaaaaataataaaaataagaagaaaggatgaaagggacaatggtgaggaaagagtccttggctcatggaaagccccaggctcagtgggggcacttatcagactcaacatagactactcaaaacatggccacaggaagcaaagccaacttgccaagcccctggaggaaagagccaacaaagaagggaaagggaaaccgtggggacggctctgttctgggaactggtattgggggttggtccaagggatagggcagggtgacccaaatgttctgcagcataatgggataggggagttaaggaaccccagcacctttgaaggcagtcctcagaggcagggtgagagctgccacagaatggaaacgagctctgggcaggctgtatcatgggcacaggaagggctgtgtcagccccatttgaccaagacagacccatgaggataggactggcctttgtttccaccacaaacaagcaagagacactgtgtacaaagacagagcttcctggtctttgctctcaaccacaagtaggcagctgggctccaggcagaccactgaggcacacagaggcctggcattgagaagcccagttctgagtcttttctgtcaatgcacatagagagacttctcaaattttctggaagaggcaaagaataacatcctgttcgggccatatctggacgttaagagtatcactgatacactggaggtcatccagaaaaacgaacaggatatgctgggaaccaaaaccatgacaggtcaaaggggcaagtcaatgacccaccatggcattccgtaaataactaaagccctgctaaggtagaagaggaagcaggcttgttccgagtggttccttagggcagagaggggaccaaggggtaatgccctggcaaatagttaaaggacagaataggttgtaagtggtaaatcttttgttcctggaggagacaagcagaaaccaaatgaccatgactgggaatggtggagatgaaacgcctgccaaggcagagggcaggagcacatctctgagcccctttccacccatgttattcccaaatgaaccaaaacaccatctgaggggaagaagtgttctcccaacgaagtattcaaagcatttaaaacccactttctcaacttggacatgtctgcgatgccgcagggaacatcacagggaacgccatgccaaggggaacatgagtgagcacaggcagatggagcaacagcttgggggttggtgccctctcttcaatattaaagctgagccctgttcatgttggtgttgttttttagtattgctatttaactgctcttgtatttatgccttcaggacaaggagggccctacctcctggcgaagctctgaggcctggattctggaatcattacagaacaagcatcaaaaaatgcttggtgagaatagactggtggggtggacaaagaaatctgtggaagccattgagagagagagaaatgtggaaggcaagctgcctccatgtgcttcccctgaaagtccacccagccactccatagactggacatctcggaagcataagcctcttctgggcacagctgtaatccagcagccaccctgaagattgggtgatagctctgcctagacttcggcacatcctgaggctcccaaactccaaagccccagagagtctgggggctacggctggaaacttctcccagaagttaacatgggtatctcacagcatcccatgatgtagggtctaacatcctccatccagggcccagaactaggggccagccctgctttgatgccacagcatcaagaccagcacaccttgtttgccccactgcctccaccaactcagatcagccagaaaggtcaagaactggacaaagcaggagagttgaccatcaggtatattggggaagggagagatggaggcaccttcatgagtgcctcccaagggcagtagcctctgcaacttgctgggggttcaggggaagcagggagttcatggggctcctccagcaaagatgagctccagggctgcttggatgtccccaccggtggcctgcagggcccgcaggctcagctcatcgtcctggatgcccatgtcacgtagctgctgcagctggggctgccactggctctgtggaaagataggaatgggcagaagctgttagctgggatccagtgaagactcacttaggtctgtgctttccggggaaggaaaggaagatgggggagtcctcagcaaagctgctgatgctgagttccacagaacacggtgcttctaggaagactaaaagataggcttgagggttaagagaacaaatccaaagttttacaataaaaaaaggaaattcttggcataaggatcaaaagagaatgtacaaattattcactgtctgaattccaagaggctaaattactttctttctcttgctatgtgtacacacacaacagcaagattttgctctttatgtgatgagtgttacagatttttttcccagtttgttagcctttggactttgcttcggttttttgtttggtttggtttgccacgcagaaattttcacctttttttaaatgtcttaaatttttgtggtatatagtaggtatatctatttgtggactgtaagagatgttttaaatttttcgcttttacaaacccaaaatgcataacttttatttaatggctcctggatactgagtttcagccaagaaagcccttccctactataaggatttgaagaaattcacccatattttcttctagtactttcatagcttcattaatatctctatttcatgacagcagggatgagcacaatttagggaaaacaacgtgttcacatgtgggaagaaggcaatgcaaaggggaagaaaagcaaagtcaaagaggcaggcagtgatgagaacatggagggcttaaaaaaaatgcacacagatcaatttgaattcattttacaggccaggtggaaccagtgaaagcttctgagctagggaataaagtaaacaggcatctagcaacaggggagatgcaagaatggagaagacaagttgttcacgaatcctgcttctgttccctcactgtctacaaggaccacatggaacagtgaaaaccacacaggcttgaaccctatcgttacgacttcatggccttatgaccccagacaagttccagggatgatgctctacccataggcttactatgtggaatagaggaaaacagacgtgaaccaaactgctcatgcatggagctgtgaactacaatgctggcccctcaggtattccacttagctgctagggtgacctttctcctccttaaagcctcccatgggccaggtgtggtggctcacacctgtaatcccagaactctgggaggctaaggtgggtgaatcgcttgagcccaagagttcaagaccaggctgggcaacatagggagacccccccatctctacaaaaaatacaaaaaattagccaggcatggtggtgcatacctgtagtcccagctacccgggaggctgaggtgggaggatcacctgagcccaggaagttgaggctacagtaagttgtgatcacaccactgtactccagcctgggtgacagagtgacaccctgtctcaatcaatcaatcaatcaatcaatgcctcccagggatccctggtgactgctacatcaagtcatcaagtctaatctccgcaggttggcatgcaagcccctctcgtaggctcctgctctttctctggccccatctgcggatcttctacactggacactgcatcctagccttgtagttttgagtatgtcacatatacctccacacatgtgcacaaacaggtagctgtcttcacctggaaatcagccccttcctacctcaaacccccttccctggctagctaacttctaactaattcttctgacaatcagcttaaatacccctctctcagaaaagttttgtctgacctaggcccttacttcaagcagctgggtttcttgccttgttgctccccagctcagtgcctgcctggtgcccctccatggcagggatgagaaccagcttgccactagcccagcatctggactcaggcctagtatacacatgctcagtcaatgatcactgaatgaatgaatgaaatggccatgattatctaagccaggtggtctagggagtcaggccatggtcactaggggcaggagaagcctagtgaccactgtgtatggtctgagagtgtgcccttgctaggaacactctgcacctgtcccactgccatgctccagctgttcctagaatgaagcatgccaggtgtgaaggaccgccagagagcaaaacaaaggctgggcatccaaaataacaaggaagccacatggaaaccaagacgtggggaagactgacctgaaggctgggctgcccagaggcctgaagggcatgctgtagggcttggctgaagagatcattggtgatgggcgtccctgactggacaccagaggacattggtgaggtccctgaggaatgaccctagagacaaattagtggtcagtgccaccctcagcgccatctcaatcttatagcagatgctcgctgttgtcatatcacctcacagcactcctgaggtacccaacttctgcctcccaacaaagacctgccataagacaaccaaacaaaggtaactagaagctctctatgtgggcaggaaaggttccattctcttctgcactgagccccttgtcccagcctaggaccccagcactgcagcactgggagagatggccttgaaagctgaagtgacttgtcacccagaaatgcttaagctggtgatgtctgctccctgtcagggatgaggaagggcatattgtgtgcaggaagagtcttctgaactaataggggggactacacgggaccatgttaaaatctagacttctgagtcctcaaggcaagtgaaggggaggtcactcaagctgcagtaagaaatccccaccaggactccagggttcagcttaaactagatctagcaccagggtcagcaaaggcaaatctactctactgctggggagcttgttccttgggggcccagccttgatcttcccggccccgtcttcatacctgggtgccaggagtcggtgtgtgagagctgctctccggagtgctggccagggccaaggcggtggccagctcactctgggtgatgggccggggcccagcagctccactgtaccccagggaggctgggcgggagctgggagtactgctagagggtgtggacctggtgttctggagaaagaagacactcagaatcagggaagcagtactgtgaaactcccagatgaactccacccacctccagcaatagttcttggggaaactcttaagttcccaggttcagaaaggaatccaaaagcagaaatagtatgacatggtcttggccccccaatggcgtatgtccatctcccagccttgggagtgccaggtcccaggatgcagctcattcccagcaccatctcccccacatgtcagcatgtcaggcaggcaggcaggccacttactgggtgaaagtcatcctcatcatctgagagcccttcaaacaggaagccacctggaggaggacgaacagatttcaggaggaagaacagaaaggcacaggcgcagctccagaatctcagctcaagttactctccaaattcatattttcatctctcccctcggaaaattacaggacagatgcacttcctgactcaaaccgagagttcccaaggaacgccctctgccaacgctatacatagctgctgagtaaagcaaattcctgggccactgccggctcctgaggggcccacattacacttttcaggcgctcacctggcatatcccggtatgagctggagggcatgctccgggaagaggagtcagtcccaggcattggggcactgcctgctacggagtgcagaaccaggacaatggcattgacgagggctgggtgagcaggcaccaacctaggatagaagcaggaagaaacccaagggtgactccaaaagagcaccctcagccataacaggagttctgggtgccccctcacaacaatgcagccacctgtgcctgctctcaaattcctcagtctttagcatcttccaccaggaagctttatcctcctgctgatctgcccccagcaacgggtgcaaggccttcaaattcctggggtccgctgcagattcttcaccctctccacaggcaaggcatgatgggaaaggtgcagcctgggaggctcagggttctggcctgagcacatgaggagtgtctggtctaggcaccactactacatcaggcaaccctggactggtcccttctcttcccagggtggggctgttttcttcacttgcaaaatgaggacatgtcccttttagctttgacactttacggatctgtacacctgcttctccttttgccagcttaaaatccttgaaaagctccctaatttctaccacacgaaacctaaactgagcctggcagacaagaccctttccctcagaatcctgcttcctcccagcactcttgacaaaagccctgctcttgggctttgctctttctcaccccctgacgtatctaaggggtagacttggtgacagactatggatgggctcccagagcagactgcagggtgacaattaggcttctggcctgagcacgaggagagagaaggtaccctctaataggacaggtacacttacgtatcaagcatattgggatcagcgaagacagagaagaggtccttgtcctggagaacccctgaaaaagagcagagctcacctcaaagaaaggaaatcagccagatccaggagggagaagaggctttgcgtctcagagcaaccagctcaacagggacacaggacaacaagccaatcttcatgagaagtagaggaagcaaagcgccaagcaatacaattcaggtactcctcatcttggtctagtgaggatggtcccctgctctccacctcccctgcactttagtcacatcacagactgggtaccaagacacctgtctctttctcccgtatctctgggttcttcccttactcagggtgtgcaggacgccttccctgattgctgtgatgtgggctaactgctatcctcatttggcatcctcatacccttatttacgatgttagttaggccattatctctctgtgggactgagagctcttaaagggctggggatatcaaacacaccttgattactctccctcttcccacaagaccagtcattcttcaaaagatagtccaagtctctttagaggaattgtcttctcctgttttctccttttccgacaactcctatttcctcaaattcagtcctgcacttaccaagagcaatagggtcactgctgaggcctggggtggccacaatgatctgatccagagactccttattgctgagcatcttaaagacctgcaggagaaatggcgggggctgagcactccaaccagctcaatgtactcatcaaatgcccacactctgccaaaggacttcctccctctaagtgcttgcatgtacatcaccacaatggaacaatagccccagaaacagatgaacctctttttgctctaagatcttagcttactggaggggaaacaaacaatttaaaaaaaaaaaaggcaagaccacagtaaaccttcaaatctctgtgctccttttccccacctacagtttagtgcttccaaaataaaagctctcattacaagcccggtaacaaaggtttctctaggttccaatccaaaagtccttttcaatctctgtacaattactatttcatatttgtatatatcgctaagttcacagctatactaattttgcctctcaactctcctacagaaagacatcagcccacttccccagtgaggacatctaggtcaaggggcagtaagcaggcagttcagccaaagtcgaagaatgaggcccagcagaaacagtatgaggatcttttggctgtcaccatacgggcaggttgtattattatcattagagggaatcaacaacgcctgactgagacaggctctttggggaaagacagggctctactgaggcccacagacatggcaaaaactccccaaggaactcttggttgccatggcaacgggcttccagctcccactccacaccactcgccagccagcgttcacaccctctcctacagtcctggctgggggccgcagcacacactcaccgcctccctgtaagaggagctgctgtgcagggcagtgtgcaacacccggaactctctcatggcagccactttgtccacaggttctgggggacaagacattcagagttaccctatagcgcaggtcctgtctctgccacagacatggcaacatcatttcagcatgtgccaaggagcagcctggtctgtgcattcccttccctcatcaccccttaagaatgtgagtgcctgctcagaaaaacccatttgtgccatggatgtgaaaactgctagtaagcatctttacattcacttgtaagcatcttgcacagataaacaaacaaattcaagttgcagcagaggagactcttaccacatgaaaaacggtgctctgatcaacataccactgcaggaattctagactaataacatttgttttttggtgtttttgcctttgtttttcagacagtctcacctcttgcccagccagaatgcagtggcgcaatctcggctcgctgcaacctccacctccctggttgaagcaactctcgtgcctcagcctcctgagtagctgggattacaggtgtgcaacaccactcctggataatttttgtatttttagttgagatggggtttcaccatattggtcaggctggtctcaaactcctgacctcaagtgatccacacacctcggcctcccaaagtgctaggattacaggcgtgagccaccgtgcccagccctgggtcacactttttaaagtatggttatcctcacgaaggaccactacttgtgactgtactgactgtgtactgcccaactccagggcaccactcccaaagcaaggtgaatagcacccctggggttcagggtggcagccacatccttatcgacagtcctgatcatgaggctgtcttttgaaaaacagtcatcttaagtaaattacctaatttattcattcaacaaacatgtactaagcatttactccatgcctggctttaggcaaggaactagaatatgaaaaataagaacccctgccatcaaggaactcttagggcaggaggagaaatgagactacatcaaatacacaattacaaaatgccacgttgaagacctcaacagagacgtggatcccagctagggtaccaggaacacaaaggcagacaggcaccactgagagggagggtgaagatagacagctgcctcccagaggagaccatttgaaatgggtatcaaagagagagctgatatttactgggggggtgaaggtattccaagcctgaatgagaacatgtgcaaaggcatgggagaataaaagaatgtggtgctttgaacaaacagcaagtcattctttgtggctggagcttggggtacacattccagctcaaacagcaggttaaggtgacgtcctgaagggatttgtaacccgccatggaggactaccaaagagatccaggtgggaagacagacaacaatgggttcttctcctataggccctaatctgtgggagaacacaaaatgtgattcctttgtgaagaaaagcactcaaggagcaaatatctaaaacactgtcacaaaacagtttctttacagatctaaaagtttattgtaaccttccaataaaaaggtcatttgtttcaaaaataatcctccaggtagaaggtgggaggaaaaggactcttaatatcttaagccattattcagctaagagccatggctgtcactgtaagatctctgagctaaattcatcctttagaagtggaacgcagccagcccagtggaaatggttttcctcttgagccaggaaaacccctggtccatatcccagctcttgcattcactttctaagtagctgaccttgaataaatgccctaacccttttcttcctccataagatgctaatgctgttacctaccctgcagggccactgtaatgattaaatgaggtataaaagggaaaaaacctggctcacagaagccacaaatgttattttccttctgttaatgccctccagccaaagagctgaggggcatatctgtatttaaacaagttgggtttactgctcagtacagagagaagaatgcacaccacaggaaaccgtgggctgtctcagtaagaggatattagaaaggacttttttttttttgagacagagtttcgctcttgttgcccaggctggaatacaatggcgtgatctcggctcattgcaacctctgcctcttgggttcaaccgattctcctgcgtcagcctctcaagtagctgggattacaagcaggcaccaccatgcctggctaattttgtatttttagtatagacggggtttctccatgttggtcaggcttgtctcgaactcccaatctcaggtgatccgcccacctcggcctcccaaagttctgggattacaggcgtaagctgctgcacccggccagaaaggacttcttacaggattttggttttgtctggctgatttggggaaaaatttaaagaagtgaggttttactctggataggatgctttcaggcagtgggagtgattttataattgagtatcttaataactcttacctagaaggaaggaaaactagagcaaggtggaagctgtaattggccaagaagcagctgttactctcatcagccaagatagaaagatacttggtcacctttgtggtttggataatgctcatgtttttgtgtttctgttcagcaataatagggatcttgtttttgtcttaatccatagtggtctcagagtggccttgactgctactggggatctgtacaattgttcatgatccccaaaaggattccagggcctggctgtgagtgccaggccaacctctggatgtcaggaactctgttcctctttctcacttcccatcagggtatgaaagacatttttgtcttttacagttagaactgaaaggggggtaaatttcaaactgataactagtcacagcaatcatgaacattataaaaagatgtcaacctgccagtgtaacaaagctaatctcttttacacagcttagctttattcttagggaggcttttaaaacacacatgcaaaatttaaatcatgaattccaagcaccttctatttataaaccaaaaaggcatctgaggctttgtatattttctccaagagctatttaaatactctttgaatatcttcaggaaaataccagtatagcaagagcagttagctaactgaacaaatcaccacctgaggcagtttgtaggaagatttgttaacaagggaataaactgcagcattaggaaagtgccaaaagtttccagcttttttctaatgagaacaacgataataacaaaaggatacaaagtttactttgtatcactaaaaaataaactgttaacttaaaggagtttaagtagacacaaactccctgtcccattaggaaacagtggatgacaaacttagaaagtggagaaacaagccaggaatggtgcctgtactttgggaggctgaggtggggtggatggcttgaggtcaggagttcgagaccaggttgaccaacatggagacaccccgtctctactaaaaatacaaaaattgaaggccgggtacagtggctcacgcctttaatcccagcactttgggaggccgaggcgggcagatcacaaggtcaggagatcgagaccatcctggctaacacggtgaaaccccgtctctactaaaaaacacaaaaaaaattagccaggcttggtggtgggcgcctgtagtcccagctacctgggaggctgaggcaggagaatggtgtgaacccgggaggcggagcttgcagtgagccaagatcacaccactgcactccagcctgtgagacagagtgagactccgtctcagaaaaaaaaaaaaaaaaaaaattagctgggcatggtgactcatgcctgtaatcccagctactcgggaggctgaggcatgagaatcacttgaacctgggaggcggaggttgcagtgatccaagatcaagattgtgccactgcactccagcctgggcaacagagtgagactgtctcaaaaaaaccaaaaaacaaaaaacaaaatggagaaacaaatcttccattagtgatgccggcagtaagaaggtcaaaattggactctgtttatcagcatggtctaatccaataagtaataaagatatcatttatcatcagctcagtaaatcatccctttgttccacccaggcttgtgcctcaagaacacacagatccttcccttgcggatattacagaaactctgcctgcctaagggctgcccctcactcacccggtttctgatcaggttcaggccaggactttcgcagaacatggacagtggacccaggttgaatgccatagaagtcaagtgtctggtcatcttttagcttccgaccacagtagatcagatctaaaaaaagaactgtccacttatattttgctcctcaaaacaaatttacatggtttttgtcccgagaaccttattttgattagatagctggagaatgatacatgttttaaaagatactcttattcaataacttaacaaatacttttttttttttggaaaacagggtcttactctgttgcccaggcttgagtgcaatggcaccatcacggttcactgcagcctcaacctcctggggtcaagcaattctcccaccttagcctcctgagtagctgggactacaggcacatgccaccacacccagctaatttttgtagttttttgtagagacggggttttgccatgttgcctagactagtctcttaactcctgggctcaagggatcctcctgccttagcctcacaaagtgctgggatgacaggcgtgaaccaccatgcctagccaattaaatacatttcaacaactatttgcaaatataaactcataaaatggacttacatcgaatctggccagatgtggtggctcacacctataaacccagcacttttggagcctggccgacatggcgaaacctgggccatggcgaaaattagggccgggcacggtggctcacacctgtaatcccaacactttgggaggccgaggtgggtggatcacctgaggtcaggagttcaaggccagcctggccaagatggtaaacctcgtctctaccaaaaatacaaaaattagccaggcatggtggcagacgcctgtaatccctgctactcaggaggctgaagcaggagaattgcttgaacccaggaggcggaggttgcagtgagccaagatcacaccactgcactccagcctgggcaacagagcaagactctgtctcaaaaaaaaagaaatatatatatatatacacacatacacacaaaaattagccagttgtggttgtgcgggcctgtaatcccagttattcaggaggctgaggcaggaaaattgcctgaacctgggagacagaggttacaatgagctgagatctcgccactgcactccagcctgggcaacagagcaagactccgtctcaaaaaaaaaaaaaaaaaaaaaggattcacacagaatctatccacagaaaaactctggagtttaacattgtggaggctgcccaatttaaatcaatggaaaaacaacaaaataggatgaacccaatccaggtatgactgaaaacatctttcttgccagttggatcctttagctattaaaaattaccttttcagtgtaatttaattatatttaaattcctccctcctccacctggactgcccacgccactttttcttttttactgcctttcctttactcagtcaaccaagcaaaaatccttctaatcatccctgaagacctacctcaaatatactgaggagcctcccctgaccaacttctcctttcctaactcatcccaaacttctgttctttcagaaaaagaattcacaatgttggccaggagcggtggctcatgcctgtaatcccagcattttgggaggctgaggcgggcagaatcacaaggttaggagttcaagaccagcctggccaacatggtgaaatcccatgtctctactaaaaatacaaaaattagctgggcatggtggtgtgtgcctgtaatcccagctactcgggaggctgaggcagaattgcttgaactgggacccaggagacagaggttgcagtgagccgagatcgcaccactgcactccagcctgggctacacagcaaaacaaaaacaaaaacaaaaaacaagacaatgtcataaagaacctggtgataaggtagttcagtataatacatggctgaaatggcaaccaatagtttcattatatgatttgtgtttctatttacccaacattcacttccctggagtgttaacattatgaggcaacaaatcccaagcccttactttactcttgtaattccagaagtatcctcccccaaaagagatcagagcagcagcccaaccccagtccagagagactcaccaatcagctcagggtctggaacagactcctggagtttgccagcaataagctgcttcagaaatgaaatactatagccccctagcgagtattctcccagttctgtctctggcaaccgaagaatagactttggagtaagtggctggtcagccagcttcaccgccaggtgccagtctgagagagacatcctctctctttcgcgctctctctttctccctgtaaaagaacaaaacctcagtggttaaaagacagaccaccactctactccacccccacccaccaaagggttgaatgaaagacaattcaatgtgacactgttgaagaggcatagggcgtaccatcaggaggccagaactagaatctggggttctctctctactcatactgtgatggacagctctctaggcctcagtttcttcatccctaacgtggacataaaaacgccatccaatctaataggaatgttgtgagagagatcatctaaccctctcccttctgtatgcccctttttccaattttcttcaactgttgcttgaaccagtagaacagctttataacaagttccctgcctcttgcctctccctatcaaatatctatgctgccacctaacaacacccatcatttttttttttttttttgagacggagtctcgctctgttgcccaggctggagtgcagcggcgcgatctcggctcactgcaagctccacctcccaggttcacgccattctcctgccttcctgcctcagcctcccaggtagcagggactacaggcacccgccacgacgccaggctaatttttttttttttttgtacttttagtagagacggggtttcactgtgttagccaggatggtctcgatctcctgacctcgtgatccacctgcctcggcctcccaaagtgctgggattacaggcatgagcgactgcgcctggccacaacccatcattctaaaacacagatctgaccaagtcacttctctgcttagaactcttccaatgtcgggctgggcgcggtggctcatgcctgtaaccctagcactttgagaggcctaggcgggcggattgcctaagctcaagagttcaagaccagcctggccaacatggtgaaacccgtcactactaaaaatacaaaaattagctgggcgtggtagtgcgcacctgtagtgccacctactcggaaggctgaggttgcagtgagccaagatcacgtcactgcactccagcctgggtgacagagagagactctgtcgcaaaaaaaaaaaaaaaaaaaaaaaaaaaagccagacgcggtggctcacacctgtaatcctgtcactttgggaggccgcggaggacggatcacttaagatcaggtgtttgaaaccagcctggccaacatggtgaaactacatctctactataatagaaaaaatttgcagggcgtggtggcaggcgcttgtaatcccagctacttgagaggctgaggcaggagaattgcttgaacccgggaggtggaggttgcagtgagccgagatagcgccactgcactccagcttgggcgacagagactccgtccctccctgccccaccccggccccccagaaaaagacctcttccaatacctctaaaccatctatataaattaagtctaaacttcatcgcctggcttacaaaactccctgccagcctcattccccaacagagccctacccctgcaaaggacctccacaacatgtaagtacacactcataacaaagctctcccctattttacacctctgctcatctaactctgcatgtaatttctcttccctttttggccttttagcaaactcctaccgaaaccaacacagattcaataacctcagtcccctctctttcctctgttgttcccacatcccctcagaacaaaagggctacaaatatctgcttgccccctcctccaccccaattcttgaatgcccttgaaaacaaaagactaaagttttcttcatccttgtccccatacctggcatacatggaaccccagaaaataaatcagaaactctgacggcggaagaatcttgcaaagcaagataagttcttgttatagtcatcattattgcttccaaagagacctctgatagagaagaggaaagaaaaggctgtgaagctgcctagcagaccttcaagcatcctcaaggtatcttccacctcaagtttatgccagaaggaggtcgttttatataccatgtctcacttaatcctcacaacggttccctaaggcaggcattagccacattttaaagatgagggaagcaagactcagtaaaatcactggcccaaggtcacagatcgctagtaatggggcaggaacactatccggtggcgacctcaccgctccagtgggaccagctacttggctgacacacatcgagcccgcgctgcccagggccccagcgccctcacccgtcccgcggaaggaacccggccgcactgccgccggtgtaaacactcactctggccctctcgccggaaaccggaaattccgcgctgcattctgggagttgcagttcccgctgtggccccccgcccccttataaacagccagtctacaagaggcgctagttgcaaagcttccggttctgggggaaggcgtggcttccgcgctctttgaaatgtccggcgccggaatgtctgggtgctttggttggagagggtcccatttccagtcattcttcagcctggtgattcccgcgctcccctgaggagcatatgaagtacgtcggttctgccaggttggaacgcgctgctggacactcggccgtaaggcggatcccggatcccctcccactccgacccttccctccagaagggccggttcccaaacggcccctttagacacatccaagcggttgccgacggccctcacgatgaaaactgctgtccgttggtgaaggcagcctcttctgtgctcctcgccgctgacttcctgaggcggacctacctgtggaggcataccaggaaccagacgatgaccccctccaaaagttgggtctttgaggagagctactaacttgggttcctggtacaccctctacatgcagtggtgaagcttatctaacagtcattcatagaatcagtttgggaaggggaattttcactgaactctcatagagaaactgtgttttagataacagaaagttctgcacggttaaaatggaacagaaatttttttgcacagaaattaggattaccgaaaatactgaagaaagactacctctgattggactcttctcaaggaattaataattcaagaactaaggaaagaaaaaagtgattatatgaaaatactgaagttgatcgtagcagctgaaggctgatcctgtgtgggtaaatgtaaacgctgaattcccacattccaatgtgcgacctgggattaaggcagcaattgagcagggtaatgttactgaggagagcgaacagatcgcaggatctcagaaggcctaacattaaaggcagatcacccctctgttctcataagttatatggggagttttgaaatggctttcactgtcttcagggagtttatcttcaggataactcccatgtatgttgtgggcgcattaggaacccatggctgttcccaaagtctccctttcccatcctacccatttttagatataccccctctttcagtaatccttcctaactagacttctttagactccttcctctcctgcctactaagttacttgcacctgagctccataatttatcaaaattatatattgtgaatactttcccagttcatgattttttttttactcttaatggtattagataatttaatttcattttaaaacttttttttttttttgagacggagtcttgctctgtcgcccagattggagtgcagtagtggccgatctcggctcactgcaccctccgcctcccgggttcaagagattctcatgcctcagcctcttgaggagctggggctacaggtacctgccaccacgcccggctaatttttgtatttttagtagagacggggtttcaccacgttggccaggctgctcgaactcctgacctcaggtgatcccaaagtgctgggattacaagcggtagccaccacgcccggcctgaaattttgttgtgatggttagtgccttttgtgtcctatgtaagaaatctttgcctgccctcgttatgaagatactatcctaggttttcttctgtgttattttatctttcacatttaggtctatgattaatttcacattaatctttgtatatgataggagttagacatcaagattcatctcttccatatgggtgtacaattgatccagcactatttaaaaattttgttcccactgaatttcagtggcagctttgtcataaatccggtgactatgtatgtctgggtcaatttttgactcttattctgtgccatgggtgtatttttctgtcattgtgccaatgtcacacgtcttgatttctctaactttagagtaggtcttgatatctgctagccttttggctttaagaggggcatggctattctatcaccaatagatgacaattgttaactttgttttatgcttctaaaagtataattttactgaatcttaaatatgtatattcaacaaaatttagattacactgtacatttgtttagtaatctacatattttacctagcttgaatatttcccctgtgctcaaatattcttgagactttttactttgaaataatttcaagtttacagtacagttgcaaaaatattacaaaataatgccctcatacccttaacccaaagtccccagttgttaatagtttacatttacctcatcattctttctctctcactctctcactatgcatattgttcttttgtttttccacccgatccgtttaagagccaattacagacattacccaaagtatttctgtatttcctgaaaacaaggatatattctatgtcacagccacagtacaacccagcaaaatcaagaaattaataaatacaataataccatgtaacttacaatctcattcagctttcatcaaccattccagttgggtggaggctgatcatctctctgccattttcataagttatgtcatagattttcacatctgtcacatcattcatttctccaaagagccttagttccttttagtaaggaatggtatttagaagccaagtttggatgctaggtgtgtttattgctactgagatgtcattatttccagtctatttcagtgactagacctagcaaataaatgaatattgatatacacacccattcatctatatttctatgaaatatatttaaatatgtgtgcatatagatgtgtatatgtatatatagatctatgtatatgtgagcatatatatgtgcacatatatcaaaatatatatgtatatataaaatatgagttcacaccaatacctcaaattccaatccaataccacatattttcctctagtcttcctcttctctataattttacctcccttctgcaatagtaggaaacttgattctcattttccacaatatacttgtattttctcatgttgacattcatggtacctgatatggtttggctctgtgtccccacccaaatctcatgttgaattgtaatcctcaatgttggaggaggggcctggtgggaggtcatgatgtttggatcatggggcagacttcccccttgctgttctcatgacagtgagttctcaagagatctggttgttcaaaagtgtgtagcacttccccctttgccctctctctcctgctctgccatgtgaagatgtgcttgcttccccttcacgttctgccatgattgtatgtttcctgtggcttccccagccatgcttcctgtatagcctgcagaactgtgcgtcaattaaagcacttttctttataaatcacctggtctcaggtagttctttatagcagtgcaagaacagactaatacagtaccataacaatggagcctcctcttcaacttgattcttgagtccttttgacataaccctggaggtttttgatagctccctgctatctagcatgacaagagttcctagctaatcttgtacttcctgccctaggcataaaaattagccatttcttcaagaaattcatatggttttctgtgggaaatggtatattaagaccacaatctgggcactagggatgcttattgctactgaattgtttgttacttgtaagccacattagtggatggagctagggggagatctatatccatagagatataaatagagaatatttatactgctacttcaaattcaagactacagaggttgggtttggttttggcttttggttttatgggttgctttttgttttgttttttttgagacaggatctccctctgttgcccaggctggagtacagaggtgcaatcatgactcactgctgcctcaaactcccaggctcaagcgattctcccacctcagcctgccaagtagctgggactacagttgtgcaccaccatgcccagctaatttgtgtattttctgtggaggcagggtttcaccatgttgcccaggccggtcttgaattactggactcaagcaatctgcccacctcagcctcccaaagtaagactgcagaattttaatttaatattttctatattacatctttatttcctttcttccacactgagaatactagttctcaagaacataagggacaacagtatttaaatatctattttcatttcctttatcccatatcacatacccaactgtctcaaaataacaatactaatgatactatcaccaccaatataattattgagacgtttaaaaaaatgtttgcatatgcccttctcattctatcccctccattcattctctccattttaacagatgtgctgtatattatctgagcctatactcattactctaccttcctctttttaactctcttaatactacaaagaattccatgtttaggccaggtgcggcagcgcacacctgtaatcccagcactttgggaggctgagacaggcagatcacctgaggtcaggagtttgagaccagcctggccaacatagtgaaacccttctctactaaaaatacaaaaattagtgggggtgtgctggcgggcactgtaatctcagctacttgggagcttgaggcaggagaattgcttgaacccaggaagtggaggttgcagtgagccgagatcacaccattgcactccagcctgggcgacaagagtgaaactccatctcaaaaataaataaataaataaaatcagaattccatgtttaatgctttccactggtttttgttgctgttgttgttgttgttttgttttgttttctgacacagagtctcactgtatcacccaggctgaagtacattggtgcaatcttggctcactgcatctccaccccaggttcaagcgattctcctgcctcagcctcccaagcagctgggattacaggtatgtagcacaatgcccggctaatttttgtatttttaatagagacagagtttcaccgtgttggctaggctggtctcaaactcctggcctcaagtgattcacccgccttggcctcccaaaatgttgggattacaagcatgagccactgtgcctggcccagtggtttttattactgaacccgttctttagtggatttcctggaaggactacaatattctctgtgaatgatattccctaaacttttgcatattaatagcagtttatttctggcctttatgcttgaaaatcagtttgctaaatataaaattgttggctcacattttctttcttaagatatttcattttcatctgatgacagaaatctaattttctttcccttacaagttacttgctcttttcaccaggttgcccaagtagtttttaaaattttttgtttaatttccagtcattttacctgactacatcttggtgctgtttgttttaggtcagtagtctcagttatgtggtattctcttccaaaatgtaatttatattttttttatttcagtaaagattgatttttgaattacaggttttagaatagttccgttctcttgccttggtttggttcttaagaggactcatgttagccatatgttgtatctttgttgtttctcttcaatatctgccacttttctcaaatcttttctctttcttcatttttaaaaatattttttaaatgttcctcctttctacattctacttaaggcatcatctgttgtatttatttcttctgtgttccttttgctttagtcttcattttgtatttattttttattttttattttttgagacagaatttcgctctgtcgcccaggctgaagtgcagttgcgtgatctctgctcaccacaacctccacctcccgggttcaagcaattctcctgcctcagcctcccaagtaggtgggattataggtgcctgccacagtgcccggctaatttttatatttgttagtagagatgaggtttcaccatgttggccaggctggtctcaaactcctgacctcaggtgatccacctgtctcagcctcccaaagtgctgggattacaggcatgagccactgtgcttggcctattttttttcttttatttataagtttctttcctgagttctgtcacctcatttctgagttctccaagttctttttgatgttgtgttttcatatatcattttctttctttttttttttttctgagatggagtctcattctgttgcccaggctggagtgcagtggcacgatctcagcttactgcaacctctgcctcctgagttcaagcgattctcctgtctcagcctcccaagtagctgggattacaggcgggcatcaccacactcagctaatttttgaatttttactagagatggggtttcaccatgttgaccaggctggtatcaaactcctggcctcaagtgatccacccacctcagcctcccaaagtgctgggattataaacgtgaaccactgcacctggccatatcattttcttaatacatttcagtttattttgaaaatagatgattatagtttttatctgttctctgttcacatcttattggtatgcttttattatttatagaaatataattctgctgcttattctcttatcataattttgtatgatatttggcttatatattttctgttattcatttttgtgtgaaattacttttcctatgcttttaaaaagagatgtggttcagggtagcattttgaacttgagagagcttcctcctctattgttttcatgtagtgttaaaaaatatggcagcttgctttctgagattctttagctctattagccttcctaattttttttttttttttttttttttttgagacagagtctcacgctttcgctaggctggagtgcagtagcaggatctcggctcattgcaacctccaccctcccgggttcaagtgattctcctgcctcagcctcctgagtagctggggctacaggcatgcaccaccacacccagataatttttgtatttttagtagaaacgggatttcaccatgttagccagatggtctccatctcttgacctcgtgatccgcctgccttggccccccaaagtgctgggattacaagcgtgagccaccgcgcctggccattagccttcctaatttttatctggatcttctcttttcttcatctttatttatgtctgtcctgatcaattttgattccatttctagcagtttttcctcagtatgagaccctgttctggagggaaaccctggcatgccagctttaggattcacataggccgagctgctctagtcctttaagacgttaaagcagttcccttgcatttagtcactattgggcaaaaaacctcccagtttcagctgttgttcgcaaattagtcaagctttctaatgaatgcctgctggctagttagaggaattcctatcctcagatctgttagctgtagcgttgcttccttctgcttctttctgcacagctgatgatgccacacaagtcttgcagctgccgatagtttgtcctcaccaatttggattttgcagttaatggggatatatcatcacctgatattagtctgtttaggctaatataacaaaatacagactgtgtggcttaaacaacagaaacttattttctcccagttctggaggctggagagtccaagatcaaagttcagcagtgttcaatttctggtgagggctcttttcctggcttgcacatggccaccttcttgctctgtcctcatacaatctttccttgatgcctgtaatggaagaaagagagatcttccccctcttataaggccaccagtcctattggattatggccccaccatcatgacctcattttttttttttttttttgggacggagtctcgctttgttgcccaggctggagtgcagtggcgcaaactcggctcactgcaagctccacctcccgggttcacgccattctcctgcctcagcctcccaggtagctgggactacaggcacccgccatcacgctcggctaaattttttttgtatttttcggtagagacggggtttcaccctgttagctaggatggtctcaatctcctgacctcatgatctgcccacctcggcctcccaaagtgctgggattacaggcataagccactgcgcctggccaacctcatttaatcttaataacctcctacaagcccaatctccaaatcacatttgaagttacactgggggttaagccttcaatatataaatttgtggtgggtagggggcaattcagtccatagcacctaggtttttttttttttctctttttttgagacagaggcttgctctgtcacccaggctggagtgtagtgatgcaatcctggctcactgcaacctccacctcccgggttcaatgattctcctgcctcagcgtcccgagtagctaggactacaggcatgtgccaccacacctgactaatttttgtattttttgtagaaacaaggtttcaccatgttggcaaggctgatctcaaactcctgacctcaagtgatccacctgcctcgggcccccaaagtgctgggatttcaggccatagcacctagttattttgtaaacactgtccatggattttttgttttgtcacccagttgctatgcttttaattgtggatccagaaagattaaaaagcttggccgggcggagtggcttatgcctgtaatcccagtactttgggaggctgaggcaggaggatcacttgagcccagaagtttgagaccaacccaggcaatgcagtgagattccatctctacaaaaaatttaaaaattagccaagcatggtggcatgtgcctgtagtcccagctgcttgggaggctgaggtgagaggattggttaaacctgagaggtcaaggctgcagtgggccatgattgtgccactgcactgcagcctgggcaacagagcaagaccctgttctcaagagaaaaaactatgtcacttaatatgctaagtgaaataagccagtcacaaaggacaaatactgtatgattccactaatgtgaggtacctagagtagttaaaatcatggagacagaaagtaaaatgattgtcgtccaggactggggttaagagggaatgaggaattattttttgttcagtggaacagagtttcagtttcggaagatggaaaaagttctggagatagacatggcgatggttgcacaacaatgtgaatgtgctaaatatcactgaattgtacacttagaatggctacaatggtcatttttggttatgtgtattttactctaataaaaaaggaaaaatagaaacacatacaacagcagtccccaaccttttcagcaccagggactagttttatggaagataatttttccacagaccagggtagggagatggtttcaggatgattcaagtgcctcacatttattgtgcacttgatttctgttattattacattgtaatataaaatgaagtaattatacaactcaccataatgtagagtcagtgggagccctgagctagttttcctgcaaatagatggtcccgtctgggggtgatgagagacaatgacagatcatcaggcattagattctcataaggagcaacctagatcccttgcatgtgcagttcacagtagggtttatgctcctgtaagaacctaatgctgccactgatctgacaggaggcagagctcaggcagtaatacgagtagtggggagcagctgtaaatacagatgacgcctcgctcacgccgctcacctcctgctgtgcagcctggttcctaaaaggcttcaaccccaaccccctggggttgaggacccctgacatagaagaccccaaaaaaggaccccatcaaaatttgaatgattccacccatcaatcactgtgctgggattccaccaacccttcacttgactggagaataaagaataaagactatgagtccactaaaatgattgtgaaatataaagataggtcttaccacatctgtaagtctttttcttctcctgtagcctgaaataaaaatagacaaagagactgggcgcggtggctcatgcctgtaatcctagcactttaggaggccaaggcgggcagatcacgaggtcaggagttgcagaccagcctgaccaacacggtgaaaccgttaagttaggaaagaacctaacttcttgattttgtattctctactgaaaatacaaaaattagccaggtgtggtggcacacacctgtaatcccagctactcaggaggctgaggcaggagaattgcttgaacctggaaggcggaggttgtagtgagctgagatcatgccgctgcactccagcctgggtgacagagcgagactccatctcaaaaaaaaaaaaaaaaaaaaaaggacaaaaaagaaatgtctacctttatggctgaagttttatttcacaaatattcaagtgcctattatatgcaagatattatgtcaggagctgaggaaaatgtgagaatgaagcatatacaagaagctcagaatcctgaaggggatatgtacatgcataagtttttccatgaataattttaatacaagagaaaatatgaagtatgccctgttctgtgcccctaaggtgctctgtgatcacagctcactgcagcctcaacctcctgggctcaaatgatccttccacctcggtctcccgagtagctgggactacaggcacatgtcatcacgcccggctaatttttttatttttagtagagatggggtttcacaatgttgcccagggtggttttgaattcctgagctcaggcaatctgcccacctcggcctcccaaagtgctaggattacaggcgtgagccactgtgcccggcctgatgcaaagttgtttgttgttgttgttgttattgtttttgtggtttgagacagggtctcactttgtcacccaggctggagtggagtgacatgatttcggcttactgcaacctcgacctcctatgttcaagctatcctcctccctcagccccacaaatggttgggactataggcgcacactaccatgcttggctagtatttgcattttttgtggagacggggtgtcaccatgttgcccaggctggtcttgaacttctgagctcaagtgatccacctgcctcggcttcccaaaatgctaggattacaggtgtgagccactgtaccaggcctcaaagttctttttcatctttagcatctcttgctgtgagcctcatgacctgcctagctgcccttctgatcttgtagaagagtctatgaagcagacttgaatcttacatgaacagatacttcaccaaaaaggatatctaaatgttcatatggaaatttactcatgctcactagtcataagaaatatgtaaattaaaacaaaaatactactatacacccatcagaatgactacaattaaaaagatcaataataccaagtgttggcaaggatgtgaagaaactagtactctcgtggttctggtaggagtgtaaattagtacagctacttgagacgtttggcaatatgcactgaagctgaatttacacttatcctatatcccagcaattctattcctaagtatgtagataacagaaatgcacacgtgctcacaaaagacatgtgcaagaatattcattgcagcaccattcctgatagcgctaaatgggaaataacacaaatattcaccaatagtagaatgaatgaatacattgtgttatattcaaactatggtgcactataaagtaatgagagttatggagccacccctattcacaataacctggaagaatcccattaatataatgttgaatgaaagaagctagacacaaaaggctatagatggggtcaggcaccatagctcacacctgtaatcctaacactttgggaggccgaggtgggtggatcgcttgaggtcaggagttggagaccagcctggccaacatggtgaaaccccatctctattaaaaatacaaaaaaattagccaggcatggtggcgggtgcctataatcccagctaatctggtggctgaggcaggagaatcactggaacccaggaggcggaggttgcagtgagccgagatcacgccactgcactccagcctgggcaacagagtgagactctgtctcaaaaaacaaacaaacaaaacaaagcaacaaaacacatggaaagccaaatataatcacaagcctgcctggagagctagaatcagagcaccacaatgggagagggggtcaagggagaataagagtgtgctttcaagaccctcacagtaaagatggatctgccgctagaattgcacaggatgtgactttggcccagggctccctctcccccagcagtgttcagatgagcatcaccagtgtcacctcagggactgtcctgggttcagcctctccagtggtaactcatcccctttcttgtctcttacttcagctatgctggaggacatttgttggttgtcttatccattttcccacatcactcccagagatccctggcctcttttcaacagaccatactttccctttggggatcaatccatgtagttcctgggatgtggcttcacataagccaagccattcagcacagtccatcctctgagcccagtgatgggttcagcatgttagccacaaatgctaggatgctgaaactatatttttcactgggcatgaatgagaaagcacatagccatgggggctttctgaggactgtaaggggagccagcctcagagtattctcacatggactaaggcagaagggagggctggaaagaacctaacttcttgatgattttggtaaactgctggatcaagtaacaacaacccctctgaacttttcagtttcttaagccaagaaattacttcttgtgtataaaccagtttgtagtggtctggcagacctagttgactatgcaatatctattcttatttatttatttatttatttatttttgagacaggattttgctctgtcacccaggctggagtgcagtggtgtaatcacagctcactgcagccttgacctcctgggctcaagtcatcctcccacctcagcctctcaagtagctggaaccacaggtgcacaccaccatgcccaactaattttttttttttaattttctgtagtaggcaaggcacagtggctcatgcctataatcccagcactttgggaggccaaggcagaaggatcacttgacccccaggagtttgagcccaccctgggcaacatatcaagaccccatctctgtaattaattaataaatatatgttttgcagtgatggcgtctcaatatgttgcccaggctggtctcaacctcctgggctcaagagatcctcctacatcagcctcccaaagtgctggaatgacagatgtgagtcaccacactgcctggcctattctctccttctcacagaacccccattttatttagagtttttagatatttatctccccacattcttccagagctaaggatgtcaatgtggccaataaggtacaagtgaaagtcactgggtggtatttttggaaaagcaattgattacctgattcaaaaagaagaagaagccagtctcaactggcacatgcattctgccttcccctacccacttcttcctacctgcaaaccagaagagttacagccaccttgtgatcatgaagccaaaagacacacactaaggatggctgaagaagataaaaagagccagattccttgagctgctgcgagagtcctggactgcctatcccagtctcctcgtaatgtaaaaaaagtaaacccctttcttgttaagcctttgctttgctgggtttgttaagtgcagccaagcgcattcctatcaaatagagaattaggtccactgaagtggggtgctgcacataatatcatctgaaacgtggacttcgttgagtggtagagacggagctttgggcagtgggggcacagatactgcagacgggaatgctgacaaccctgctatgctgtgggaaaacatttggtcgatctgctattttatgggagacaccccacataccagccaagtctgtagtgatagggtaaatggctagaataattcagaatgttggcacatgctggtgacttcattccactttcgatgaattcttgaaggagaccagtgaacttgaattatccaggctgaaggaaaaaaggaaggcagtgctacttcactaagtagtacttctgcctatggcctgcaaatctactttgaaggagcatttcataatttggagaattgcagggctgaaaaagacaattgctctgggccaggcatagtggctcatgcctgtattcctagcactttgggaggctaaggtgggcagatcgcttgagcccaggagtttgagaccaacctgggcaacatagcaagaccgcgtctctacaaaacatacaaaaacttagcctggtgtggtggcatgtgcctgtagtcttaactacttgggaggctgaggcaagaagatcacctgagcctaggaaggttgaggctgcagtgagccgtgatcacaccactgcactctagccggggcaacagagccaaacaagaccctgtttcaaaaaaaaaaaaaaaaaagataattgctcttttctccatataggagtagtggctgccaagcaatatggtagaagaaggtaagactggttggtatcttgggcctttcctaagcaccttcctctaagaattcattcagcagaggaagtggagtccgcaaagtggtttcttcccactagaatcttttgtttcaaattgtctcaagtcaataatcattaagttaaaggctaaagggacaggcaggacacaaaggccagtagccaacaaaggaaggttttcaggtctaaaagactatggccatataggagatttggctatggcgactcaaacgtaggatcaaccagaggcaaatacactgagagcctacaacaatttttaaggaatcatatcaccaaaaatgaaaatttaaaaacctggccagcaaaagcgtataattcttcaatcccaggttcctaaactcacacaacagaaagcatattctccccaaagttcacttcagatatggttaagaggataatgaacaagaagccgtctcaaaagaagatggaacttggaccacagagtacaatagagaagggaattcctcctagagaataggttggctgaacaaggaaattattccctgcctggaagggagtcctggccactcctgtctagcaggatctgacatttgttatagatccaatatttgcaatagctttgacatgcttaaaacagagagattctttcctttattcacattcttccttgtcctacattgaagttttattctgttccttctccattattgtatatgagacatgctgggggaagataacttgccttttagcttacagattactggactgtgaagattcacatcaagactaaatggagaaagctgtatatcagctgcagattctgggttttgagatggatgtaggctctgggtgagactttggcactgtctaccttagaaagggagtatattctgtgcatgtgaggatggatagccaagggtgggctatggcagtcactgctttccttctacccaatgactggtctccttttcttcttgactagtacaaccctgaatttgatggaggaagtaatgtgtatttgtccatttttcatgctgctgataaagacatacccgagactgggcaatttacaaatgaaagaggtttattggacttacaattctacgtggctggggacacctcaccaacatggcagaaggtgaaaggcacgtctcacgtggcagcagacaagagaagggaatgagagccaagcgaaacaggtttccccttatcaaaccatcagatctcgtgagacttactcactaccacaagaacagtatgggggaaccacccccatgattcaattatcccccactgggtccctcccacaacatgtgggaattttgggagtacaattcaagatgagatttgggtggggacacagccacaccatatcacaatgtgtccagctaaaacattacaattccctgcctcccttgcaactggggatgacctcgacctctctggccagtaaaacgctgccaaggttatctggaaaagcttcgtcttccagttgtaggtgctactccatctctcctttgcacccctttgccagaaccagatggaaactggaattttcagaaaagactgttgagcatcagaaatggttaatatgtgcctaaccttgtttaaacaaagtgagtgaagtaaggacaaatttataaatatgtgaaaagactactttttcctcttagtttctttaaaatgcatgcagccgtttaaaaataagtagaagctttctttttttatgctctggaacattttaagtagctgtgaaggtttggtaaattctcctgtgaatccatctgggccttgtgacttgttaaagagcaattcgttaatttgtttaaatgttctgtgtttaccagggtcaatttgggtaagtaatatttttgtagaaaattatttatttaatctaggttttcaaaggcatttgtctaggcttgagaaaagtagtatcttaggatttgtaaattgtcttctgtttcagtggttgtcctctttgtcatttcttatcttgcacactgatgcctttttcctttccttttttaaaaaaaaaattatgaatacataatagtcataaatatttatggaacgcatgtgatattttcataaaagcatacaatatgtaatgttcaaatctgggtaactgggatatccttcacctcaaataccatctctttgtgttgggaacatatccttttgttcttgattaggttagctagcagttcgtctacttgactgatttgttttctctaagaaacagcagttcagttaatttatgttttttatattttttcttttttttgaaacaatccattttttattcaaatagaataatatttaacaatcaaggtcatatgacttaaaatcttctgagctgggtttaggattcagatagatagtttattgtcagttgacattaaaacaatgttcttggccaggcacagtggctcatgcctgtaattccagcactttgggaggctgaggcaggtcaatcacctgatgtcaggagttcgagaccagcctggccatcatagcgaaaccccgtctctactaaaaatgcaaaaattagctgggcatggtggcgggcatctgtaatcccagctacttaggaggctgaggcaagagactcgcttgaacccggaaggcagaggttgcagtgagctgagattgcaccactgcactccagcctgcacaagagcaaaactccgtctcgaaaaaaaaaaaaaagaaaaaaagaaaaaaaattatttgcatcaaagttatacaaacaggttttttttagttttaaaatcaaatttatggccagacacagtggctcacacctgtaatcctggcactttgggaggtcaaggtaggtggatcacctgaggtcaggagttcgagaccaggctggcaacatggtgaaacctcatctctattaaaaatacaaaaattagctaggcgtagtggcacacacctgtagtcccagctcctgaggaggctgaggcacaagaatcacacttaagcccaggcagaggaggttgcagtaagctgagatcatgatactgcactccagcctgggtgacagagtaagaccctttctcaaaaaaaaaaaaaaaaaaaaaactttatttaggcctaatttccatgcaataaaattattttaactgtacaatatgatgacttttgacatatatacacaatagtataagtactaccacaatcaagattcaattataactcatgcctctttgtcagcacttttcatccccaatttcagcagctggtaactttaaggttttgccttttccagaatgtcacataaatggaatcatactgtgtccggaattggtgggttcttggtctcactgacttcaagaatgacgccatgggccctcgcggtgagtgttacagctcttaaggtggcgcgtctggagtttgttccttctgatgttcggatgtgttcggagtttcttccttctggtgggttcgtggtctcgctggctcaggagtgaagctgcagactttcgcggtgagtgttacagctcttaaggcagcacgtctggagttgtttgttcctcccggtgggctcatggtctcgctggcttcaagagtgaagctgcagacctttgctgtgagtgttacagtttataaaagcagcgtggacccaaagagtgagcagtagcaagatttatcgcaaagagcgaaagaacaaagcttccacagtgtggaaggggacccgagcgggttgccactgctagctcgggcagcctgcttttattctcttatctggccccacccacatcctgctgattggtagagccaagtggtctgttttgacagggcgctgattggtgcatttacaatccctgagctagacacaaaggttctccatggccccatcagattagttagacacagagtatcgacacaaaggttctccaaggccccaccagagcagctagatacagagtgtcgattggtgcactcacaaaccctaagctagacataaatgttctccaaggccccaccagagtagctagatacagagtgtcaactggtgcactcacaaaccctgagctagacacagggtgctgattggtgtgtttacaaaccttgaggtagatacagagtgccgattggtgtatttacaatccctgagctagacataaaggttctccaaggccccaccagagtagccagatacagagtgtcgattggtgcattcacaaaccctgagctagacacagggtgctgattggagtgtttacaaaccttgagctagatacagagtgccgattggtgtgtttacaatcactgagctagacataaaggttctccaaggccccaccagagcagttagatagagtgtggattggtgcactcacaaaccctgagctagacacagggtgctgataggtgtgtttacaaaccttgagctagatacagagtgccgattggtgtatttacaatccctgagctagacataaaagtcctccaaggccccaccagactcaggagctcagctggcttcacccagtgaatcccacacctgcgctgcaggtggagctgcctgccagtcccagtgccatacgcccgcactcctcagcccttgggtggtggatgggactgggcgccgtggagcagggggcggcgctcatcagggaggctcaggctgcacaggaacccacggagtgggtgggaggctcaggcatggggggctgcaggtcccaagccctgcccggcgggaaggcagctaagcctccgtgagaaattgagcgcagcgccggtgggctggcactgctgggggacccagtacaccctccgcagctgctggcccgggtgctaagtccctcattgcccggggccagcagggctggccgactgctccgagtgcggggccgccaagcccacgcccacccggaactccagctggcccgcaagcgcctcacgcagccccggttcccgctcgcgcctctccctccacacctccctgcaagctgagggagtgggctccagccttggccagcccagaaaggggctcccacagtgcagtggtgggctgaagggctcctcaagtgccgccaaactgggagcccaggcagaggaggtgccgagagcaagcgagggctctgaggactgccagcacgctgtcacctctcaatacagtatgtagccctttgagtctgttttctctcactcagcataacgattatgatatttgtccatgttgatgtgggcatcaatttataaaaacaattttaatgcaaacattcaatagggcttctttcccattttcccaagatttcatctctctctctgctatggacacagatggcttcactccatcctgtattcttcggaccatgataaaattccagactctcggtagtttttgcgttccaagaagtagagcctagagtggtggcctataattacagttactcaggaggctgaggcaggaggatcctttgagtccagcagtttgaggccagcctggacaccacagcaagaccaccaataaataaataaataaatggaacatgtttccctgtcatggtcattttcatccattcctctggtagaagcatcagattccttcaagcaagggtttatgttggggtctctcaatctctgcgttagcacaggcatccagtcttcttatggagggggacggggaggtggaatggagaaacgagagaggcgaatcagagacctcactgccttctgcccattggtgctgcccgtggacggctggcacaggggagcaccccatgcttctgccttcaatggtgcggggaggggcagaggacaaggaaacgcaggaaactaggagtggggcaggcagacatgcttcaaaggctggagccaaggagggtgcagggagagttgggagttcctggaccaggcaggggtcacctcctcaccacagccagaatagctctaccagtgcccatgccatctccagctccaaacaccgttttttctgtttcctaattcattaatttctttctttttttttggagatggagtctcactctgttgcccagcctgtagtacagtggaacaatctcagctcactgcaacctctgcctcccaggttcaagtgattctcctgcctcagcctcctgagtagctgggattacaggtacgcgccaccatgtgcctggctaatttttgtatttttagtagagacagggtttcgccatgttgcccaggctggtctcgaactcctaagctaaaagtgatcacctgcctcagcctctcaaagtgctgggattacaggcgtgagctactgcccccggccctcacttattaatttctatttatgtctatattcattcctaccttctactttctcttggtttactttgcttttttcctttttagttgatgtttacttttactgatatgtgtatttgatgtaatacatttcctaacaatgcttttgcagtacctcataaattcagataagctgtgttttcattattgttattttataaaattctgcaattttggtttgtattaccctgttgactcaagagttgctcgatcgagttctttaaaatttctaggctgggcatggtggctcacacctgtaatcccagcactttgggaggccaaggggggcagatcacttgaggtcaggaattcaagaccagcctggccaacatggtgaaacctcgtctctactaaaaatacaaaaattagctggacgtggtggcaggcacctgtaatcccagctacttgggaggctgaagcacgagaattgcttgaactcgggaggcagaggttgcagtgagccaagatcgcgccactgcactccatccagcctgagagacagaacgagactccatctcggaaaaaaaaaaaaaaattctagttcgaaaagtctttttacttttaattttgttaatttgtcattgtattgcattttgtgatcagagaatgttgtttctgctattgctagttcacgaatgtttctttcaattactcagtagacagttctctgatccaccaattctcaggatacggtcctctccttctggggctaattctagccaatgctatctgtgtgctgccacctccaggacctggctgcactctgctgtcttccacacaaccctcctgacttcccgttcagaagtgagctctagacctagctctgctggtttcagatatttatctccccatttatatgtaaattgaagtttgaggtatgccctgtctcctagtgatgctgtgagggatggggtgatttatttaagttgctttcattgtcaatctgtatggtttgtgaaggactgtgaagggattttaggcatctgccattattccacgagaatcaggaagctttgtgctttctttttattgtatctttgctgctttttcttcattcctgcctcccattggcttaatcaaattttcttttttgcccttcccttcccatccacattgaagtcatagttccatttcggttctctcagtggtatcccttaaaagcacagcatccacatttagcttagcaaactctaaagttaatcagtatcaccacctccctcccaaacagtatgaagatcttagaatgctccaattcccagccaggcatggtggcccatgcctgtaatcccagctcattgggaggctgagacaggaggacctcttgaggccaggaggaccccttgagaccagcctgggcaacatagcaagaccttgtctctacaaaaaataaaaatatttagctgggtgtggtggcacgcatctgtaatgtcagctactcgggaggctgaggtgagaggatggcttgagcccaggaattcaaggctgcagtgagctatgatagtgtcactacacctcagcctggaatcctgtctcttactaaaaaaaaaaaaaaaattgctttttttttttgagatggagtcttgctctgtcgcccaggctggagtgcagtggcatgatctcggctcactacaacctctgcctcccgggttcaagcgattctcctgcttcagcctcccaagtagctgggactacaggcatgtgccaccatgcctggctaattttttttttttttttttttagagacagggtttcaccatgttggccaggctggtctccaactcctgacctcaggtgatccacccacctcagcctctaaaagtgctgggattacaggcgtgagccactgcacctggccaaaaagaatgctttgactctcatcatctccctctcaccgtattattaattcaacaaacatttgtgagtgcctaccacatgccaagttgatacagtaatgaagaaaagaagaggaaagggagggaatgggagagaatctctgtgctaatggattacattttggtgggagagataaacaagatgcaaaattaaaatctgtagtgtgggccagcagtggtggctcacatttgtaatccaacactttgggagggcaaggcgggtggatcatttgaggtaagaagttcaagaccagcctggtcaacatggtgaaaccctgtctctactaaaaatacaaaaattagctgggcgtgttggtacatgcctgtaatcccagctatccaggaggctgtggcaggaggatcacttgaacctgggaggcggaggttgcagtgagccaagatcacgccattgcactctagcctgggtgacagagcaaggctttgtctcaaaaaaaaaaaattttttttagtaggttgcacagtgaaaagtactaaggtgcaaaacactaaagcagggtaggagaatatgaagtgatgtggccacgagaagcctcactagaaaagtaaatttttgttgtgttttggagacggggtctcactctgtcacccagactggaatgtagtggtgctatcacagctcacacagcctcaacttccccacctcagcttcccaattagctggaattacaggcacatgccccacactgggctaatttttctattttttagagatgaagatttccccatgttgcccagttgcccaggctggcctcaaactccttgggctcaaatgatttgcccacctcagcctcactgggattactggcatgaaccactgtgcctggcctgaatgttttcttttcttcgagaccgagtcttactgttgcccaggttagagtgcaatggcacagtctcagctcactgcaacctccgcctcctgggttcagttgactttcctgcctcagccccccggagaagctgggattacaggtgcccgccaccacacccagctaattttgtatttttagtagagatgggtttcaccatgttggccaggccagcctcaaactcctgacctcaggtgatccacccgcatcggcttctcaaagtgctgggattacaggcatgagccactgcgcccagctgaattttgtttgtttgtttgtttgtttattttgagatggagtctcgctctgttacccaggatggagtgtagtgacgcgatcttggctcactccaacctctgcttcccaggtttaagggattctcatgcctcagcctcctgagtagctggatctacaggcacatgccaccacgcccagctaggtttttttggtagagacggggtttcaccctgttggccaggctggtctcaaactcctgccctcaagtgatccgcctaccttggcctcccaaagtgctgggattataggtgtgagccaccgcaccaggcttattttttatttttattttttttagaaacagggtcttactctgtcatctaggctggagtgtagtggcatgatcatagctcactgcaacctcaaactcctgagctcaaggtatcctctgtctcagcctcccaagtagctgagactacaggaatgtgccaccaagctggctatttattttattttctgtagaaccaaaaaaggtctcactatgttccctaggctggtctcgaactcgtggcctcaagcaatcctcccacctcagcctcccaagcactgggattacaggtatgctccaccttgcctggctgaaaggcaacttttgaattaagacatgaaggaaatgagagctagccatgtagatatcttggagaagaacattctaggcaaagagaatagcaagtaccaaagacttaaagcactttttgacatgtttaaggaacagcaaggagccctatgaggctacagtgaagagaaggaggagaagagtgataagatttttttttttttttttttttgagccagagtctcgctctgtcgccaggctggagtgcagtagcgagatctcagctcactgcaacctccgcctcacgggttcaagtggttcttgtgcctcagcctcttgagtagctgggactacgggcacataccaccatgcccagctagtttttgtatttttggtagagatgggattttgccatgttggccaggctggtctcgaattcctgacctcaagtgatccgcccgcctcagcctcccaaattcctggaattacaggtgtgtgccaccatgccagctaatttttgtatttttattagaggcagggttttgccatgttggacaggctgatctcaaactcctgacctcaagtgatctgcccaccttggcctcccaaaatgctgggattataggcgtgaaccaccacacccagccagaagagtgataggattttgaggtcacaaacctaatatggagaccaaagtagaatcgtgtggtccatattaaggattttggtctttattatgagatagagacccactgaagagtgctaagggacatggtttggcatatgctgtatcaggatcattctggttgctgtgtcaagaacaaaatgaccgggcacagtggttcacgcctgtaatcccagcactttgggaggccgaggtgggcggatcacctgaggtcgggagttcgagactagcctgaccaacatggagaaaccccatctctagtaaaaatacaaaaattagccgggcatgggtggtgcatgcctgtaatcccagctacttgggaggctgaggcaggaggatcgcttgaacctgagaggcggaggttgcagtgagccaagatcgtgccattgcactccagcctgggcaacaagagtgagactccatctcagaaaaaaaaaaaaaaaagaacaatgctggagagaaagccagctaggaagttacactaatccatgtgagagatgatggtgacctgcccagcattgggaagtaggaaggcatgggaagtgcttgaatgctgagtgtgttttgcaggcagagctgacagaattttctgactgaccaatggggtgtgagaagtgagaggccaaggaggacacccagtattttgagcaactggaagaacagagttgccattaacttcttgttgactagaatttaatcacatggcataggaggcagaattctaagaattcttcctatgatccttgccttggcataatccctttcttcctttttgaggataggtagaaatcaacatgatctcactcctgagattatgttctgttataaagcaaaaggattatccaggtgggtgtaatctaatcacaagcccttgaaaatcagtttttctggctgctgggcagaaggggaagacagagagtgtattaatcagggttctccagagaggcagaaccaatagaaaggatggatgaatagatagatagattagatagatagatagatagatagatagatagatagataaagggggtattttttaaaaaagagatggagtctcactaggatgcccaggctgttcttgaactcctgagctcaactgattctcctgtgtccacctcccaaagtgctgagattacaggcatgagccaccacacccagccagaaagtattttttaattaaggtgtgtactatgttttttttaggcataatgaatgctattgcacatgtaatagattacagtatagtgtaaacataacttttacatgcactgggaaacaaaaaaatgtgagccagtgcacctggctgagaggggatttattagaggaattggctcatgtgattatggtaggcaaaaagtcccacaatgagccatatgcaagctggagaccctgggatgctggtagcatggctcaatccaagtctgaaggcctcagaaccagggaggccaagggtgtaactctcaggccgagcccagaggcctgagaactcagggaggggagccactgatgtaagtcctggaatccaaaggccgagaagtctggagttattgtccaaggacgggagaggaagagtgtatcccagctccagcaggtagatcagcacattcatttttgccctggtttttcttctctccaagcccccagcagattgaatggtgcccacccacattgcaggcagatctttcccacctagtccactgagactcacacactaatctcctctggaaacaccttcacagagacactcaaaagaatgctttagtaggtttctacgttttccttaatccagttaagttgacacctaaaattaaccatcagagagagattccaagcataagaaaggcactgcaccaaggctgccttgaagatgtaggggactggccaggtgcagtggctcacacctgtaatctcaacactttggaaggtcaaggagggcagatcacttgaggtcaggagttcgagaccatcctggccaacatggtgaaaccccatctctactaaaaatacaaaaattagccaggcgtggtggtgcacacctgtaatcccagctacttgggaggctgagacaggagaatctcttgaacccaggaggcagaggttgcagtgagccaagatagcatcactgcactccagcctgggtggcagagcaagactctgtctcaaaaaaagaaaaaaaaaagaaagaaaagaaaaggtgtagggaccacaggaagtatcccggcagcctctgggaacacagagcagcccccgctgctcacagccaggtaggaatcaggatctcagatctacagccacaaggaactggattctgccaacctgaatgagtctagaagtagattcttttccagagcccagcccatggacaccttggtatcagccttttgggaccctgagcagagaacccagccaagcccagacttctgacctacagaactctgagataataagtgggtgttgttttaagctgctaagtctgtggtcatttgtcacactgcaatagaaaacaaacacatatggccactcctaactgagagaggttggtaaatggtgtctcaagctggatattcatgtgcattgctaaacttggaggaggagttctatgatgaaagaaagagaagcatgaatattagggagatgataagacattcttccacacactgtaaacctgccctgtccaatacagcacacactaaccacatgtgggtatcttttttttctttttttttgagatagagtctcaccctgtcgcccaggctggagtgcaagggtgtgatcttggctcactgcaacctccacctcccaggttcaagcaattctcccacctcagcctccagagtatttgggattacaggcacctgccatcatgcctggataatttttgtacttttgtagagacagggtctcgctctgttacttaggccggagtgcagtggtacaatcttggctcactgcaaccccaacctcctgggctcaagtgatcctcccatttcagcttcctgagtagctaggactacagatgcacaccaccacgcctggctaatttttgtagagacagcctcttgctatgtttcttagacttgtctcgaattcctgggctcaaatgatccaccagcctcagcctcccaaagtgctgggattgcaggcatgagccactgcgcctggtctaaaaacacccttttcattcagcactataggttttaaaaggcagtgttcccataagaaataatggcaaagaaaggaactcccagtcacattcagcaaacctgttttcccagctacattcatgcactggttgatgcaggtaagtgtacaggggaggttgatggagagataggagggtcctggaaacaaaggaagactgtgacattagatgactgcaatcgtggagactcagatggtgcttgtactaccacggttcatcttttgagtatgggcatgtcatagtctggaccagaatctaaattctagtagcaaagcaggtagggtggttattgcataaggaggtatcacaacctgtcatttggggagggtgagggaaggactggctgtcacagcttagcctcaccaaggacgtatgtgtagtgccctctggtggcctgcaatggcacgcaagccagccaaatcagaatcccccatctctcaccccccacacccccaccctcctcccagccacccccatctcaggcaagacaaagccagagtcctaactggtctccctgcttccactcctgtccaccagaatgatttgttaagatcatcagatcatgtcactcctctgctcaaaattcagggtaatttcccttctccctgagttatttagccacagtactcacagtggtctccatggctgtactcggtatggcgcctcccagcaacctttctgtctccacttcctgcccctcttccggctgctcaccctgctgtagccacaccgggctgcctgctcttcctctgccagcataacccaccaagcacactcccacctctgcatttgctgtctcccccacctggaatgcacagatgactccttcatgtccttcatatatgtgtcaaatatcaccacatcatcttttgcactaaattaaaaaacagccctcctcccagcacactatatcccctttagctggattcattttttgccatagtatttaataccatctgacgtattacatatgtatttacatatatatatgtgtgtgtgtatttatatttattacctatctcctactactaaactttctgcttttttgaaaaagcagaaactttgttttgttcccagttgaatccccaggatctagaacagtgtctagcctatagtaggtgctcaaatatatatgttggggaaataaatgaatcaagatctgaataatgagcaggcattgtatgaccttcattgtttctttcttgaatattaagacactatcacaaaaaggacaactctacaaatatatataaaattcataaaattcctattatatcccagcagctggggcaaagaaaaaaaaagaaaaaaattccagtataatcccaacagttttttttttcccaaccaccccagatacatcagacagatggtatacatctcttcgtgactcaatctgctgaacgatgcaactgtcacagtatccaacaggtttctttttaattggattaaattatctgatgatttatttggaaagaataaagtacttgtaaatagccaataaatgtagaaagaagtacagtaagggtgcacttggcttactagatctcagaagacactataaagataccacaatagcatcaatataatattggcctgggcatagacaaataaaccagtggaatagaaaagagaatccaggaatagatatctgtttttaagaacataaaatgtgaacagtgcaattttaattcagtgggatatggatggattatataataaatgatgatatctgtcaggaaaataattggacctccattttatatcatacaaaaacaagttccaagtagattaaatactaaaacatagcaggtacttttatttattcatttatttatatttatatttatatttttgaggcagggtcttactctgtcacctggcctggagtacagtggcacaatcacgcttcactgcagcctcaacctccctggctcaagcgatcttcctacctcaggcttccaagtagttgggacaggtatgtgccaccacgcctggctaattttttgtattttctatagagacagggttttgctatgttgtcccaggctggtctcgaactcctgggctcaagtgatccacccacctcaatcttccaaagtgctgggactacaggtgtgacccaccatgcatggccagcaggtccttttagaaccccaactaagttcagaatatagttaatttggtcctcaggcctatatgaagaaatattactgatttcatcaaagtcacaatttatagtgtacattcttaatcttttggttgtaaaaagtcccatttcacaactgggctgagagtatgaaagcccagattgaatgaagagggagtccgtggtgtggagagggggactggtggtggtaagaatggggtgctggagcccaagcatgaggagagtttccataggaaagtaggggtggtgactctagctgcccagctgagaatatcagagtccaagccaggtaaggaaatggttcatggaggggcaggacaagagattgatcaaataagtaaatattttgagaataatgggagtgaagcttctatttaaaatgaaagaataaatatagtaatgaggaaactagaataaaccctgtggcattagactggaattgaaggtattgggggtggattcatggttttctttttttcttttctttctttttttttttttttttttttttttggagacagagtctggctgtcacccaggctggagtatagcggtgcaatctcagctcactgcaatctccgcctcctggaatcaagcaattctcctacctcagcctcctgaatagctgggaatacaggcacgtgccaccacacccggctaacttctgtatttttagtagagacaggatttcaccatgttggccaggctggtctcgaactcctgacctcaagtgatctgcccaccttggcctcccaaagtgctgggattacaggcgtgagccaccgcacccagcccatggttttcatttgatctaaatatcttcaccatgttgaatctagacaagaggatacatcagacaaacgcagatcaagggacattctataaaataactggcctgttatcttcaaaagtggtcatgaaagtaaaggaaagactgagggactgttccagactaaagaagactaaagagggatgaaaaccaaaagcagtgttttgatcttgggttgtattcttttgcaaggacattattgggacaattggtgaaacttgaatggagtacattgatgcgactgtagtaaaacatcattgtcagtgtcctagtttggatggttgtattatacttaggtaaggaaatgttgctgtttgtgagaaatacacacagtaaagtattctcgtgggcaacagggcatgttgttggcaacatactcttaaatggctcaaggcaaaaaaaaatttttttgcccttgtcttgcaatttttctgtaagtttaacattatttcaaaataaaaagaaaaggaaaaattattgttttaactactaacccaatgaggaaataaacataaaacaaagctgcacatgcacgattagaacttctaggctaggcagggtggttcacacctgtaatcccagcattttgtgaggccaaagcaggcagatcactgagcccaggagtttgagaccagcctgcatgcgaaaccccatctctacaaaaaatacaaaaattagctgggtgtggtggtacatgcctgtagttgcagctactcaggaggcttaggtgagaggatcacttgagcctgggaggtggaggttgcagtgagccgagatcgagccactgcactccagcatgggcaacaacttctagttacatgtacctgtatacatacttcaatacaaaataattgtcaactcccagaaagaatgatttgatgtatttctagaaagaaaggagcactgggtgctgagcgtggtggctcatccctgtaatcccaacacttcgggaggctgaggtgggcagatcgcctgaggtcaggagttcgagagcagcctggccaacatggtgaaaccccatctctactaaaaatacaaaaattagcagggcatggtggcgcgcgcctgtaatcccagctactctggaggctgaggcaggagaatcgcttgaacccgggaggcagaggttgcagtgagctgagattgcaccattgcactccagcctgggcgacaagaatgagactgtgtctcaaaataataaataaataaagtaaaataaaattaagcagaacatttgttactgcccattagtctatatatatatattctagtttaaggtcacttttctttcaacacaaagtggatcaccaaagtggatctcccaaagttctgctcctgggagaattccccttcatcattgtctttcaagactgtctcagagtaatgctgtccattgcccacttgtttcctgcatctggatactaagctgacctgctgtaaaaaagcacaggcttttttctcctccttcagctccttcatataagactcctcataaagtcaaagacatgaattgagggagagtaattggttctacagtggtagggaccatgggagtctgggctacctgctcatgcagctttcccaggtcctctggtcctacttgtgactgatactagacataccgcatcaatggttttgttttgttttggtttggtttttggttttttgtttgtttgtttgtttgtttttgagacagagtctcgctctctgtctttccatgctggagtgcagtggtaccctcttggctcactgcaacctttacctgatcctcccgcctcagcatcccaagtagctgggattacaagcatgcaccaccacatccaggtactttttgtatttttagtagaggaagggtttcaccatgttggccagtctggtctcaaactcctgacctcaagtgatccgcccactcagcctcccaaagtgctgggattacagtcatgagccaccacacctggcccatgtcacattcactattatgatggagtgttgctgtgcactgctgaccttatgaattggctgttctgagaggactcaaaccataacgggaaattccagctgtgcagtcatttggtcatgatccaccattttgtttcttctaagggccagtagcataccagagttgcttttctgtggtgttttgtttttgggacagagtctcgctctgtcacacagcctacagtgcagtggcgcgatcttggctcactgcaacttccgcctcccgggttcaagtgattctcctgcctcagtctcctgagtagcttggagcacaggtgcacaccaccacaccctgctaatttttatatttttaatatagacggggtttcaccatgttggccaggctggtctcgaactcctgacctcaagtgatccacccacctcggcctcccaaagtgctgggattacaggcatgagccaccacacctggcccggagttgtttttcaacagcatgtttaaatcttcactgcagatggtagggtcttgctccagagccccagtgccacttccaaagcttgacacaaattatacatagcatcttctcccacttctgataatctgcagcaccataggatatgctgaattgtattgtcctaggagtaggactgtttacactgtagcctgtatctactgcaaagctctgtcatgctctgggcccgctttaggccttgctcaaagcttccagtctttcgtgacacctggtatatagactacagcagcatccttaggtgtagaatatgctgactctagaatctgaagagatccaccaggtgttgcgcttccttttttgtgggagaaggcataaaatgcaataatttgtcttttactttgaagaggatatcccaacatgcccctgacaactgtactcctaaaaattttagggatgttggggcttggcgcagtggctcatgcctattatctcatcactttgggaggccgaggtgagcagatcacctgaggtcaggagtttgagaccagcctggccaacacagcaaaacccccatctctactaaaaatattaaaattagctgggcatggtgatgggtgcctgtaatgccagctactcgggaggctgaggcaggagctgggaggcagaggttgcagtgagcaagatcgtgccactgcactccagcctgggtgacagagcgagactccatctcaaaaaaataaaaaaataaaaattttgctgggcgcggtggttcacacctgtaatcccagcactttgggaggctgaggcgggcggatcacgaggtcaggagatcgagaccatcctggctaacacagtgaaaccccgtctctactaaaaatacaaaaaaatagccgggcgtgctggcgggtgcctgtagtccaagctactcgggatgctgaggcaggagaatggcgtgaacccgggagtgggagcttgcactgagccgagatcacaccagtacactccagcctgggcaacagagtgagactctgtctcaaaaaaaaaaaaaatttatagatgtagaaggtccctgaatcttcacagagtgccctctgaagtgcctgtcttatttaccaaggccttcagtgtattatccatctcttgttcatctggctcattaacatattgtcatcaatgcaatggatcagcatgaaactctaaagtatgtccagatagttcagaggtgtacaatcttttggcttccctgggccacattggaagaagaattgtcttgggccacacataaaatacactaacacgaacgatagctgatgagccaaaaaataaatcacaaaaaaggctagacgcagtggctcacgcctgtaatcccagcactttgggaggccaaagtgagcagatcacttgaggtcaggagtttgagactggcctggccaacattgcaaaaccccgtctctactaaaaatacagaaattagctgggcatggtgacgggcgcctgtaatcccagctactcgggaggctgaggcaggagaatcgcttgaagctgggaggcggaagttgcagtaagctgagattacactactgcactccagcctgggtgacagagcaagactctgtctcaaaaaaaaaaaaaaattataatgttttaagaaagtttcaaagctctcctgtgccatgtacagcctgcaagccgtgggttggacaaggttgagatagtccaaatctcttcagactgtattttacatagagtggaaggcatagccctgggaggaaaacctcacatgtatattgttgcccattccatgtaaatgcaaacttttttctgactctttttctttttctgattaggataaaaaagaacacatttgccaaatcagtggttgtataatatgttcccgaggccaaagtaatctgctgtagcaaagatactacatcttacataatggctgtaatcggggctatagtacttggttgaactcatggcagtctacagtcaccttccaggatcatctggtttctataaggtcaagagtggtgaattaaacagatacatgatagaaaccaccatccctgtatcctttatatcctaaggatggaactaatttctgctgtacctactctcaacacttttctttgttgtcccccaggagtaaaccaatcctggttatgaactcagagactgggaaatgaccactgagtggctccaaggacccaatggctgtactgtaagccaggcccaagacaggatttcacttacaacctggccccatgtgcttcctgcactctaacaaggagaggttatgatggtgcttcaggcctcgagcatcattgtcatcacagaccctacatccaacagaccctgatatgtctaggtatttttctttcccaggtgcacagttacccaaataaatggccattggtctttttgagaaagaactgaggggatcattatcacatattcttgttatagtattgagggtccttcctcctagggacccagccacctctttaatcatgggattccaagtctcaagctggctctagtctgaacactaggaaagggattgtgaatttttcttgggctatggccttcagtcttctagtcatctttccttaatttcttctgctagtacaagctgagtagtacccttaacaattgcccatctaatttgcccctagggacattttgctttattagtcatctccataactctctgttggccaggtgttcctggctgccactcaaacctcaccagccatgatgataattgccattgcctagcttccggaagttaagcactgccatctggacttttgtttgtttgtttgtttcagtgtcccattatcctcattgctatcagtaagtcaagttctgtactagtctcttctattatcagtcctagcctacagaggagagcgagtacttatctttttagtactttttattctggtgagcctctcaccagcaaattctttctttttttttttgagtcagagtcttgctctgtcactcaggctggagtgcagtggcacgatcttggctcactgcaacctccgcctcccaggttcaaacaattctcgaacctcagcctctcgagtagctgggattacaggcacctgccaccacacccagctaattttgtgtgtgtgtgtgtgtgtgtatatatatgtgtgtgtgtgtgtgtatatatatatatatatatatatttttttttttttttttttttgagacagagtctcgctgttgcccaggctgtagtgcaatggcaaaattttggctcactgcaacctccgcctcccgggttcaagtgattctcctgcctcaacctctcaagtagctgagattacaggcatgcaccaccacacccagctaatttttgtatttttagtagagatggggtttcaccatgttggtcaggctaatctcgaactcctgacctcaggtgtttcacccgccttggcctcccaaagtgctgggattacaggcatgagccaccaaacccagccctttttttttttttttttttttgagatagagtctcgctctgtcacccaggctggagtgcagtggcacaatctcggctcactacaacctccgctgcctgggttcaagcgattctgcctcagtcttccaagtagctggaattacaggtatacaccaccatgcctggctaatttttgtatttttcttttttttttttttttttttttgagaaggagtctcgctctgtctcccaggctggagtgcagtggcacaatcttggctcactgcaagctccacctcctgggttcacgccattctcctgcctcagcctcccaagtagctgggactacaggtgcccgctaccacgcccagctaattttttgtattttttttagtagagacggggtttcaccgtgttagccaggatggtctcgatctcctgacctcttgatccgcccgcctcggcctcccaaagtgctgggattatagacgtgagacactgcgcccggccaatttttctattttttagtagagacggggtttcaccatgttggccaggctggtctcgaactcctgacctcaagtgatccacccactttggcctcccaaagtgctgggattataggcgtgagccaccacgcccggcctaatttttatatttttttggagagacagggtttcaccatgttggccaggctggtctcaaactcctgacctcaagtgatccacccacctcggacttccaaagtgctaggattacaggtgtgagccaccatgccgggcagcaaattcttcacggccttgataagtagtgtgttgttatggtttgaatgtggcccctaaaaatctgtgtgttagaaacttaattgttctcccctcataaatggattaatgtcagttctgccctcatgaatgaatatatggagtaatgagagttctgccctcttgaatggagtaatgtcattatcatgggagtaggttcgttatcacgggaatggctttgcaataaaaacaagctttgtttttttgttataaaagcaagctctatcatgggaatggctttgttataaaagcaagcaagagtaaccagaatctttctggttgccctctcaccatgtgatgttctctgctatgttatgacacagcaagaaggatctcaccagatcctgacttcaggctcttgggcttcccagcctccagaaccatgaactcagtaaacttcttataaactacccagtctgtgctatgcagtgagagcaacagaaaacagatgaaaacgtgttctctgggccttctcatgaggcataattagctaggagatcttctggttacctatagtctatccattctggcacacctatttccctgagtcttttcattctaccatcactatctgccatagcaattccggcatgtaagctttctttggcataggtcatcactttttccatgcttctaggatccatcctggtagtaagattgtaccatctcctattgtccttgccaggatgttaaatcttgtattttgaaagagagattcctgccgggcgcagtggctcacacctgaaatcccggcactttgggaggccgaggcaggcggatcacaaggtcaggagttcgagaccagcctggccaacatggtgaaatcccgtctctactaaaaatacaaaaattatctgggcatggtggcacgtgcctgtaatcccagctactcgagaggctgaggcaggaaagttgtttgaacccgggaggcagaggttgcagtgaactgagattgcgccattgcactccagcctgacagggtgagactccatctcaaaaagaaagaaaagaaacgaaaagaaacaaagagggattcccaagtcaataaactcttccctatccaattttatattccttctccttcatcaagcactctcagaatccagttccacatgtatctccctggctcctgccaatacatgctggctaggtcttgctatttctgtggcatatagtccctttccacccctatcatacccagcacctctccagctgggttatgctgtagctaacctagtataggctaggaggcaatgtgggggcagattctgagggggagctgttgctttgtggagaaaggcactgcattgtccctcagcagggagagagtggtagttcttactagggaggagtgggccaattctgtaggctcaggagattcagaggaatttgtggagtcaaaatattcaggagaggccaaggcgagtggatcacttatggtcaggagttcgagaccaacctggccaacatggtgaaaccccgtctccactaaaaatacaaaaaaaactagctgggcatggtggtgcatgactgtagtcccagctacttgggaggctgtggcaggagagtcgcttgaatcctggaggcagaggctgcagtgagtcaacatcacaccactgcactccagcctgggagacagagcgagactccgtctcaaaaaaaaaatctttaggagcatccactctgatatctccattccacgtgtcagggtcccaagcttttccaaccaggactttgactttagcataagagatgtgccttatttggacatttaactgtctttgaagtcagttgctcagattattattattattattattttagatggagtcttgcactgtcccccaggccggagtgcagtggcacgatctccattcactgcaacctctgcctcccaggttcaagcgattctcctgcctcagcctccctagtagctgggattacaggcgcacgccaccatgcccagctaattttttgtatttttagtacagacggggtttcactatcttagccaggctggtcttgaactcctgacctggtgatctgcccgcctcagcctcccaaagtgctgggattacaggtgtgggccaccacgcctggccagttgcttagattattaagtcctaggctttgtccttgcttttctccaccctttcactgctagagatgttggcttatttgtataaaccaaagaggccttttccttttcataacctggatttttttttttttttttttttgagatgatcttactctgttgcccaggctgaagtgcagtggcacgatcttggctcactataacctttgcctcccggattcaagcaattctcctgcctcagcctcccaagtagctgggactacaggtatgtgccatcacgcctgactaatttttgtatttttagcagagatggggtttcgccatgttggccaggctggtctcaaactcctaaccttaggtgatccacctgccttggcctcccaaagtgctgggattacaggcatgagccattgcacctggccccataacctggattttaatgcatgttactggccctaagttgtttattatcctgtagcacatccatggagcttggcaatagccaccaattccatcatcctcatagctactactccctccatacatctcaagtacctggcacattgtgcccttagagtatccagttctactggtacattctcccaatttgctgccatttgtctgtgctctgcccacctccactaatgggatcctcatcatcagatgggtggtgatccagttccaaaccccatcttaccatctcctttctcatctactttggtagcaactgtggaagaccagattctcaagaaggagatgctgagatagagtttgggaggcaaaatgtttattaaggacccatacctgtgaaaggaaggaagaaaaagcaggactgggcagagggaaagtcaacctgtgctgcaggctcgaccaagctcagccgatcagcaggtcactctagaatgagaagtgctcatcagggctttccagcatcaagtttaaatggctggacctttatacctctgccttgctcagtcaccaaatgtgggctaccccaggaagggcatgacctcaggtgaggcagccctgcagctgaagcaggctctgaaggaactgaaagctggtattgtctgctgccctctctctgcagctaggcagcatgtcctttcttgaaggcgatctgggcaacacatcaccatgtgtctcacaatgacatacagacatgaagggacataaatcctaagtatacaatttggtgaactcacccagctcaaaaagtagaaatgatctgcatcacagaacccccatttattcctcttctcagtcaatctctcttcccaaggtaaccactatccttcttctatcaccatagactcatttacctgctttttaaatttttaactgtggtcaaatacacataatataaaacttaccatgtgagccatttttaagtgtgcagtgcagccgtgttaaatacattcacattgttgtgcaaccaatctccaaaactcttcatcttgcaaaactaaaactctgtacccattaaacaaatccccattatcttttcccaagcctttactaactaccattctaccattctacttcctttttttttcttttctttcctttttttttttttttttttttttttgagagagagagtctcgttctgtcgcccaggctggagtgcagtggtgtaatctcagctcactgcgacctctgcctcccgggttcaagtgattctcctgcctcagcctcccgagtagctgggactacaggtgcctgccaccatgcccagctaatctttgtatttttagtacagacagggtttcactttgttggccaggctggtcttgaactcccgaccttgtgatctgcccacctcggcttcccaaagtgctaggattacaggcgtgagccaccacgcctggcctaccattctactttctgtgtctataaatctgactgctcgccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccaggcgcggtggtgggcgcctgtagtcccagctactcaggaggctgaggcaggagaatggcgtgaacccaggaagcggagcttgcagtgagccgagattgcgccactgcagtccgcagtccggcctgggtgacagagcgagactccgtctcaaaaaaaaaaaaaaaaaaaaatctgactgctcaaagtacttcatacaaatggaatcatacagtatgcatctttctgtgcctggcttattttacatagcctaatatccttaagtttcagccgtggtgtagcatgtgacaggatttccttccttttcaaggccgactaatattccgctgcatcttgctgggcacagtggctcatgcctgaaatccaagcacttcgggagcttgaggtgggtgaatcacttgaggtcaggagtttgagaccagcctggccaacatggtgaaaccccatctctactaaaaatacaaaattagccaggtgtggtggcgcatgtctgtaatcccagctatttaggaaggtgaggcaggagaatggtttaaacccaggagatggaggctgcagtgagctgagatggcgccattgcactccaggctggaaaacaagggcaaaactacatctctaaaaaaaaataataaaaaaattccactgtatctatatgccacattttgtttatccatacattcatcagtggacacttgggttacttccaccttttggttagtataaataatattgctatgaacacaagtagattgtttacctgcttttgagcttttcatataaatgaaatgaattctaccatgtgtattattttatgtttggtttctttccttcaacattgtgaaattcatccgtcttatcgcatgtagcaatagtttacttttctcattgatatatagtagttcattgtataatcacatcccagtctgtttattccgtctaccagtgatggacatttaggttgtttccaggttgtatctgttatgaatagtgctgctataaacattcttgttggtgtcttttattatacgcatgtatgcatttctggatgtaaacacctaggagttaaattgctgggtcatagattatgtttgtttagttttactagacactgccaaatagttttccaagatgactataccaatttacctcctccggaacactgaatgagcattccagttgtttggtatcctcaataacacttgatgtcatcggttattttaattttagtcattctcattgatgtaaagtggtatctcattgtggttttaatttgtatttccctaatgactaatgaggttgaaagactttttatgtttatcagtcaattggatgtgaagcgcttgttcatgttttctgtgaagtgcttgttcatgtttcttgcccttaatttagttgtctgtttttttccttattgatttgtagtattgtggtgtatgtatgtatttttccaagggtgattctccagatggcatgggcttgctccagaaccccagtgaccctgctaggacttgccacaaattacacacagtgtcttctcccatctcccacacaaatgtgtgggtgtgtatgtgtatgtattttttgttttgttttgttttgtttttaagatagaatctcatccagttgcttaggctagagtgcggtggtgcaatcatagctcacggcaaccttgacctcctgggctcaagtgattctcccacatcagcctcacgagtagctggaactacaggtgcccgccaccacacccaggtacttttaaaaaaatttttggactgggcacagtggctcatgcctgtaatagcaggactttgggaggccaaggtgtatacatcatctgaggtcaggagttcgagaccagcctggccaatatggtgaaaccccatctctactaaaaatacaaaaattagccgggcgtggtggtgggcacttgtagtcccagctacttgggaggctgaggcaggagaatcgcttgaacctgggaggcagaggttgcagtgagccgagattgcaccactgcactccagcctgggcgacagagcaagactctgtctcaaaacaaaacaaaataaaacaacaacaaaaaattgtttttggagaaatgagggtctccctatgttgcccaggctggtcttcaactcctgggctcaagtgatccttctgcctcagcctcccaaagtgctgggattataggcatgagccaccagcctgcatgtattcttgacaagggctcgaagtttaacatgaggattgcaaatatagtctccctctctatggtttgccttttttccctcttaatggtgtcttttgattagttcttcattttaatcaattcaaattaccaatctttttctttatgactagtgctttttgtgttctgctcactaattatttttaaaatacacataagaataaacatatactcatcgacataaaaatattcttctgtgaaccatctacgatcatattgtgtaacactactgacctcttggatgaagcccaactgcctactgtgaaacacctgatcaagcccctgccaagccctccagccccgtcccactgctccctgccctgcacttcatccttccactaaccaagcagctgtcacacagcatggcattgctaaccaccctgcctttgcaccggcagtgtggaaataacagtgtgtcggacactgtggcccacgcttcttctcccctttcccaccagagccctgactttgcataggtgtccactctcccccacatagccctgtgcttcagggcaagatgcccccacctcagccacaggaagggcatcctgatggcctaatccaattgtggttccacattcctcctgccatggacataggactcaattctagctaatgagatgcaagaggctcctgggaaagtcatccttgttcctgccaaagagaacaggaagagttagatcattactcatgttggatgttgttaggctggatgataaatcccatacactgaggacagcactgagacttgtctgatagaagctgggcctttggtgacatggagtgccagtgatcatactctgcctaaagaacaaccttctggctgggcatggtggctcacattgtaatcctagcactgtgggaggccagggcaggaggatcacttgagcccaggaggtggagactgcagtgagccatgttcgtgccaccacactacagcctgggcaacagagcaagaccctgtcccgaaataataaaataataatttttaaaaacacaaaaattagtcgggtatggtggtgcatatttcccaactacttgggaggctgaggcagtagaatcacttgaacccaggagatggaggttgcagtgagcagagatcggaccactgcacttcagcctgggtgacagagcaacactccatttcaaaaataataataatactttaaaggccaggagcagtggctcatgcctgtaatcccagcactttgggaggctgaggtgggcggatcacttaaggtcaggagtttgagaccagcctagccaacatggtgaaaccttgtctccactaaaactacaaaaattagctgggagtggtggtgcgtgcttgtaatcccagctactaaggaggctgaggcatgtgaatcgcttgaacccaggaggcggaggttgcagtgagccgagatcgtaccactgtactccagcctgggcaaatgagcgagactccatctcaaaaaaagataaatataaataaataaataaataaataaataaaagtgtaatctgaagctcagcatggcatggtggttcacacctgtgatctcagcactttgggaggccaaggcaggtggctgtctgaaataataataataatttttaaaaaccaaccttctgctggtctatatttccttatgattgaagtcagtttgaatcatggtttctgtcccttttaactgaaagcacctcactagtaggaccttaactgaccttggatgaattactgaatgtggatgtatttggtgtgttatgatgtttaggaccagcttcacgggtgtgcaacctgtgctgtcacaccaggcccacacttagtagggccccacgcttggtttaatgttctgctttcatggttttgaaattcttttatatatatatatattttttttttttgtattatactttaagttctagggtacatgtgcacaatgtgcaggtttgttacatatgtatatatgtgccatgttggtgtgctgcacccattagtcatttacattaggtatatctctgaaattctgaaattcttaataacttacgaacaaggagccctgcattttcttttttctttttttttttaattttttttttttgagatggagttttgctctgtcgcccaggctagagtgcaatggcacgatcttggctcaccgcaacctctgcctcctgagttcaagtgattctcctgcctcagactcccgagtagctgggattacaggcatgcgccaccacacccagctaatttggtattttttagtagagatggggtttctccatgttggtcaggctggtctggaactcccgacctcaggtgatccgcccgcctcagcttcccaaagtgctgggattataggcgtgggccaccgcgtctggcctgggccctgcattttcattttgcactgggccctcctaattatgtaattggtcctggtgatgtgacatttcttatctccttgtgtttctttttctgccctttcaatctttgaatctgcacagcttcatccacaagactctaattcacatgcttcatctgccaaatccaccagcttaactgcaaaatgaggaggttgaaccattatctgatctctatggataccttttagaactgttaagaattcaccactgggcatggcggctcacacctgtaatcccagcattttgggaggctgaggcgggcagattgcttgagctcaggagttcgagaccagcctggacaacatagcgagaccccatctctacgaaaagtacaaaacttagccaggtgtggtggtgtgtgcctatagttccagctacttgggaggctgaagtgggaggatggcttgagaggttgcaaggagccgagatcgagccactgcattccagcctgggtgacagaccaagagcctgtctaaaaaaaaaaccaaaaaacaaacaaacaaaaaaacttaaactttcttgcagatgagcagtctgtgttaaaaaagaaaaaaaaaaaagaaggaaaaaggattcaactttctccccagccattttggtaagcaatgacttttcagtattccagaaggcaaaattcaagtgccctggcctggcattcaatatcttgttccatatattgttcttgttactttctgacaccagcacccattactccccagtaagaattacccactttaactaaaaagaatgatgatgataataataataatagtaacaataatagtgaaaacaatgcattcaaataatggtttatagaccgtattcatacatatttacgtttgttcctcacaataattctgtgagatatcatgtgaaaaataattactctggaccttaattctattacaaatagaatttactaacaagcactatatctcatgcaaaagttcagaaatttaataagtgtagttaattactagtcatttatgacaactttttttttttttttttttctggagacaagaatcttgctctgttgcccaggctggaatatagtggcaagagtgatcctcctgggctcaagtggtcttcctgcctcagcctctcaagtagctgggactacagacatgtgccaccatgggtggctattttttaaatttttgtagagacagagtcttactatgttgcccaggctggtctcaaactcccgggctcaagccatcctcccaccttggcctcccaaagtactgggattacaagtgagccactgcacctagacttattacaactttttatttgaaataatttcagacttacaaaatgatttcaggaaaggtcaaagacatcccatgtactttttttttttttttttttttttgagacagagtcttactctgtaacccaggctggagtgcagtggtgcgatctcgcctcattgcatcctctgtctcccaggttcaagcaattctcctgcctgagccccctgagtagctgggattacaggtacctgccaccatgcccagataatttttgtgtgtttttgttgttgttgttttgttttgttttgtttgagacagagtctcactctgttgcccaggctagagtgcagtggtgcaatctcagctcactgcaatctccacctcccgacttcaagcaattcttctccctcagcctcctgagtagctgggattacaggcgtgtgccaccacaccctgctaatttttgtatttttagtagagacagcgtttcaccatactggccaggctggtctcgaactcctgacctcgtgatccgcccgcctcggcctcccaaagtgttgggattacaggtgtgagccacagggcccggcctgtattttttgtttttttgttttttgttttttgtagagacgggctttcaccacgttggccaggctggtatcgaactcctggcctaaagcgatccgcccgccttggcctcccaaactgctgggattacaggcgtgagccacagcacccggccccatataccctttattcagattctcaaaatgttaatattttaccacatttgctttatcattttctttttttctttttttttcccaagacggagtcttgctttgtcgcccaggctggcgtgcagtggtgcagtcatggctcactgcaacctcagtctcccaggttcaagcaattctcctgcctcagcctcccaagtagctgggattacaggtgtgtgccaccacacctgactaatttttgtatttttagtagagacagggtttcatcatgttggccaggctggtcttgaacttctgaccttgtgatctgcatgcctcggcctcccaaagtgctgggattacaggcatgagccaccgcgcccggccccatatgacgtttattaagattctcaaaatgttaacattttaccacatttgctttatcatttctctctctctctctctctctctctctatatatatatatacatatatatatatacacacacacacacacaggtaatatatatgcatacagacatatatacacacacaaatatatgtatgatatatgaaattatttttccagaaccattggagaataaattgcaaacaggatgaaattgtatctctaaatacttaagtatgtgtttcctaaaacaagaatattgtattctcttgtataacagtagcacaattataaaataaaaataataacattgatataataatattacctaacccagagaccttattcagatatcctccactgtcttaataatgttttccacagcaaaaagaaaaattatttttctaaggtcaggcatggtgactcatgcctgtaatctcagcactttgggaagccgaggtggacagatcatctgaggtcaagagttcgagaccagcctggccaacatggtgaaaccctggctctactaaaaatacaaaacttagccaggcgtggtggtgcgcacctgtagtcccagctactcaggaggctgaggcaggagaatcacttgaacccaggaggcggaggttgcagtgagccgagatagcatcactacactccagcctgggcgacagagcgagactctgtctcaaaaacaagaaagaaaaattatttttctggctcaggatccaatccaggatcacacactgcacttagttgagaaatctctttagtttcttttaatctggaataattcctcagtctgactttgcctcccacgatcctttgtcacttgaagaatacaggccagatattttgtatgaggttcttgttttaggtttatctgttttttcccctcatgattagattcaggctatacatttttggcaggaatattctaaaactgatgctgtgttcttggtttattaaatcaggaggcacattactgactactggtgatgttaatttttatttttaggtcaaggtggtgtctgccagttttccactttaaagttattctttgtcgatttttagttaataagtatcttttttttttctttttttagagacagggtctcactctgttgcccaggctgaagtgcagtggcgcaatcataactcactgcagcctcaaatttccgggctccagtgatcctcccacctcatcctcctgagtaacaaggactacaggcacgccaccaggcctggctaatattttatttttgtagagacaggtcttgctatgttaccctggctgatctccaactcctggcctcaagtaatcctcccaacttggcctcagcctcccaaaactctgggattataggcatgaaccaccatgcctggccaataagtatcttgtggggagatattttgagactatatcctgttcctcataaaacttttacccactaatcttagcatccattgcaaaaattacaaagtctttcattgaaaaagtatacacaagccaatggttaaaaaattcaaaacaatacagtgaacaagtatgtatacatactcactttttgttgtataaaaaaagagaaatagagtgaatagtatagtgaaaagtaaatctcctgatattagatcctcaggacccttcctcctgttacttgtttgtgtctttgtggtagacacgatgccatatgatactgaacctcatttcatttccttttttctgggcataaaggatgacaacatttcctgtcctgctttgcggtgaggctgagaccatgagactagttctggctcaagggctatgaacagaaatgatattgggcactcttgggccaaagcatttagtgccattttatgtctctccagctctctcttcccctgctgcagcaattgtgaaagccacgcatttagatggtgaagccacaaaatggaaacagcctggatccctgagtcaccagatgcagaaacagctgccctgaaaagttgtccatcttgcactatacatgcccatgtacgagaaatacaagccttttctggccgggcgcggtggctcacgcctgtaatcccagcactttgggaagccgaggcgggcagatcatttgaggtcaggagttcgagatcagcctggccaacatggtgaaaccccgtctctacaaaaaatataaaaattagccaggcatggtggcaggcgcttgtaatcccagctactcaggtggctgaggtaggagaatcgcttgaacctgggaggcagtggttgcagtgagccgagattacaccattgcactccagcctgggtgataagagcaaaactctgtctcaaaaaaaaaaaaaaggccttttctgtggttaagaaatgagaatcaagtttaagatatttgagatttttctttttattatttttttccttagaggtaattgtggggtggaggtgggggtcttgctatcttgcccaggctggactcaaactcctgggttcaagcaatcctccagtctcagcctcccaagtagctgggactataggtacacactaccacaccagtttctttgagatttttgtacatcgggatatatagctcattctttttaagatttgccaagtgttccattgtatgactataatatatttaggaggtacatttctttaatttaaatttttgaattgatattatataccatatggttttaaattaaaatggttcaaaaaagtatatatgtgaaaaattctcactctcattgctgccctgagccaataaattccccaccaaaggtaaccaatatttcctgttccttatgtgtacttccagagttatgtcatacataggatatttaaaggaacctcactcgtctcaagtttggccgagacaccaaaacaataaggtcacacttcaaagttacgggcaagtccaccaatacaggatttgcaaaagaagattatagaaaaccaattttcatgccgggcgcgctggctgacgcctgtaatcccagcactttgggaggccgaggcaggtggatcacgaggtcaggagatcgagaccatcctggccaacatggtaaaactccatctctactaaaaatacaaaaatgagctggatgtggtggtacgtgcttgtaattccaggtacttgggaggctgaggtaggagaatcacttgaacccaggaggcagagattgcagtgagccaagatagtgtcactgcactccaacctggcgacagagcaagactccatctcaaaaaaaaaaaaaaaaaagaaaagaaaaccagttttcaatcttcattcactacccatccgcagcctgcaaaagatgttgaagagattgaaaaaaaaaaagactcaaggttttagaaaaagctattgctgaactgagtcactgagtcattgcctccaacctcatcctaaggggtacatgcccctcacctcacactaataaaacgaattttactgggatcacatagtagaatatgtgtttcttcgtctttgagaggcacagtgggctgaagtctgagttgtctgggatgtgtaaagggttaagggttaatgcaggcatcctgtggggtagagaagaggttgcgatttgggatatagcagcacttgcaacaatgggtcaaatgaacatattttctctaatctaagtatgatacaaacatgcaagagctctggagaagcattgccttggatcctgttcaagaaagctgcctggaaagtaagtggacttcagcagaaggaaggtggaggcgtagcaccagatgcctagagtctcgagaaagaattgtaaataaacaactgtaaaagccatgtattcatctatgcaggagaaactgcaggccaagtgtggtagctcatgcctgtaatcccagcactttgggagaccaaggcgggcagatcacctgaggtcaggagttcaagaccagcctggccaagatggtgaaaccccgtctctactaaaaatacaaaaattagctgggcgtggtggtgggcatctgtaattccaggtactcaggaggctaaggcaggagaatcacttgaacccaggaggcagaggttgcagtgagccaagatcgcaccactgcactccagcttgggtgacagagggagacctcatctcagaaaaaaagaaagctgccgggaaagtaagtggacttcagcagaaggaaggtggaggcgtagcaccagatgcctagagtctcgataaagaattgtaaataaacaactggaaaagccatgtattcatttatgcagaagaaactgcaggcggggcacggtggctcatccctgcagtccccacactttgggaggccaaggcaggtggatcacttggggtcaggagtttgagatcagcctggccaacatagtgaaaccccaacttaaaaaaaaaaagaaactgcagagatgagatccccaatgatgggaggaggaagctttaaggaactcagaaatacagcccacatacaaaaagagtaagccttaaacacctgccagagtacagatgccattcatgacagtactagtcaagtgtgaactttaccgtctcctttattactttctccatatgttccaaccttaacaggccttatggctgtgtgattcattcactgctaaagggtgcctaaatgaaggcgcatatggtggctgcaacccagtctgggttccattctccaaactgtatgccctggcatggggttttatctatttggaataagagcagtgttttcctaattcacacagaggtacagttctctcaccatggggctgcatacacccagaaggggaacatattcctaatctacagaggcaccagatggactagcagccacccagtttggagggtctcagagacagtgactagcaagaggaggagaggaggggaagcactgaatgaggaaggagctgagctggccacacactccttttccatagtaggtaacccacctcgtagaggcccaatctgggaaagagggtggagcctctgtataaatgaattttacagtaatggatgttagagggggctggaagttttttttttatcacttaactgatattatttgggaaactagcatgacaggagaacttttttttctttttctttttttttttttgagacagagtctcactctgttgccaggatggagtgcagtagtgtgatctgggcttactgcaacctccgccttctgggttcaagcaattctcctgcctcagcctcccaagtagctgggactataggtgtgtgccaccacggccagctaatttttgtgtttttagtagagacagggtttcaccatgttgaccaggatggtcttgatctcttgacctcatgatccacctgccttggcctcccaaagtgctgggattacaggcgtaagccacctcacccggccaggactttttttttttttttgagatggagtctctctctgtcacccaggctggagtgcagtggcgtgatcttggctcactgcaacgtccacctcctgggctcaagcgattctcctgcctcagccttataagtaactgggattacagcatgtgccaccatgcccagctaatttttgtatttttagtagagatggggttttgccttgttggcctggccggtctcgaactcctaacctcaggtgatccacctgcctcagcctcccaaagtgctgggattacagacatgagccactgcgcccaacctaggaagacttttaatacttatgagtaaccagaaaagttgagggatttgaccatggtttcacctaagggggcacgggaaaactagccccaaagaatacattaaaaggccagtgaaagatgaaagttaagatttttctgattcatacgcggtagcggagactccctactaataggcattctatcctttaggcacaaagctaggctctgtttcccagcatacattgcaggttggtataatcttttgttttgttttgttttgttttgagacagagtctcgttctgttgcccaggctggagtgcagttgctagatcttggctcactgcaacctccacttcccaggttcaagagattctcctgcctcagcctcccgagtagctgggattacaggcgtgcaccaccacacccgcataatttttgtatttttagtagagatggggtttcaccatgttggcccgactggtctcgaattcctgaccttaagtgatcacccgccttagcctcccaaagtgttgggattacaggcttgagccaccacgcccagttgggtataatctttttattaaattttttccagtgaaatgcaaaacaggtttgggttaatacgatgggtatgacttgcagaactggcctataactgcacccccacccataacactcttctattttttcccaccttttgccaacttaaagtagatgatgacaagggctcaagtgatgacagatagaaacctgggtctgtggatgatggcaaagaggagagctgccccaccaagccaaacaactgtccaagactactatgtgaacgggaaataaacctctattttgttaaggcattatattttagttttgctcatgttaaaagaatcacaaatccttcagatctagaaaacaaaagtagaattcatttcttgctgggcaagggagaactgcaaagatacatgtaatccctgtgaacaaagtaaaaaataggtttatatgggattttaggaaaatataagtgattggttttggctcaaagtgagtagggttagtcactgattagataggtttcaagaacaggtgacctattgatgtaaggtttgatgactgcaggtgattcagcccaagactgatattgattcatcttatagtttcctgtgtaaatgcctgcagacatcagctaggttcttcaggcaagaatggaattttctattgtcatctcccattttgcccctgcttgacaggtcatggaagaggccattaaatattgtctagaacagtggtgggcaactgtttttctgtaaagggacaaaacgtaaatattttaggttctgtgagccctactgactctatcgtaacaacttaactctgctgctgtcacacaaaaatagcacaaatgattcgtaaatgaataggtgtggctgtgtttcaataaaacgttacttaaaaaaacaagtggtgggccagacttaactcattggccatagtttgctagcccctggtctagaactctagatgtagtccactgacatggttttccttcgggggtgaaatggtggctgtggtgatcatcatgatttcattttgtttttgattcaagatcatctgttgcaccatctgatgagacagccaacacacagtagagtttaaaattctggacaccagctagacagtatataaatacaacattaaaatatatgccaggcacagtggctcacgcctgtaattccagcactttgggagaacgaggtgggcagatcacttgaggtcaggagttcgagaccagcctggccaacatggtgaaaccccgtctctactgaaaatacaaaaattagctaggcgtgttggggggcgtctgtaatcccagctactagggaggctgaggcaggagaatctcttgaacccaggaggcagaggttgcagtgagcagagatcgcatcactgcactccagcctgggcaacagagcgagactctgtctttttttttgagacagagtttcgctcttgttgcccaggctggagtgcagtgtcgcaatcttggctccctgcaacctccgcctcccaggttcaagtgattgtcctgcctcactcaggctcccgagtagctgggattacaggcatctaccaccatgcctggctaattttttgtatttccagtagagatggggtttcaccatgttggccaggttggtctcaaactcctggcctgaggtgatccacccgccttggcctcccaaagtgctaggattacaggtgtgcccggccggagactctgtctttaaaaatacacacacacacacacacacacacacacacacacacacacacacaggactagatttttttttttttttagagtcagtctcactccatcacccaggctggagtgcagtggtgcgatctcagctcactgcaccctccacctcctgggttcaagcaattcacatgccttagcctccctagtagctggaattacaggtgcgccaccacaccccgctaattgttgtatttttagtagagacgaagtttcgtcatgttggccatggtggtctcaaactcctgacctcaggtgatccgcctgccttggtctcccgaagtgctgggattacaggtgtgagccaccatacccagcctacaactagtagaataaggaaggactggaaagtgcaccaaaatcatgatccaagttttcacagattaaaccctctttttgacctgaagtatggggataagacaaagaaatgttttttgtttgagatagagtctcattctgtcacccaggctgaagtgcagtggcatgatctcagctcaccgcagcctcgaactcccaggctcaggtgattctcccacctcagcctcctgagtgagtagctgtaactacaggtgtgcaccaccaagcccagctaatttttgtacttttggtagagatggggttccgccatgttggccaggctggtctcgaactcctgggttcaagggatccacctgcctcggcctctcaaagtgctgggattacaagtatgagccaccgtgcctggcccagacaaaggaatattgaccaggttgttatcatttgaaattttttgaagtttctctaatctctttgctaatgttgaaaatctctgagacatcttgggaaatacaagtgcaatattttcctttagcacagcacaagttccttttggtgagataaggagaatatgtcatgggcgctctattttggctgactgccttcttgcaataagtctaaagcttagaaggtctttgttaagctttcagtcatttgtacagtcataaacttgaagaattctctcaaatatatgtgccccctgtaaagcatggtgtgaagctgtctggggacaaaaaaaatttcaaaattctcttatgccaaggtttaattgcttgtaacagaaatgaagggaccggatgcagtgactcatgcctgtaattccagcactttgggaggccaaggcgggtgaatcacctgaggtcaggagttcgagaccatcctggccaatatggtgaaaccccactctactaaaaatacaaaaattagccaggtgtggtggcacacacctgtaatcccagctacttgggaggctgaggcaggagaatcgcttgaacctggaaggcggaggctgcagtgagctcagatcatgccattgcactccagccttggcaacaagagtgaaactccatctcaaaaaaaaaaaaaaagaaagtaatgaaagggtttccctttaggcccggtacaatggctcacaccagtaatcccagcactttgggagactgaggtgggaggattgcttgagcccaggagtttgagaccagcctgggcaacatagcaagacctcatctctacaaaaaacgtttaaaagttagcctggcacggtggcctacgcctgtagtaccagctactcaggaggctgaggcaggaggatcacttgagcccagaaggtcaaggctgcagtgagccatgtttgtgccactgtactccagcctgggtaacagagagacccttttttttttttctgagacagtcttgctctgccacccatgctgaagtccaggggcacgatctcagctcactgcaacctccacctccagggttcaagcaattcttctgcctcagcctcccgagtagctgggactacaggtacgcacgccaccacgcccgactaatttttgtatttttagtagagacggggtttcaccatattggccagtctggtctcaaactcctgacctcgtgatacgtccactttggcctcccaaagtgctgggatcacaggctgagccaccgtgcccagctgagaccgtttttttaaaaaaggatttctctttagataattttgaccaaaagggtctaggagtgaggtcctgaattattattattattattattattaagggtctatgagtgaggtcctgaattattattattattattattattattattattattattttgagacagggtcttgctgtgcccaggctggagtgagtggtgtgatcttggctcactgcaaccccagcctcctgggttcaagtgattctccagcctcagcttctcaagtagctgggaccacaggcaccaccatgcccagctaatttttacatttttagtagagatggagtctcgccatgttgcccaggctggtctcaaactcctggcctcaagcaatctgtctgccttggtctcccaaagtgctgaaattacaggcatgtgccaccgtgctcggccatgaatgattcttaatacaggaatcagttgccataaatagaaacatatcaccaattttcagggagtaaccaggagttctttattccacaaagcaagtaccactcattaggagtcacctaggaactgggttcaggccaggaaaatccagaactctcattatggatcctggcaaagataatgaatctgagtctacttcactttaaaactaacttaaaatatctgaaaataatgctttggtatgcctttgtggtaagagttgtacaggttatgcattttttaagataaaccataccagtgattcttcccctgggctgtcagtgctacaaaaatttgaacacacgaactggtccccaccttaggccctttagtttgatttctgtgtaagcaaaaatgtcctactttaggcatgacaatattggtattggtggcttagaaatataaggtttgtgatggtgattatcagtaattatgttaagagttcataataacttcattcattatgaagtcattgatatcacttgaggggattactacccaaaagaattatacaacctaaagggaagtgagtgcaacccagcaactgaatctggctagactgtgggctaactgtggataagtaattgttgtataggaggagtttactaaaggcaagagtatcaacaacagaaacaggaataataaaaagcccgtatacagtagacacagtggctcacacctgtaattccaatactttgggaagctgaggtgggaggatctattgggcccagtagttcaagaccagtctagacaagatggtgagaccacctgtcccacccacagtctctacaaaaagtttttaaaaaattagccagctgtggtggtgtgtgtctgtggtcccacctacttgggaggctgatgcaggagaatccctggagcccaggagttcaaggcgacagtgagctatgattgcaccactgcaccattgcaccactgcacagagctagactctatctcttgggggaaaaaaaaaaaaaaaatatatatatatatatatatatgatcttgtagtatgctaccttcccttctgggtaagaaataaaagggggaaataagaaaatacacatgtatatattcatttgtgcaaaaagaaacacatgacaaactgggttcagtggctcacagctgtaatccaagcactttgggaggccaagacagggggatcacttgagcccaggagttgtagaccagcctgggcaacagagtaagaccccatctctacacaaaacttaaaaattagccaggtgtggtggcgcacacctatagtctcagctactcgggagactgaggtaggaggttgagcctgcagtgggccatgatcacaccattgcactccagcctgaagaacagaggaagaccctgtctccaagaaaaaaaagaatgggctgggcgcggtggctcatgcctgtaatcccagcactttgggaggctgaggcaggcggatcacctgaggtcaagagttcgagaccagcctggccaacatggcgaaaccccgtctgtactaaaaatacaaaaattagccaggctttgtggtgcacacctgtactcccagctactcaggaggctgaggcaggagaatcactggaacccaggaggcagaagctgtagtgagctgaaattgcaccactgcactccagcctgggcgacaagaatgaaattctgtttttaaaaaaagaaaaaaaaaaaagaatgaggctgggcgcagtggctcacacctgtaatcccagcactttgggaggctgaggtggcggatcacttgaggtcaggagttcaagaccagcctgaccaacatggagaaaccccatctctactaaaaatacaaaattagccgggcatggtggcacatgcctctaatcccagctacttgggagcctgaggcaggaaaattgcttgaagctgggaggcagaggttgtggtgagccgagatcgcaccattgcactccagcccgggcaacaagaccgaaactccgtctcaaaaaaaaaaagaagaaaaagaaaaaagaatgatagtgacatgtcaaagtaacacagaaggcagcttgaaaaggtagccagatctgcctgtaagagattagaatcaagtatgggtggagggactcctagttatatgggcctgcctgccagtggccgaatcagagggagacagtctatgggttcctgaatgggcagaacacagagtcatagagcaaaggacagtatttaaggccatgggaactcaagtgtgtctgataatttagttaatttaagcttagtactccttttgtggttttgacttttctagatgattgagagtggtaaggagcacgaggctttgacatgacaggcaatgctttacatagctcaagaatgattgccccagtaaaataagtttatctatcattacacaattaaattagaatagctcctgtagggaatacaaagtccattagtttcttagccactttgagtgtctcaaaaaaaaaaaaaaaagagttttaatcacctcatggttctgcaggctgtacaggaagcatggcagcatctgctccgcttctggggaggcctcagaaaacttacaatcatgacagaaggcaaagcgagatcaggaggcttacatgacagaagcagtaccgagtgtggtggggaagtgccatgtacttttaaacaaccagatctcatgagaactcactatcatgatgacagcaccaagggtgatgatgttaaaccatgagaaaccacccccatgatccaatcaccttccgtaaggccccacctccaacattaaggattacaattgaacatgagatttgggtggggacacagacccaaaccatatcacccccactgcggtaaactgttctatggagagcttttgtaagtgttcgtttgaacttttctggtgctacatggaggctgtcctcatggatcttataacccaatagtgtgcatagatgatggaattcttgaacctctccatgggctcatcatcattctgttgctaaaagaactcacttttaaagacttcagacagagcaacttataagtataaagatctgctaaagcatttcttctcatttttttaaagtgtgggcctctgcttaatgacagcaatttccaagacatcatgaaactcatttatttgttgtctatttttaacagggataccaattgagaaggaaaattttctgtttctttccatggtattctgaagccatggcccatgagtcagaatgttcatgtgtgttagtcattccttgctgtgtttaacaagatatagtaagagataagctcaggtaagaacatactgacttgcaggtgaaaggaaaaggaatagaaggagtccagcaatggagccttgtagggttggagaagctgctgaaccccaacaacaggaaaaaagactgaaaaggctttgagaaacacaggtccactaaggtatttcaattaaacagaggaattcagcactactgcaaagaacagtttaaaggtgttttctcttacctaaacctattgtttcctatggcctcactgtaactgccattaagttgagagagagaggcatggagtgaagaaagaaagagataagcaaaagttgatatttatgtcttgaaaaaaatccagcctggccaacatggcaaaaccccgcctctactaaaaatacaaaaattagccaggttggccgggcgcggtggctcacgcctgtaatcccagcaccttgggaggctgaggcaggcagatcacgaggtcaggagatcgagaccatcctggctaacatggtgaaaccccgtctctactaaaaatacaaaaaattagccaggcacggtggcaggtgcctgtagtcccagctactcgagaggctgaggcaggagaatggcgagaacccgggaggcggagcttgcagtgagctgagatcgcaccactgcactccagcctgggtgacagaacgagactgtctcaaaaaaaaaaaaaaaattagccaggcatggtggcaggcacctgtaatcccggctgaggcaggagaatcacctgaacccgggaggtggagattgcagtgagctgacatggtgccactgcactccagcctgggcgatggcatgagaccctctctttaaaaaaaaaaaaaaaaaaaaaaaaatatatatatatatacatatatatatatatatatatatatatatgtatatatatatatgtatatatatatgtatatatatacatatatatatatatgatggcataagaccctctctttaaaaaaaaaaaaaaaatatatatatatatatattttttttttggcacaagatactgttgtggcacaagatactgtttgctttgaggcaaatcgatccaaaaagtttctgagtgaactgtattgccaaaaaattccccagcctggtccgaataaataagtaaaaccataaagtaacacttggaaatccaaagttgcaccatcaggaaggaggctttcaaggctgtgtagttcccaaggaggacaggcaccccacttcacacaaagccaggaagaacaatggctgaggaagaacttgccagagggcagaacaagggtggaaggagaacaatgccaggataatttttcctaaagagcaaaatctggtctaatctaggaaattcatccactgccaggaaaggatgtcttcataatgcatatctagcagaactccataattgctttggacaggaaggttgggtttttcccattctcccttttccaaataggatttgctattgcccttttcctgtctctgcttcatcattgtagatgggcaggtgggtttattggggtggggagaaagtggcaaccacttggcttttagttcatagattgctagaccatgaggaaattcactcaggccaattacagaagaccacaatccagattctgatatgaatcctataaatgaatggaagtttttgtcatagctcttgggagaagggtgaatatgagatttgctggtcagagaggctgactgtagcagcgaccccttgctatctaccaaaagtcattattctctttaggcacacaacaagactgtttcccatactcccattcaatttgagtgtggtcatgtgacggttttctccaatgtaatgtgagtggaaccaatgtgtgtcactacctgatccaggggataatagatggacagcttctgggccccttaatgaaaaaagtggaggagagtggccccattgacctgaatatccgcccgggactgttaggtgagcaagaaattaagtattttactgagtcatattttggatctatttgtcacagtagtttaacctattattaactgatacacaccccatgagtcatgcttgttcaacatgactatatatgcatatccttttaaacaataattattaatggtaacatactaaacaccctgtagtgaaccttgtttttttgttttctgtttttttttttttttttcattaaatttcctgctaagtgttctgtatcagtacattaataactcctttgccgggcgcaggggctcacacctgtattcccagcactttgggaggccaaggcaggcggatcatgagctcaagagatcaagaccatcctggctaacacggtgaaaccccatctctactaaaagtacaaaaaaaaaaaagccgggcgtggtggtgggcacctgtagtcccagctactcgggagcctgaggcaggagaatgacgtgaacctgggaggcggagcttgcagtgagccaagactgcgccaccgcactccagcctgggtgacagtgcaaggctccgtcaaaaataaataaataaataaaataacttctttgtttttattttctttatttttgctttttttgcggggggcgttggcaggggagacaggatcttacactgttgcccaggctggaatgcaatggtgccatcatagctcactgcagcctaaactcctgggctcaagtgatcctcccacctcagcctccccagtagctatgactacaggtgtggaccaccatgcccagctaatcttttagtttttgtagagacagggtcttgctttgttgcccaagctggtcttgcattcttggcttcaagcgatcctcccacctgggcctaccaaagtgctgggattataggagtgagctactatgtttgctttttgaatagcttaagtaccacatgttattttgcccgttccctactgatggacatttagtttgttaacagtcctttgctattgtccttggttcaagttctttctttccttccctccctccctctttctctctctctctctctctcgttctttctttttaatggagtctcgctttgtcgcccaggctggagtacagtggcaccatctaggctcactgaaacctctgcctcccaggttcaagcgattctcctgcctcagcctcccaagtaactgggaccacaggcacccgccaccatgcccagctaatttttgtatttttagtagagatggggtttcacctattggccaggctggtctcaaactcctgaccttgtgatcctcccacctcagcctcccaaagtgctgggattacagatgtgagccactgcacctggccgattcaagttctttcaattggcactctgcaaatgcaaaagacaggtcagctacatgtccagcattatctagttctattctttaatttaggacttcccttagattcttttagccaagttgcaaagataatatgctctattgattctctgtggtctactattgtaaaatacatattgaaaaataaactcaagtgattacaagtccaatacttacacaggtaggaggactataacatggtgacctaacagcatgattacaatgagacagccctgggttcaaatcccagctctactacctataacatgtaacttaaccttacacaatttactgaactgtaagcatccattttctcacctgttaagtggtgactattgtgaagattaaatgataatgaagtgctcagtacatgatattcagttaacaagtactgtagaatttttcttactacgtaactttaaaaaattaccaaagaaagccaaaattaaggccaggcacggtggctcacgactgtaatcccagcacttggggaggccgaggcaggtggatcatctgaggtcaggagttcgagaccagcccggccaatatagcgaaaccctgtctctactaaaaatacaaaaattggctgggcgtggtggctcactcctgtaatcccagcactttgggaggctgaggagggcagatcacgaggtcaggagttcgagaccagcctgactaacatggtgaaaccccgtctctactgaaaaaaaaaaaaaattagccatgcgtggtggcgggcgcttgtaatcccagctactcaggaggctgaggcaggagaatcgcttgaactcgggaggcagaggttgcagtgggccaagattgcatcattgcactccagcctgggcgacagggtgagactccgtctcaaaaaataaataaacaaataaaataaaaatagaaaaattagccgggcatggtggtgcatgcctgaaatcccagctactaggggggctgaggcaggaaaattgcttgaacctgggaggtggaggttgcagtgagctgagatcgtgccactgcactccagcctgggcaacagagcgaggctccgtctcaaaaaaaaaaaaaaagaaaaagccaaaattaaactttagtctgaagatgggacatgtatcataactgtctttattgttaagataggaaataggggccaggtgcggtggcccatgtctgtaatctcagcactctgggaggccaaggtgggcagatcacctgagatcaggagttcaagaccagcctagtcaacatagcgaaaccctgtctctaccaaaaatacaaaaattagccatgcatggtggtgggcgccttggttttcaaaaggttaaatcattgttcagttttttcaaaatgattttattttacatacttctctgcaacttgccagtctctctctctctctttttcttttttcttttttttttttttttttgagacatggtctcactatgttactcaggctggagtgcagtggcatggtcatggctcactgcagcctcgacctcctgggctcaagcaactcttttacctcagccttctgagtagctgagactacagccaccatgtccagctaattaaaaactttttttttatagagatgggggtcacgctatgttgcctaggctaatctccaattcccgggctcaggtgatcctttcgcctcagcctctgaaagtgttggtattacaggcgtgaaccacctctcccagcctgccaatttcttttcttttccttttttttttttttttttttttttttgagacagaatctggctctgtcgcccaggctggagtgcaatggtgtgatctcagctcactgcaaattcctggcttcaagcaattctcctgcctcagcctcccaagtagctgggattataggcgcctgccaccactcccagctaatttttgtatttttattaaagatggggtttcaccatgttggccaggctcttcttgaacctctgacctcatgattcacctgcctccgatcccaaagtgctgggattacaggtgtgagccgccacacctggctgctaatttctctttaaattgtactgctgacatcttctcagtcagtagaagtatatcgacttcattatttttaatacctttagtcattttttttggtaatcattcatttttaataaagagggattcttcaaattttttggttcttttttttttttaagggagtctcgctctgttgcccaggctggactgcagtggcgcaatctcggctcactgcaacctctgcctctggggctcaaacgattctcctgcttcagcctcccaagtagctgggactacaggcatctgccactacacccagctaatttttgtatttttagtcgagacagggtttcaccatgttggccaggctggtctcgaattcctgacctcaaatgatctgccagccgtggcctcccaaagtgctgagattacaggcgtgggccaccgcgcccggcctcaaattttgtgattattcatttaaattttgtaatcaaacattagggtgacgtgttggagctgatcccatactgtaggttcaggaaatacagtcattgcagacatcatcattaacgttaaagcaagcaacacagaggcttctctcttgggactgagaagggaaagaggtgtaggaaacatatacaaatgtaaaaactattctcctagtacttggcttctggaagtgaaactgaaggactgtactgtccatattaggaaatgactggctgctggatgaccacagtgttaagctttttgtccctttttgtggggagagagatgaaagggaattggtcaggaggacatcagatcagttagctttataatcaatctcttctcttccaacacaatctcagtagagttataagcattaggaaatcaaactttcactttaattagagagattgaaaatctggctccatttttaaaggtgagggttctaaattgtattcctaaatgatgttaactattgttccccgaaattgcatcagggttaaaaatttgtgttgaggttggtttgaattaatctaaatattcaacatgtgctcttgccataaagcagaaagcaaaggcctgaagtagacaagctttttaacctttctggcatttcatagatttcaccttaataaaattctgaaaactcccattatagtataattagcttcctttattttatttatgtatttttttgagacacctgtgtaggtatctgtggacacatttatgagaatcggttggccctgcaactctcccagtcaagctcactgccaggctaactttggcttgtgtaccttctcctcttagtttcaccaatacttgacagagtctggctcagcacagctctatgggatggagggccagatggctcccaaagagccctgaccagaggcacaggcctgtgaccaggtgtcctattctaggacagatggcttgaattgcctcctgctcccttttgctctgacagtctctgggactactgagcgctggggccactacagaaattggatgatgctttgcaaagatggcttttaattaagtatcagggagagtgagacaatccaatattttcaaagatgagtcactctgggattggcctttttgcttgccttagaggtctaacctcttccattcacaggtgagagacagaacaatgtagtcaagtcagttcatcagcatgttggcaaatcggagtcccaggcttggagaagacctttgcagtgaaggcatgtggaaagagaatgtggcaagagagcagctatcttcaggggaatgttggtctgcccactgccaggagggcttgttactctgaaaaagttttcaaagtttacctttgagcctcagtaactaggtactggcatttccccagggtttagtggttagtggaggctgacacttcacataacccaggtcaccagacaccaaataccaattgtctgacttaaaatacaaacagttctatgaaagaggacacccagtagtcagcctgatggtcgtatcccctacccacaggaaaacacactgaaagcccactcaggctgcagatacgttactgacgcatccaccaccacagctagagagataccctcaggaatgtgttgacttgatatacctccttgctgggccccctagtcacattctttctttacacaagttaataccatttactcagcagaggctttacacatgctaatagaggctcctcaggctacaccttcatctcaggacaagtggaaaccttaatcatctggtttcattttaattttccatgacagtaaaaggtacagtgactacaggacagtcctttcctgccttcctggggtagttaatcctaaaaaacctcttgtggggcaattcaagttgaaaatgtaatcagtacttaatttcaatgggaaaacattttatatgtgcacagtgtcccaaaattaacacccactcatgctaaaacatcaaatctcattaagacagacacaattacattaacaattacactggctatcataaacaaaactaaaggcattttcccttcattagttatgatctcattagttacgagattattatcccataatatggccatttacccgttgtttcttagcttttatgcactgtacatttaagactaaatttaggccaggctcagtggctcacacttgtaatcccagcactttgagatgccaaggcaggtggatcacttgaggtcaggagttcaagaccaccctggccaacatggcgaaaccctatctctactaaaaatacaaaaaaaaaattggtcaggcacggtagttcacgcctgtaatcccagcattttgggaggccaaggagggcagatcccaaggtcagaagttcgagaccagcctggccaatatgctgaaaccccatctctactaaaaatacaaaaaaaaaaaaaaaaaaaaattagctgggcgtggtggcgcccacctgtagtcccagctacttggaagactgaagcagaagaatcacttgaacccgggaggcggaggtagcagtgagccgagattgtgccactgcactccagcctggcagcctgggtgacagagcgcgactccatctcaaaaaaaaaaaaaaaaggtcaggcctatcccagtactttgggaggccaaggcaggcggatcactgaggtcaggaatttgagaccagcctggccaacgtggtgaaaccctgtctctactaaaaatgcaaaaattagctgggtgtggtggtgggcacctgtaatcccagttactcgggaggctgaggtaggggaattgcttgaacccaggagacggaggttgcagtaagccaagatcgcaccactgcactccaacttgggtgacagagcgaaattctgtctcaaaaaaaaaaaaaattagccgggtgtggtggtgcactcctgtaatcccagctactcgggaggctgaggcaggacccggaaggtggaggttgcaatgagctgagatcgacagagaaagactccgtctcaaaaaaaaaaaagatatatacggccaggcggctgggagttcgcgaccagcctgaccaacatgtagaaatcctgattctactaaaaatacaaaattagccaggcctggtggcacatgcctgtaatcccagctactcaaggggaatcgcttgaacccaggagggcagaggttgtggtgaaccaagatcctgccattgcactccagcccgggcaacaagagcgaaactccgtctaaaaaaaaaaaaagactaaacatgcaaaacatacgtaaaaaatgatgtccaatgtttatacaacttaacctttttttttttctgagacaaggtctcattctattgcccaggctggagtgcagtggcatgatcatagctcactgctcaagtgatcctgcctcagcttcccatcagagtagccaggactacaggcatgcaccaccattcctagcagtttttaaaaacttttttgaggctgggcacgctggctcatgtctataattccagcactttgagaggccgaggcaggtggatcacttgaggtcaggagttcgagaccagcctggccaacatcgtgaaaccccatctctactaaaaatacaaaaattagctgggtgtggtggcaggtgcctgtaattccagctactcaggaggcagagacagaaaaattgcttgaacccaggaagcggaggttgcagtgagcagagattgtgccactgcactccagcctgggtgacacattgagactccgtctcaaaaaaaagaaaaaaaaaaaattctttttcaggccatgtgcagtggctcacgcctgtaatcctagcactttgggaagccgaggcgggcggatcatctaaggccaggagttcgagaccagcctggccaacatggtgaaaccccatcgctaataaaaatacaaaaattagccaggcgtggtggtaggtgcctgtaatccctgttactcaggaggctgaggcaggagaatcacttgaacccaggaggcagaggttgcagtgagctgagatcaggctattgcacaccagcctgggggacaagaatgaggcttcgtctcaaaaaaaaaaaaaaaaaaaaaaacctttttgtagagacagggtcttgctatgttgcccaggctgaacttgaatgcctggcctcaagtgatcttcccatctaggcctctcaaagtgataaaattataggcaagaggcaccgagcctggccttaacctttgttttaaaaaaagagtaacaagggccgggcacagtggctcacacctgtaatcccagcactttgggaggctgagacgggcgaatcacgaggtcaggagatcgagaccatcctggctaacacagtgaaatcctgtctttactaaaaatacaaaaaaaaattagccgggcttggtggcgggtgcctgtagtcccagctactggggaggctgaggcaggagaatggcatgaacccaggaagcggagcttgcagtgagctgagatcgcaccactgcactccagcctgggtgacagagtgagactgtctcaaaaaaaaaaaagaagagtaacaagggccaggcacgatggctcacgcttgtaatcccaaacactttgggaggacaaagcaggaggatcacttgagtccaggagttcaagaccagcctgggcaacagggtgaaaccacatctctacaaaaaatacaaaaattagctgcgcgtgatggtgcacacctgtggtcccagctgctcgggaggctaaggtaggaggaccgcttgagcctgggaggcagaggctgcagtgaactgagatcatgtcagtgcactccagcctgggtgaaagagagagaccctgtctcaaaaaaaaaaaaaaaaaaaaaaaaagtaacaagtcttggcacagttgtttgtgcctgtaatcccggcactttgggaggctgatgcaggaggactgcttgagcccaagagttccggaccagcctgggtaacacagtgagacctcgaggctgacacaggaggatcgcctgagcccagaagttcaagaccagtctgggtagtacagtgagacccggctcaattaaaaaaaaaaaaaaaaaagtaataaaatgaatgaaaaccttgcaaataaaattaccttcactgaacaagtgaaataacaagagacttgatgtgtattattaagccttaaatatgttttgctataaatcagcaaaactatgagaaatctgatgagataacttaaggtaacacagaccagctctgtgaagctgatgcatgttggcttcaggcactccaagaagtacaccaaacaaatccatcctgagagctgcaaagacatgctttgtgtttcagtttttattgcagaacaaactacctcaaaacttactggtttcactcttaaacaataagcatttattctttttcatcagtctgtgggtttgctggggaagtcttctggtctgggccagcttagctgggcctggatggtctagaatgctcttgttcatatgtctggtagttgctggcaggctagctggtctaaggggccacactcatacatgtctggcagttggtcagatgtcagatggggtgatgactatgtgtctgtcatcatccattaggttagtaggagttatcctcgtggtagtggaagaggtcacagcagcaagagaaagcaaccccctgttgtaatcacttctcaagacacttcttgctttacatttgccagtgtcctacaggacaaagcaagtcacacggccaagcctagattcagtgaatggagaaacagactccacctctgcattggagaagctgaaaaacactgtggctattctgttcaacccactaccctttagaagctaaagtagagattaaatgatattccttgtaacatgaatgggcacgtatctcagggtttaatcatctaggtttcagggcattctacattttctgttacttatatcatatttctgtgatgggaggagcatgcttttctgtttcagctactgaggtcaactagtagggccactttcctaggaccttttctataccttgagacagagataaaactgaagaggtaggcaagaagctagatcttcttagggccctgtaggccacataaaggaatttaggacttgatcccaagagcaatgcgaagccatagagcattttaaggagaaagatccgatcacttgagctgtagtgaagacaataactctagaagttttgccaggaaggggaattagtgagataaggctttagtcaacagaatgtgggattgagggaaaggcttttttttccttcttcttttgaaagcaaaagatgagtgaaactagagtttgcttgaatactaatgaaaggatccaacattgcaagaggttaaagggagatccctaagaattgtgaagggaaacttgaacagctatggagtttggcttttttgtttttagacggagttttcgctcttgttgctcaggctggagtgcagtggcaccatcttggctcactgcaacctctgcctcctggcttcaagagatactcctgcctcagccttccgagtagctgggattacggccaactgccgccatgtctggctaatttttgtattttcagtagagacgagatttcaccatgttggccaggctggtctggaactcctgacctcaagtgatctgcccgcctcgacctcccaaagtgctgaggttacaggcatgagccattgcacccggcctggagtttggcttttaagaaaaaaacttcatacaataaaattgactttatttttgttatatacagtcctatggattttaacacatgtacagattgaagtaactactaccaaaatcaggattcaaaagagttccatcaccctaaaaccgtcctttttgctatctctttagtcattccctccacccccttagctcctggcaatcactgacttactctccaaactataatttcaatatttgtatgtgtgtcatttgagactgacttagtttacttggcataatcctttcattattatgtagttataatgcctacttgttgtgtatatcaatactttattctttttattgctaatattccattggtgttggcttctgctggtattccttaggtcagcaaatgataccattattctaacaattacttgggccaaaaaccttggcatcatccttcactctcttctctagcctatacaaccaatccatcagcaaatcttagtggttccactttcttatctttttatttagttattttttttgagacagcgtctctctctgttgcccaggctggagtgcagtggcatgatcatggctcactacagcctccatctcctgggctcaagccatcctcccatctcagccctgactagctgggactacaggcacacaccatcgcacctggctgatttttgtatttactgatagagacggagtttcaccatgttgcccaggctgttctcgaactcttaggcacgagcgatccacccgtctcagcctcccatagtgttgggattacaggtatgggccactgtgctcactggctcgctcagccagctccactttcaaaatacacgtggaatctaaccacttaccactacctccactgctgttacttagttcaggccaccatcatcttctgccaagattagtgcttctactcttaccccttaccctcatagtctattctcaacacaacagctagaatgatccctttagagatataaatctgatcaagtagctcttgtgttcagaactctccagggctttcagtggtgaccggcaaaattgttgccataattgagaaggccctgcatggtaaggccccagctaccttttttatctggtctcttagcactctccccatcactcactctgaatcaacatagtgatctccttgctattcccatagcacctcaagcaggctcctgcctcagggcatttgaatttgctgtctcctctgcctggaacactctccccctagatatctacatggcttacacccattaagtcaaggccagtttctgcttaagggctccttataaattcttctctgactaacatctaaaatagcagctacctgacaccactgtctaatccctaccctgctttgttttcttagcatatatccctgacattacatacttgttttctctcctcgaactagtaaagatccttgcgagcagggaatttgttttgtccattgctcagtaagcacctacatgagtgcctggtctggcatatagtgggagttgaatgaatatttttgattgaataaataggaggtaaggacaggatgggaaggcaagtaagtaggtttctcgatttcaggacattctacattttctgttacttacatgataaggaagtcaggggaagtggtaagggtataggtcagagatttgtagagatcgtggagagcaagttgactagaaaaatataatgaaatttctagtcacagttcacagtcctttttttttttgagacggagtcttgctctgtcaccccggctggagtgcagtggcgcgatctcagctcaatgcaaactccacctcccgggttcaagcaattcttctgcctcagcctccaaagtagctgggattacaagtgcttgccactgcgctcagctaatttttgtatttttaatagagacggggtttcacaatgttggccaggctggtctcgaactcctgacctcatgatccacccacctcagcctcccaagtgctgggattacaggtgtgagccgccgcacctgacccacagtccatttaaagttggtctttattaatgtagtgacgccaatctgttcagcaggacactttttctttttttgaggtggagctttgctcttgttgcccaggctggagtgcaatgatgcaatctcagctcactgcaacctctcctctcaggttcaagctctcctgcctcagcctctggagtagcagggattacaggtcttcaccaccacgcccggctaatttttgtatttttagtagacagggtttcaccatgttggtcaggctggtctcaaactcctgacctcaggtgatccacccgcctcggactcccaaagtgctgggattacaggcatgagccatcgtgctcggcctcaacaggacaatttttttgtttttgagatgaaatcttgctctgtcacccagactggagtgcagtggcgtgatctcggctaactgcaacctccgccgtccaggttcaagcgattcttctgcctcagcctccccagtagctgggactacaggcatgcgccaccacacccagctaatttttgtatttttagtagagacggggtttcaccatattggccaggctggtttctaactcctgacctcgtgatccgcccacctcggcctcccaaagtgttgggattacaggcatgagccaccacgcccagcaacaggacaactttctatgacaaggtacaagcaaggagaaacacataggtccatccagggtgagggatttcgttggggaaaaaggagtgttgtggtgggattaagattaagtaggggcaggactgtattaatgtaccactgaatctaaaatggataaggaaggaagtgaagaggggattaatgtataagagataaagtagaggctttcaaccgattagatgctctgctctgataaagtgaaagaacaggccgggtgcagtggcttacgcctgtaatcccagcactatgggaggccgaggcgagcggatcacctgagttcaggacttcgagaccagcctggccaacatggcgaaacctgtctctactaaaaatgcaaaaattagctggcttggtggcgcacacctgtaatcctagctactcgagaggctgaggcagtagaattgcttgaacccaggaggcggaggttgcagtgagctgaggttgcgccactgcactccagcctgggcgacagagcaagactccttctaaaaaaaaaaagtgaaataacagtaataacagttatgctgtaattctattttttttggggggggggaacagtgtctctgtcacccaggctggagtgcagtggcacaatcatggctcactgcaacctccgcctctcctgggctcaggtgatctcccacctcagccttccgagtagatgggaccacaggcatgcgccaaaacgcctcattaaactttgtattttttgtagagatggggtatcgccttgttgcccaggctgctctccaactactgggcccaagagattcgcctgcctcagccttccaaagtgctgaaattacaggcgtgagctactgcatcaggcctataattcaaaagtagtcaagctgagagaatagcaggctgtggttgaaaagagggttgttcaaattactgagtcgtgacgcgatagcgtttggagggacaaggtccaggttttaactgggattgggaggctgatataagggtcgctaaagacgaggcccgatgttgaatgggttggccacataggctctgaaattatcaaagatggtcagacgggagacagacaaggagctggatacacagatcggcagattatctccaaacggggtgaagtaggtgacagagtctaaggggaagggctgaagaagcaagtgtttttacaagaggtgacagcacctggcacataatcccgacctctgcaaactgagacctgagaatactaattcatgtgagaaagtttcaagggacgcaacattctcgggacagccaggtctctgtcccaggaaggagcggagaagtttagagacaagctgatctaaacacgagaacctctgaggaagaccggcttgaaggcaggagattgaggaggggaccgaagcgacggcaaaccctacactcctctgctctttagttactttcctcccagccaaccgcccaagccacaccaacctccgcaatagaaaacgctcggagaacacgatctcccgcccagctcttttcaactccccgcggaagtgctcacaccggaacccctctgtgtccgcactttgccattggccgaggcttccgcccgcttccattcgcttcctcccacaactcagtcgggctgcgcggtccgtaggagtcacttccgcctcgtcccaccccgccccccggtccctttctagcagcttccggcttcggtcccgccccgccccctgtggccccgccccgcccccgcccccgcccctggctggcggtccagccccgcggcgccgcttccggtgcgggccccgccccggctgtggcccccggctgcggaggagtccgagacgcagctgccgcgccggggcctgagctgccgcctcctccgccgcccgaaaacccggagtgccccgcacaggtaagtggcccgggtccgggctccctcaggcatggcgggagaggaggctgcgacaggtggaggggccgaggccaggagccgaggcaggtgtagagagagaggggaatgcgcgagtcgggggcgcggggaccgcgaaggaaagtgagagcgccgcgggagccccgagcgccctgtgcccattagggcatttgagataaagcgtttgagataaagcgatgagaagggtgaggggccctggagctgagtgggcgcgcagataggtggggcgggggccatcggaagagccagcggattggctgggagggttggtagaggtaaaaatgatagggctgaatggggggaggtgaataaagaatggggggaggcgtgcaggggtgaccgggaaggtgggctgtggggcttacaggggcccggggccaaaagaatccggcagcaaaagcaggggaatggtcagcaggccgggttcaaagctgcaggtagtccgttgtacccggcttggtggtccgggaactttaggggaaatgggggaggggcccgtgtgaagggatgaagaggtttagatttgagacataagttctccaaatgtaggcaggtggcattgtttggatcgctggctgcttagggactgcgggaaaatgggctctttgggggagggtgtgtgtattgagttgtagaactgagtcatctcagtcttactataagaggctgtgggagggacacctccccctctgctggggacagcattcagagaagatggtgccacaagacaagaagcagttgttcagtgactggcaggacttggttgagaagttattccgatcgtgattgattgactgtaatgactatgaggacatttaaaatgaacaccgaattatttgctttattctgtaattttctttgacccaaattgttttcattttaaatgaacacttttgccaactgaatttaatgtggatgtaaatcttgtcatgcttttttacactgtaagaagagctaaagcagaatgaaagtattgctgcaagcgtaactcacactttctgaagtgccaagagaggaagtaaaggcagtaagaggcaaattggaatgcgaatctttcacagaacacaaaaggcacaaacagggctataagataaacagaaaatgagaatttttaatctctactaattggcctagctttaaaaattgtacccttttttactctaacctggaaaaaatcttaaatccaagcagtttttattgctgaagatgtgattacttctccgtgaatttttgaagatactaaagacactttgttttttgtctttcgacccaatcctaaaacactggaacaatgcagatatcaagtcccaacatgtgcagtgcagcttctttcatgtgatgacaaaattgtacgccatgttgcaagtcctgttcacctaaaattgcccttgcatagtaatccattcagttatggagacttgctgaagaaacataactcaagtgaagtttgttgggggtgagggcctgcaggggagaggtgggggagtaaaaggagaagagggtgtgaaagtgatgtgtgtttggagactgattggtaagaatgcagataaacctgcccccagaatgcttttggcccgaaagacttttctttttgtgtttgtcagagaatatcataatagaaatgaatcagaaagaaaggggatgtgaagagatttacttcgctgtttataaaaaagaagcagcattaacttgttgttcagacaatgttgatatctgtttcaaattaattaactttaaaatctccagaggaattcccccgtttgcttttgagtgacgattgcaatttgagactcttgcctccttgcgtgtttctttcatgttgttgaaattggattctttttgaggctataatgtccagttagtatggctcagtccactcaacaagcaggctggcaatttgatcagggaaatttgaaaagcttagacccaagagcagcttgcttggtcttgctttttctatgagagtaaaactgtctgcctgatagttctgtgtctagcttagaggtgatatctttctcctgtgggcttgggaacatactctctcctttgcaggcaggtccttcttttcctttattattgttgtttgcataattatgcttctgctacagtgcaaacccagttaccttttcagtaattaatgttcagtaacattagttcagtaacagattaatgtttgataatgtagaggaagagagatcagaacacgttagcagactagatattggctggatgtacttcttttaaagcctgctactactactgaaattcattccctatttcccctcttagatcctgtttctcttcttcacaccttttcctacccacccacgaaacccccaccactcactcatcttaaaactcaggtttaggagcatatgtttagcgttcggaactcatggccctctactggagaaaaggaaacctttttatacctgcttaacatggttgttttttccccctccttctttgtggtttctgttaatcactaaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcaggtcagtctttctggtattgtaggtcatttggtcttcctgaaggccagagaggggtcatggactgacagggtcaggggctgtgccagtctgtgccttctcaccccacttcggtgaccaacagcctagacatgaatagactttggatttttttcttatttaatatttattttcttcattaaagcaatgaaatatatgttactctttttttttttttttttttgacatggagtctcactctgtcacccaagctggagtgcagtggcatgatctcggctcactgcaacctccatctcccaggttcaagcgattctcctgcctcagtctcctgagtagctgggactataggcgcgtgccactatgcctggcttattttttgcatttttagcagagacggggtttcaccgtgttagccaagatggtctcgatctcctgaccccgtgatctgcctgcctcggcctcccaaaatgttgggattacaggcatgagccaccgcccctggcctgtatgttactcttaatataggttttgccaagtttgatgtgaaagaatgtcaatacaatcttcttttttaaaggaaggatgaagttgcaacagtgttgtgaggaatatctaaaatgagatgtgtgactaattacagcttttctaataataatgtttctaacagtaatgtaaaagaaagttcttgcctaagacagtttcttagctccaggctaaccctctttaaggacagttggttgttttggagctaaacacagctgacaagaagcacttgcattgtatatattttccaacaaagagccttgtagacatgatttcatttcactcttacatcatccccttgacaacagggaagggtagacctcaaaatttcctttttagtcaaggaaagctgaagtgacttccaaatggctgagtatcagagtcagttagggagctttttaaaaaatacagattgctgagtcctaatgaattatcttggagggtggagcctagggaatctttgttttcaaccaagcctcttctctttgtgacccataatatagtttttcctcgcccaaaggatgggagtgatgataagttgttccagcttaagtgacttgttggtgcttagtaagggagttcatgggtaccctgcagaagcacacacacttcttgtgatccagtggtactgtttagaaatcatttgtgaaaagctgtgggttttcacagggcaactgagaagtcatataagaaaggtcctttggaacccaaaaaatcaaacatcttggatcaggaggtctgtacagtagatctgagttttacaacaatagtgtttgcagccagcagtgggattcaaatcccatcacttccaaatattgcccttgtgatcttttagtagggctctgatttgctctgagcctgtgtcttctcatctgtgaaataaaaagagtgccactgcctcccatggatgttgtaaggattaaccgagctagcacatgtgaaagcttgtccagtgccaggcacatggtaggtaatagtgcccgggggagctcttttatgtaaacagtgccatcctctcctgcatcacatagacatgcctctgaagtgggagatgtactgagatacacagaggttttcactcatcacccagggagatagtggcagagctaggactagaatcagagaatcccaacttccacgacagcagcaccctggccgccagcccagacccgcctcccactgattgctttggtttagcaaaacatctgtgagttgccggctgcccccgcactgctgtgtggttggcagagttccataccggccgctgagtcagctcatagcaggatcctgccctgacagcgctgggaaagttcaggcccgaggcggctgggctgcccccgccttggcagctggccagcgtctgcgtgtgtgcggtcgttcctagaaagtgcagccgcatgcgaggaacaagtggagctccagagcctgtctgtcttcaggaagtgtagcaggtgttgaggtcaagccattagaggtttaaaaaaagactcttcagaactggcgtgtgcatgtgcacacgtgtgcaccgtggcagggcacccagcatcatgttatctagatggtggcagccctatgactacgtagctcagtattcagggggctggctgttggcatttgaaactctttgcgttcactttatgtttctgaggcatattcactaattatagactgcttggcagagcacctgccaaaatgttttataaataccacagtagctgaggtataatccctcacccaaaatttaccttcccccaggatttggagatcaagaactgaactggggggctttgggtagcaatgacttaaaccgtcagatgtgcacgtccttttcccctttaatttttaacattgatttgatctgtgctctccttttctataaatcctgattttaaaggagtaaatcatatgcttggggattttaaaactttttttttagtatattttagaagggccaaaaataataatattcttggggagagcctatagaaaccattacagatcattagactagcttgttttgttgttcaaaatctttactttatgaaacttaatggagtgcaaaaatagaatatcccttgctccagcaacaattacaaagacctttacaattgacacagatctttcccccccgccttccccctcccccgccgacacagagcgcactctgttgcccaggctggagtgcagtggcgcgatctcggcttcctgcaacctccgcctcctgagttcaagtgattttcgtgcctcaccctccctagcagctgagattacaggcatatgctaccatgcctggctaatttatttttttatttttatttatttttttgtatttttagtagagacagggtttcgtcatgttggccaggctggtctcaaactcctgacctcaagtgatccgcccgtcctggcctcccaaagtgctgggattacaggcgtgagccaccgcgcctaccctgacacagatcttattgttaatgtgatacagtgtccatcttgttcttttgaacaacaaacttttacagaggcttctttgtgccagacctgtgctgtatgaaacaaggcatgtttctctctcagggagttcaggtctagcggtggcagtgtgggaacctcaagggggattcgaacttgggttacaataatttgattctgtcctgagtctactggagcccagccacccagtctgctatggcagagatattttaaaacagagttttgtttcaaacattcacatgccaaagtttaaaaagttaattttgtctacagcatagcatagcttggcaaaccaacaggaatactcagaagtattttgcaagattttggggtaagggaggacaggcatctgctaactgaaaagtgaaactgggaaagcttaagggttccagagattattctttgcatctgaaatcccttacttagaacatgtaaagtcaaaattatttcgtggattctctttgaagaaactcttagaaaatatttgcttctcaaggcctggattgttaaggtgtggtattattctctgacaccacagtgatgggaagatggataacgccattgagccaagtgttctaaaacccatcagattcctatgggcagagtaaataattgtaaaacaagaaaacagacaaagaactgagtgttccttttctcaaaggagatcatacagccaactaggggatgttgctggccttttgggggtggtgttctccccctctggtagaaggtggttcaagcagtacaggctgggtctgtcttgagcccattggtagagctaggttactagaagggtgtagacccccttcgatagaatagaaagaagaaagatggcttggcaggcatgtggggccagggtgcatgtgtccgattttctgcatactttggcagtcgctttggttactgcatgtggctgtgatccaaccacgggcttaacatactttcacagccaattcagttgaaagcactgggagccattgcacaataaatgttggccccctcctctacccttccccttctagcatgttttacaagattttgttttgtgactgccttctaggatggaagggtttaatttcagaatatttgcaattaaagaattcctaacgtcctaaagcttgctaatcacatgtgttaacaaggacagggtattaccaatttcaaacacctccaagccgcttggggcaccctcagctcatgacagcgtgggttctctctgaatttgttggagaagcacttctgcagtacagaagcaaaggaagctccatgacaaatgggaagaattgccatgttagatgggcactgggagagacaaagggaatgtgatttgagaagagggagtttcgtgtttgtttttgtttttttggggttttttttgcctattcttaaccatgagcaaaatcaatctcatcttaccgtgagagtcgacttcctgctgggcaattagtggagactactgtccatttcttctaatgccatgactgactgactggtgtccagaagccatccctctaattaaggtgtagtcccttgggataggcctacttttctttctttttttttctttttttttagacggtgtctcgctgtcactcaggctagagtgcagtggcatgatctcggctcactgcaggctccaccccccggggttcacgccattctcctgcctcagcctcctgagtagctgggactacaggtgcccgccaccacgcccggctaatttttttgtatttttagtagagacggggtttcaccgtgttagccaggatggtctcgatctcctgacctcgtgatccgtccgcctcggcctcccaaagtgctgggattacaggcgtgagccactgcgcccggccgggataggcctacttttcttggtagatactgcatgactatcattagctgggtgtggtggcacacgcctgtagtcccaactacttcggcaggctgaggcaggaaaatcacttgaacctgggaggcgaaggttgcagtgagtcgatatcatgccacttgcactccagtttggatgacagagtgagatggtgtaaaaaaaaaaaaaaagggaaaaagaaaagatacagcatgactatggaacatttgaggcttttttaaaaaactgtgcaaagtattgcccaaaaaagaaaatgttcgtaggctttcctcatgttctttatagagctaccttgcatgcccttgccttctgcagtcacaatggaatccatctagttgagtggttctcaattagaggtgacccctgccccttcccaggggacatttggcagtgtcaggagacatttttgattgccatgactggagtagggggcagtgtgctatgggcgtctagtgggtagaccagggatgctgctaaacatcctataacgcactggacagccccccaacagcaaagagttatctggtccaaaataacagtagtgccaaggttgagaaaccgtgctctagattgtgcaaccagaaagaacataagcttcgctatcatcagacagcaccagagactcttttcctttgtgtttcagtctcagtaactgaggagtttggcagccttgaattttcttgacttctgctttcaatatctgtaccgagctcatgtctttcctctagtcatctaggtgaacagactgtcacttgggaaaggtttggggcctagaacttgagatctcttacttgactctatcagtgattctttcagcccagcactccatgatatctttgatatctttggtgatatatgagagagcttggttgcccttgtagacattaaccccaaaaggttaaagtgtaaatacttggcagacttgttacctagtaacagatttaattattaaatcagcattggttttggagccagaggatgtggattaagaccctacttcccgccaggcgcagtggctcacacctgtaatcccagcactttgggaggcggaggcaggcggatcacgaggtcaggagatcaagaccatcttgactaacacagtgaaacatcatctccgtctctactaaaaatacaaaaaaaaaaaaagttagctgggcgtggtggcaggcgcctgcggtcccaagctactccggaggctgaggcaggagagtggcatgaacccgggaggcagaacttgcagtaagctgagatcacaccactgcactccagcctgggtgacagagtgagtgtccatctcaaaaaaaaaaaaggaaaagaaaaaagaccctgcttccactgcttgcttgctctagtactttggacaagcgttctaatctgcctctctgaacccatgcatcaatctattccagaggatgataatcctctcccgctatcctcaggaagtgattttaaggatattacaaaggtagaagaaaaatatgagtgtgaaagagctttgcagggttagggcgaattgtcatcaacacctaagtcctttttgaagctaccgtcgtccctcacatgcaggggattggttccaagacccccacatataccaaaatttgagcatactcaagtcctgcagtcagctctgtggaacccacatatattaaaagtcagtcttccatatacatgggtttcacatctcgtaaattttgtctttgatccaagttgggttgaaaatagtttacatataagtggacccaggcagttcaaatccacgttgaagggtcaatcataatttttcagtctttatgacctttgtagataagatgctccataaatcctacccactactctaaaacaactccttttcaggttttctagagccctgaccacactctggtgttctgaagttctctgaaacctttcaggattatgtgagcttaaaccatggcgcttctgaagctgtatctttccgtattagcatagggatatgtgtgtattgttctttaggtagaagtaagctttatagatactaagtccttataaatacacaatcactgacttgacttgggtccttaccctctcaccagaggctaatttctctacatgtgtcccagatcccatccccttccaggtttccagggacttgctccatcagtgaaccctccatttcctgactctttgggctcattctcttccaggccttttccacgtttacgcatcttctctctgtcagacttaaaaacaagcaaacaacaacaaaaacctttaatcttaaattttacctgagtcagttgttaacaaggaaatgagagaccacttttaaaaaatttcctcttgattgcacattattgccagctttttttctattcctaactatcccccacatccttgcaacaaagcttctcaaaggaattggttttactctttatttccatttgtcacctcctactcactcctcagcatactccagtctgatctctgtttcttccatgtccctgaagttccatgttgctaagcccagccttccctgacctcattgatttctcagcattattgaatacagagcactccctccttgaatattctcttcttttgctttctatagtccttcattctgcttatgcttattttcttttccttttcttttttctttctttcctttttttttttttttttttttctgagacggagtctcgctctgccgcccaggctagagtgctgtggcgtgatcttggctcactgcaatctccgcctcccgggttcaagcgattctcctgcctcagcctctcaagtagctgggacaacaggcgcatgccaccacgcccagctaattttttgtatttttaatagagatggggtttcattatgttagccaggatggtctcaatctcctgacctcgtgatccacccgccttggcctcccaaagtgctgggattacaggcatacaccaccacacccggctaattttgtatttttggtagaaacggggtttctccacgttggtcaggctggtctcgaactcccgacctcaggtaatccacacaccttggcctcccaaagtgctgggattacaggcatgagccaccacgcccagcctattctatggattttgacaaatgtgtaatgacatgtatccgccattgtagtatcacacagagtagtttcactgtcctaaaaattctctgtgcttcacctattcatctttccctcccccttaacccctggcagcccctgattcttttcctgtctatggttttgtctcctccagaatgttatatggtgggatcattaatgtagcctttttagattggctttctccacttagtaatgtgcatttaagcttcctctatatctttttatggcttagtagcttatttctttttgtgctgaataatattttgttttctggacataccacagtttatccattcacctcctgaaggacgtcttggttgcttcaaagttttggcaattatgaataaagctatcatacacatctgtatacaggtttttgtgtagatataagtttcagtttatctgggtaaataccaagaagcgtgattgctggattgtgtggtaagagtatttttagctttctaagaaactgcccaactgtgtctcaaagtgggtgtaccattttgcattcccgtcagcagtgaatgagcttctgttgctccacatcctcaccagcatttggtatcgttagtgctttggattttggccatgttcctttaactgaaatttttatttagctaattatagattcacagggagttgaaagaaagcaatgtcatgtacactttgtccagtttccctatggtaacagcatatacaggtatagtatgctgtcatacctggatattgatgttgacatcatccactgatcctacttagatttcttcttcagttttacatgtactcatttgtgtgtgttctgtttttaagccattttagttttacgttgaacacattttttgaaattcttgttacttaataaatgcattcaaggctatagagttttccctggatctcacttttgctgtaccccacaagttctgatgtgtagtggtttcattgttggctagtactaaacattttataatttcagttttaattgcttcttcaactcatgggttgttaaaagtattttttggttcccaaatatgtgggttttatctcttttccagtattattttatagcttgattacattgtagttgggaaacgagcatggtatcaattctctgaaatttaagatattctttatgttggccttatgtgtgattagtttctataaatgttccatgtgtgcttggagagaatgtatgttaatccatttcattataaggattagtgatacatttggatctatttctgccctcttttttttgttttgttttttaatttttatttatttatttatttatttatttattattttttgagacagagtttcgctcttgttgcccaggctggagtgcaatggcacaatctcggcgcactgcaacctccgcctcccgggttcaagagattctcctgcctcagcctcctgagtagctgggattacaggcatgcaccgccacacccagctaattttgtattttttttgttgttgtttattttttttgagacagagtctcgctctgtcgctcaggctagagtgcagtggcacgatcttggctcattacgagctccgcctcctgggttcatgccattctcctgcctcagcctcccaagtagctgggactacaggcgcctgccacaacgcctggctaattttttgtatttttagtagagaacggggtttctccatgttggtcaggctggtctcgatctcctgacctcaggtgatccacccaactcggcctcccaaagtgctgagattacaggcatgagccaccatgcccagccctgtttgtttttgagatggagcctctctctgtcacccaggctggagtgcagtggcatgatttctgctcactgtaacctctgcctcccgggctcaagcagccctcccgcctcagcctcccaagtacctgggattacaagcatgcgctaccacactcggctaatttttgtatttttagtagagacaggatttcaccatgttggcaaggctggtcttgaactcctgacttcaagtgatctacccgcctcagcctcccaaagtgctaggattacaagtgtgagccacagtgcctggtcatgccctcttattttggattttcaatttaactatacttttcttgttttctctttttctgtcttgtattgatttgatcgagttttatttatttagcctttatgtcctttgctggtctagaaattatacttttctgtttttattcttctattggttacttttagattgtaatttatattctttttacactaaaggcatatctcagagatattgcaggttcagttccagaccaccacaataaagcaatattgcaataaaataagtcatacattttttgtttcctgtataaaaattatgtttattctctggtctattaagtatacagtagctttcattatacctaaaaaaaaacaacaatgtacataccttaactaaaatgttttattgctcttgaatgttcccagcacaaagaaatggtagatgtttgtggtgatggagatgctaattaccctgatctgatcactatacataatatgtatgaaaacaactctgtgtacctcattaatatatataattattatttgtcaattaaaattaaagtaatactttattacaagaaaaacaataacaagtatctgagccttcagcgagttgtaatctttttgttgatagaaggtcctgccttgatgttgatggcttctgactgatctaggtgctgggtactgaagcttggagtggctgtggcaatttcatagaataagacaacagtgaagtttgctacgattgactcttttttttttcttttttgaagcagggtctcactctttcacccagggtggagtgcagtgacgcaatcacagctcactgcagcctcgacctgttgggctcatgtgattctcccacctcagccttttgagtagctggggccacgggcatgtgtcaccatgcccaactaatttttaaaaatcttttgtagaaacagggtctcactgtgttgcctaagctggtctcaaaactcctggttcaagcaatcctcctgcctcagcttcccaaagtgctgggattacaggcatgagccaccatgcctggccccagttgctattttgacctcctcccatgaatcatgaaatattcttgatgacacctagaacagtgaatcctttccagaaggtttccaatttgctttgcccggatccataagaggaatccctgtctatggcagctgtagccttacgagctgtatttctttttttttttttttttttttttgagacggaatctcaccttgttgcccaggctggagtgcagtggcacaatctccgctcactgcaagctccgcctcccaggttcatgccattctcctgcctcagcctcccgagtagctgagactacaggcgcccaccagcatgcccggctaattttttggtatttttagtagagacggggtttcaccgtgttagccgggatggtctcgatctcctgaccttgtgatccgcccgcctcagcctccgaaggtgctgggattacaggcttgagccaccgagcccggctatctgggctttcaacatgccttcctcactaagcttaataatttctagcttttgatttaaagtgagagacatacaactcttcctttcatttgaatacttagaggtcattgcaaggttactaattggcctaatttcagtatggttgtgtccaagagagtagggaggcccaagaagagggagaaagatggaggaacagctagggtggttggtggagcagtcagaatacatacaacatttatcagtgaagtttgatatcttatatgggtgtgattctaggctctccaaagcaattacaatggtaacatcaaagatgactgatcacagatcaccataacagatgtaataatttttttaagtgtgaaatactacgagaattaccagtatgtgacagagacacaaagtgagcacgtgctgttagaaattaggtgtgctgtgctttcaaacattggtaccttagaaattctagttttaacatctacctctccaatcctatttaccagtttatagtggccagtattttagttctaatttgttttaacccgtccccaaattagtttttttcccctcacagttattatttatttagacttacgaagtttatccatttcttttctcaccattacttgatcctactcattccctctgggctcactttccttttccttttttcttttttttgttttttgttttttttttttttttgagacggagtctcactctgttgcccaggctggagtgcagaggtgcaatctcggctcactgcaacctctgcctgccaggttcaagcgattcttctgcctcagcctcctgagtagctgggactacaggcgtgtgccaccatgcccagctaatttttgtatttttttagtagagacagggtttcaccatattggccaggctggtctcgaactcctgacctcgtgatccacccgcttcggcctcccaaagtgctaggattacagacgtgagccagcatgcacagcctcctttttctttatttactaactttttttagcagagacttatatgtaataaaagtcttggccaggcatgatggctcatacctataattccagcactttcggaggccaacgcaggcggattgcttgagcccaggagatcaagaccagcctgagcaacatgatgaaaccctgtctctaccgaaaaaaaaaaaaattagccagataggttggtacctgcctgtagtcccagctacttgggaggctgaggtgggaggatctcttgagcccaagagatggaggctgcagtgagctatgatggtgccatgcactccagcctggatgagagtgagaccctgtctcaaaaaaaaaaaattgtggtatgtttgaaactttcaaaaaatctttttattttgccctcacttttgtacagttgttcatagctttagattctacattgaccattatttttttcttcacccttaatgataagatttcattgtttcctaacaactgtttttgctgttgagaaatctagtgtcagtctgttaatctttttctagctttttatttaaagtgagagacatacaactcttcctttcgcttgaatacttagaggccattgcaaggttattattggcctaatttcaatatggttgtgtccaagggagtagggaggatctttttctctcttgtagcttttaagattttttctttttgactctgctattctgcactttaattacagtattctaggtttcgacttacttttttttttttttttttttttgagacggagtctcactctgtcgcccaggctggagtgcagtggcatgatctcagctcactgcaagcactgccttcagggttcatgccattctcccgcctcagcttcctgagtagctgggactacaggcgcccgccaccacgcctagctaattttttgtatttttagtagagacagggtttcactgtgttagcctggatggtctcgatctcctgacctcatgatccgcccacctcggcctcccaaagtgctgggattacaggcgtgagccacgcgcccggcctttcaacttacttttattccacttgggtctctgtctgctccttcaatctggtttgtgtcttttttttttttttttttttgggtactattttttcttaaccagtattctaatagaagtatttgaacctcctcattcagtctcctgtgcgtcttttcttttaaaatcttatgtatttatatcattctcctgcattctggattattttcacatttaattttctaatttctaattctgtcttcagctctatctgttctactttatggctctttaaaaaatggtttgtcgtaattattgtgtttgtttataaattttttggcatttaaaaatctgcctgtttttactttatggtttctattccttcagctctttgaacatctttgactttttaaaactttatattggaattgctaaaactcatttatggaaatttcatacatacaaaaaaaaaagaatagtaatgaaccatctgtgttctttaatcagctttcaacaagtatcaacagtctgccattctttttaaacatgcttattttaaagatgcttttagagtctattattatctctaattcttggggtgcaagttcttcctgtgtcatgttactgtcccttaagatggtttatttcctcttggtttgtttttgttttttttccagtgtaaattcattttgagtggggatttgtttctgtaggaatcccatgtgccttggatggtggaagcattcctaaggggagttttgtttttccctctgctggggctgcacaagtttagctcgttgcattggtttgggtagtgtgaatttgaagcctacatctgtgcctagtgagagcccctcaatatgagtcccctgccagatggcacggttccttgcagcttcgccgggctggtgggcagtgtttttaggcccagtttatggcgggccatgtagtctctcatggcctctggctttatgcagttgtttctgttctggttcctggcatgcaggggcctacagcctggactcccttctcttggggttgattcagtctccagctctcagttcagcactcggctcttaagaaccctattcgggtcatgttctcccttgagcccttcagctttgccacttgctcactgattgctaccattttgtttctgctgctgtggactctgctttctttctgggtttcaagctcagctatgtatgcaacgggtagagtgttaaatgttatccagcttttctatgtgaggttttctttggggaagaagcgagggagatggtggagttccttcacatcagactatcctcactcacagttttgtttgcttgttttcttgtttttgttttttaataactaagactttttgacctcttatgtgccaagtaccttatttcatttcattgtgtgaggcaggtcctaatattatcccctttatgtgtttgttttatttacagatgagggaaaaggtcaagtgggaagcttgtggtctcacagttgggaagctggctagtgaacccaggtggtctgacttctagctccatattccctcttgctcccttccagatagaacaggagaaaaataatctttccttagtggttttattactctgcaaatgacttttacttattttttctgattgtcaaggtaatgcaggctcattttagaaaacatggaaaatgtaaaaatttgtaaagaagaaaatacaatcactacagccacataacttagatttaatataactataaacatttgttgtacttgcgttttgaagaaaaatgcctactatagatacagttttaaattttatatacaggctgggtgccgtggctcacacctgtaactccagtactttggaaggccaaggcaggtggatcgcttgagcccaggagtttgagaccagcctaggcaacatggcgaaaccctgtctctactaaaaaaaaaaccacacacacaaaaattagccggagtggtggcacacacctgtaatcccagctactcaggaagctgaggcagaagaatcacttgaatctgggagatggagattgcagtgagccacgattgcaccactgcactccagcctgggcaacagagcaagactgtctcaaaaaaaaaaaaaatttatatacaattttgtgcttaacttttatcacctaacaggccttgagcaatttaaagtattactttaaaatattttagttttcaaagtatattacagaagtaataataactcaaataattttagaaatttggaaatgtatgaaataaaagtctgactcttcaggtgtaattgttaacagtttggtctacaccttcttggagctttttcttttcacaaatatattttgtctgttctacatattgttctaccacttgcttttgtactctgctctggcagtcctccatgagtgttcatgaagatctatttttcgtgtttttataattatttatttaaaatcacataagcggtatgaataggtgctcatgaaaattaaaacaatatggaaaaatacagagtaaaaattcgtagttaaaaaaataccatggtgtcctgttgcctgtcctgtgtccttacacctcacaagtaggagtgaatcagcttctaggactgtttctgtgtatttactgactgaagtgtgcagtcacagaacatgtgagtgtgaatgtacttgtgtatgtgtgtgtagtatgtgtaaccctatgccctggtatatgtatttctgtggtgggatagattattatagatgttgattaggtgtctatgtatatgttagcttttcaatatatactgttaattaccctcaaagatattactccgctttgctaccggtgatatattttcccaaacccttgtcaacattggttattatcagtccttttatttttgctgtcttttcatatgtttatgaaactcctgggctcaagcaatccttgtgcttcagcctcccaaagtgctgggattataggtgtgacccaccgtgcccagcccgtagtttgtctttcaacttgatgtgtggttctttaatcaagtaggggtttaaaattttgatatagctaaatttattgatttttctctttatggtttctgtcatacttgagaaggcctttccctaagattacaaaaaatattctctattcttaatactttatggttgtgtttttaatcgtagctctttactacatctagaatgaatgagaaggatgaatagaatgaataggaatcaagtgtgtttaaagagtattgctatttttgatggctgcataatgttttatcacatggatagcaccttcatgtgttgcccattcccttaatgtcagacatttagactgctttaaattttttactcttataaataaaattatactgtatttctagttatttccttaggatagagtcatagaccagaattacaagatcaggaggagactaagaaagtgaggcagttataagcagggacttaaagctgccctgcctgcaattgattcccaactccaccatttggtcactttgtaaccaagtcactggacttccttttgctttggttttctcatctgaagagtagggataataatagtacccacttcagagcactgtgctgaggattaaatgtcaatacatataaaatgctggaatagtgcctggcaggtagttagcacagatagtccctgacttaagatggttcaactcaactatttttcaaccttatggtggtacaaaagccatgcacactcagtagaaactacttcaagtacccatacaactattctgtttatcctcttccattgtagtattcagtaaattacaagatactcaacatgttattataaaataggctttgtattaaatgattttgcctaattgtaggctaatatatgtgttctgagcacgtttaaggtaggctaggttgcactccagccctggcgacagagcaagactctgtcttaaaaaaaaaaaaaaaaaaagcaggctaggttaagctatgatgtttagtaggctaggtgtattaaatgcatttccgacaacggtattttcttttcttttcttttcttttcttttttttgtgagttgaagtcttgccctgtcgcccaggctggagtgcaatagcacgatcttggctcactgcaacctccacctcccaggttcaagcaattctcctgcctccacctcccgagtagctgggattacaggcatccaccaccacacccagctaattttgtatttttagtagagactgggtttcaccatgttggccaggctagtctcgaactcctgtcctcaggtgatccgcccacctcggcctcccaaactgctgggattacaggcatgagccaccatgcccagtccaatattttcaacttctggtgagtatattgggttgttaacgccatcataagtatttttctgttttctgagacagggtctcactgtctcccggggggaatgcagtggtgtgattgctgctcactgcagcctggaactcccagtctcaaccaatcctctcaccacagcctcccaaagtgctgggattacaggcacgagccacctcacctggtccccatcataagttgaagagcacgtgtactcaattattagttgttgctgctgctgtttttattgtgataggcattttaaggcaagtgactttccagaaagtcatactattttatatttccagtatgggaatatgggagatcccattgtaccaacccttgttgtcactgaaaattattttttgaagctttgctaattttacatatgaatcatgggccccttttttaaaaatacaaattcttatgtttagctcttgggccttaaaatttacctgctatctttaggaaatgacttatattgccttctagaccccttttctagagttgtcgtttagaactagcagcccaccttcttttaagtgtgttctgattttccccccagattattcacttagcttgtgctgagtctcctaagtttattcccgttggcttgttcttcaggtatcaacattcatttgagcctcgaccacctgtcaggccctgtgcttgatgcaccagcctcacagaggagtcaatcactatccccatgtgagagagcctcagcctggtagaggtggccggtggcatagggacagttgtcatcagagaaggaatgtgtatatcatagtagcaccccaggatgggggtgtggacctggaggaagccttaggagaagctctgagaaatctgtgaatgcagctgacttttaaacacaaactgtgactgtgttctgcctgaggacacccaaacttgtggaatcccaaatttgaaaataaaggagggattttttaactttgtaaagtaacttatgatagtaatttttaaaaatgttgttcttcctatacatttaaaatgtgttgtttggggggaaaaaaaagttttatgaaacttttgggcaagtttccaacctcttaggtctgtttcctttctgtcaccagcgggtccattgaagtgttcttgtgctgggctctccaactctgactttgtgcaactctgtgtggagcctctgtggtgtggatggatgtcagcaaccattgtggaagttcaggtggtagctcaagggttggagtaagccgtagtgctgccaagtcagattctgcagagaaaaggagctaggacttacttacctctgtggctctcggacttggacttggctgggccagttcatgccttggtatcagggtgtcctcatcaccaacaatgtattttagtttttctgccacctttggtaggaacatctatttctgggaagtcttcttgatcattgcatggagtgattctgtgcttagtggaaaggtgggaccgctgccctctcttcctcccctgctctgcccgctttctacagcttaatcagagaagtgtcctttagctcttttccaagccactgagtttgaattgatctccgctgctagcaagaggtgggaaggctctttctggttcctgctaaagttacctgacagcggaaggtgtgcatctgataattataactctagtgtttccaaggcctgagcgatttagttaagagcactaatcctgatcttatcaagagggttttgtagtccaacagtgttgcttataacagtatctgttttacttcctggggctcccctcccctcttaggattctcctgtaatcctgcccattatgccttgtgcatgtctcattacctcctgaaatcagttaaaactggtatgagggcaaagagcattttttcttttcttcataccaagatctgagaattggatttttaacattacatcattaatcaggccagcagtagagtagtcacaaatgtggtatacgtaatgcctgcagagccatggatctggccaatgataagatagtttatttgttgcttattaaaaacaacaacagccacagtcagcccaaatgctttagttacattttgtattttggagcagttagttgccatccatgagcttgggatcagcccctttgaagtctaacgattttctttttctttttctttttgagacagggtatcactctgtcacctgggctggagtgcagtggttcaatcatgactcattgcagcctccatctttcaggctcaagcaatcctcctatctcagcctcccaagtagcttggactacaggcacatgccaccacacccagctaattttttaattttttggtagagatggggtttcaccatgttgccaggctggtctcaaactcctgggctcaagtgatccacctgcctcagcctcccaaagtgctgagattacagtcatgagccaccatgtctggcctgaagtctagtgattttctaatgattactttgaggttcaggtcctaggagtttgcttaaatccttgaccttgggattcataatctatttgatttatagagaatagacacattactgttctgtgtcttttttttttaaattaattattattttttatttttttgaaatagggtcttgccctgttacccaggctggagtgtagtggtacaattgtatctcactgcaacctcagcctcccaggctcaagcgctcctcccacctcatcctcccaagtagctgggactataggcatgtgccaccatgcccagctaatttttttatttttttaattttgtagagatggagtctccatatgtttcctaggctggtctcaaactcccgggcttaagcagtccttccacctcagcctcctaaagtgctgggattacaggtgtgagccaccgcaccctgttctgtgtcttcagagaactctcaagaatctctataaaagttgtcagtatgcacaatggcaatttaaggacagggcagtttctgagaggttccaaaatatcaggaacccaagtgaagacttgttagctcagcccctgggctttaaaccccaaggaagggttaacccttgccttggggaggaatgaggtatgggaactaaaattgctttggacatctgagctgtgctttaataagatattccaggtggtcaaggagtaatcctaaaatagcctagatacttaattgcttttaaagtcaggcgcttctgtctctggggaagtgcagctctaaggaatgcagagctggctcctaagatcttagaagcatggtctcgttgttttttttgttttttttttttttaatcccagtaaaaagaaaaggcccaaggtagccttcttggatcaggagacctttgttaaatctacctctttcttctcattggaagattggcagtaagccattggcttctcctgctgccaggtgccataacctggcttcttccagggctgtgagattggtgttgtcaccccacctcactaggcagtggtctgttttcattagtgcttaaaggcttcctgcttgatcccctgtccagcctctgtttgcatcagaacatacctttctcactataagaattcagattaatccttctctttctctttcatcccctcaatccagatccagttgattctccatttatggcactgatttctccctcattctgctactctccgtctcccccagtcccacattctcagcttgggctactgcacagccacctacccccagtgcaggctttccctctcagattttcaataccatttacaaaatctgtcagcattacaagtcattactgaggggcattaaaaatatttttgattaaatgaaaaatcatactactctcttacttgtaattgaaagactaaataggccaggcgcagtggctcacacctgtaatcccatcacttggggaggctgagacgggcagatcacctgaggtcaggagtttgagaccagcctggccaacatggtaaaacccgtctctactaaaaaaaaatacaaaaattagctgggcatggtggcgcgtgcctgtaatcccagctgctcaggaggctgaggcaccagaatcacttaaaccagggaggcggaggttgtagtgagcccagattacaccactgcactccagcccgggtgacagagtgagactctgtctcaaaaaaaaaaaaaaagagactaaataaattttgtgaaggtgtccgttctatgagaaattctctatgatttcagtgcagcctggttccaaatcttcattgtagggtggaaagcaaatgataagtcgtgacaaatggttcagattaatctagaaaataatataatttttaaaataaaaaaagagcataattgcattttgtaattgtttgtctctctctctctccattagacagtaagctccatgaggtgatcatctgtcttgttccttttccttcagaaccttttaccataactggtaaattctaggtgatcaagtgtttgtacatgaatgaatataatggaaaaaaaaggaaaagtgaaaatcccccagttccaatccgattaggtgtctatgtacatttgtatgtttctgttattttttttttcaacaaaaatgggccactaaagcagtctaaaacattgatttaatcatgtgctttcctgtccagaaaacatccactgcctccccactgttcacagttcagagtttaaatttccttctggtattcaaggcatctcacagcccctttcaactttaactattcagactttctgtccttatatcctccctgtcaaaacatgccttgtttataccccactccatgctcatttagactgcaaatctcccttcaacccattcttcaaggccagcttaacctccacctctaagccatccagccttttcttctacctcctgagtaccttgggttttcctatttgttgtcttgctattatatgctatatgtgttcagtttgtttttccaacttcatggtaagactcccagtggtgggaacaattttttttttttttagtggtattctcagcagcttgcacaatgctctacctggggtaggttctcaggaaatctgtgttgaataaacttgtcatcaggtctttgcttctcaggacagaaagggcccctagagaccatctcatccaccctgtctcatgttggattccacgccatgacatgccatacagatagtcatccagagacaggaagttgcccacctcctgggaagctcactccattaccaggcagttctacttgttttaaaaagtccttctgtagacctgaaatcttcctcagggtaacttctgcctatcacactagttgtgccctctggagctttagaagaaaggaggaaaaagcctagtttctcttcactcactacctttagattttcaaagatagtctgtttatttcccctgtgtgctgttgaaatgggttccagggttgagatgctggagaagcactattctaattttgagtagcagtcaggtcagaccttgattcattatttttgaaggcctgtgtgtgcatgtcacagtgtaagctgccatcttcctctggtccattcagaggtgtagccctcttctctttttctcctctcccctgatcctctgtcttctgggggaagatgggcccattctactggaatggtctattttggagggaggggtaaaaagttagcaattcttatttcagtaccgccagataactctcctgggcaagcattgtgtgagggctgcttttcgtttggctaaagtgcccaggtgaagccatgagataaagcaaagataaaagagtctcccattgataggagctgcccagtgccatgacatgggcatttcaggcatctctggacagaggattttattctcacttccttttcttcttttctcccttcctgatctccttatccagaacacttcgtgttattctttcaaactacaagtcagtatggtgtaacagcgagagccagacagacctaggtttacatcctggcactgtcactaagaagctctgagaccctgagcaggttatttgagctctttgagccattgttttcccatttctaaaataaccacttctacattatagaattaagtgagaaaatgcttgtaaggctcctggtacaatccttagtatgcagaaggcacacaaacactagcttcctgctaccttttctctttcccccaaccttcttttcctggggaaaattagctgaatgtaggtatagtagccaaagctagtcttgggtgtgtatttgggagcaaactatcagtttcctgtgagctcctggagagatcaaagatgttaaaagacagttctcaagtaggagaggctgagaaggctgtaaatggcagtaagtggccactctggctactgttgacttcccacacacgtttctgggctatataatactgctgcctgctgctgatggtgtaacaaagcctgttccctgggcaggttaaacttgcatgcagcaacccttcaactgaaatgctttcctcatcaacctcttttgatccctaaaatgttgagctgtctctttttgggtttgttttccccaccctccatctgcctctgctgttccctgctttcttccaccattacagtctcagtcagccacagtcagcatccgagaaaaaattatttctgggctgataattttctagtagtcacacccatactctattgataggccaagaaacctgctgcacacaaacttgaattgcataagtgagccatgttttacagcagttgatcagagttaagaaccaagaaaataactggttaagcctgtaacccacccaatgaaagggggaggggaagacggaggagctgtggggttggaggtcccacaggggagcccatctctgtcttttagcagatatatcggtgctccctcttcattattattattattattattatttttggtagagatggagtctccctgaccaacctggccaacatggcaaaaccccatctctaccaaaaatacaaaaattagccgggcgtactggcatgtacctgtagtcccagctactcaggaggctgacgcaggagaatcgcctgaacctaagaggcagaggtcgcagtgacctgagatcatgccactgcactccagcctacaagaaagagacagtcttcctatattgctcaggttggtcttaaagtgctggaattacaggcaagagccaccatgcccagctggtcagtgctttctatgtgctcagggctggagatacccagacgagtaactgaacacaggtggtagagcccagaggagaaaggtgttgaatctgcctggtgggcagaggcaggaggctctgctagactgcgaaaggcaggcagggctcaggaattactctcacctcagccagaagatcctgtgaagtgggaccaaagtttaactgccttaagacaaagaatggaatgcacgttggacatttttacatcagccccagctgaattgaccatccttgccttggagctggacgaaagaaaatacctcctctctgggcaactattttccccacattttctttaaatagagtaactgacagttcctatctgtggaatgggtccaacagtgggattactcaaagagttcggtgtctcatttctttcctgctctggcaagtcttcctgacctctgtggtcaccaagctggaggcattttaagctaagtgggtcacacttagtgggctctgtgcaaggcctcaccatctgactgtcagattctcttgcaggttggacaaagctggagaagccaagaggaccctaccagccccagcccccatcctgccaaggcattctccatgtgtggagccgagcgctcacacttgggtgtttattttcacacatagtcacatagtggtcacactagcgtgcttgttttcacactgctgtccttctgtggaaagccctgtctgactttttaggttgtggattccaccctttccacccaactgagtgttaaatagtttttgagtgagcattcagagtgcttggaagttactataattagcaaaaaaaaaaaaaaaaaaaaaaaaaaaaaaaaaaagtgttttcatctctcttggtgactgatagagaaagagtccttctgtgaatgagatcagcttcagagctctcgccagagaattgggaattgagctgccgcagtaaacagctgacataacagaagcggcaatgatcccccattaaatgtctttcaactgataggggctcctgggataattgactttccagcaggaattactggctcaaacaaaatcactgggcattagggcaacctactgcatcctttgaaagggggaatgtaactctgtctggttttgctgacctgacaggcataattcatcttgattattcattgtgctagttgccaccagatgacaccagatttctggtgactgtaattacaatgtgggatgagctttaacttttttttctttttaaacaatgttcctcccacttggctattggctcccctgtgctgaaggtgctgtaggaagggatccaacaatgtctgccttgagagatgatgagtgcatggtcagatagcatttaccaagcacttccatacacacatcttttactagataagcagggaaacaatttgatgtagtctgtttcattttaactgacagagtgtcacttcttagttatacttatgtcactgtgtgccagattgctgctatcggaaagtgggtcttcatctcagagcccactgtgaataggggaagcaaagttggccccaaaatataactgcataatgccttctgctttcagacaagctttattaaaggggcaggtggaagagagtggaattcaaccaagcttttatttcgttgacatggttttagaagaagattcctgagtagtccaaagaatgttctcccaagaaaccactgctccccagccccacatgtcctttcctcaccacatacacaccccagccagctgggtggcatggtacgcatgcacctgtggtcctgtgggagaaatgaatatgacaggttcagtgtgtccaggccactgggacctccactgaccagtgggtcggggtgaacaagagagttatactgtgagagttcataccctcactagcacaaagactttttgacccccctgtaaggtatgtgtatgttttttgaagaggtgcttaattggtgtgccaggcaatgtgctatgtgcctgatgacaaagataaataagatacctttcctttcaaggagcttaccatatggtgaggatgacagatacttcccaagtaatatgttaaaatctaagctagaagtgaacagagattgcttttagagggttgaagggaaggcttcctgctgaagagataactgattggaggaataagagttactggacttggctgggcgcagtggctcatgcctgtaatcccagcactttgggaggccaaggtgggcggatcacctgaggtcaggagttcgagaccagcctggccagcatggtgaaaccccatctctactaaaaataccaaacaaaaattagccgggcgtggttgcgcacacgtgtaatcccagctactcaggaggttgaggcaggagaatcacttgaacctgggaggcagaggttgcagtgagccgagatcgtgccattgcattccagcttgggcaacaagagcgaaactccatctcagaaaaagaaaaaaaaaaaagttactggactgattaaagataggaagcaagtttaaagaatatttgccatcccttcctatttagttgaatggtgttgcttcaacccaatcaattaagttgggcttagattttcactgtttctctaataaaaatgaactctcgccctagtggcacagagtctgtaccttggaaacaatctcaggccatggtggccctcatatcaccatgagttcttgccatgcggcttagggttttgaatggtgaggcttgactaagagaccaacttcaggatgtatgtcctgctcgctttgacccttatcacttacagtgttgtataggaaaccaggcaaggtgtcttcccagtctgcaggaaagtggtgcatctcagagtgatggcttctggcgatcagccgggaatgagccccttctaagcaacgtgggcctttgtgtcctcctcttccaggattatcaagtataaatgacacccacgacacctacccttctccaacaaatggagatgattcttccacccgattccctctttattttggaaccaaatcaaaagccaaaaaaaaaaaagatgtccctgtaagggtggcagaattagtcttctgagttgtcttttatagtatgagtgaggatagcacaattgctaagcatcttcatctttgccctaaatgattgccttgccctctgtcctaactctttctcttcctttgcccctctcaactttgtgttttgttcccttttagaatggtggtttggcctggagtgatgatgcagatggaggccggggaagagagatctctcgagattttgccaaggtctgtaatacttcctttgtgatacagataggggcagttctgcagtggcttgttacagctgattcccaagaaataaggaccaaggtagccagtgagttgcatttgtagtgattcagatggtcatagtatatctggtataagacttcagcaagatggaatttttcactgtgtgtttttcttgggggattgggattgcagctgtatgaactggacggtgatcctgaaaggaaagagttcctggatgacctcttcgtctttatgcagaagaggggtgagtgtgcatctactcatcattccaattcagggaatactgatagagtgcctactgtgtgctagtcactgttagacatcctggcccactaatcctcatccaggaggagaagaggcatttactgccagttggttctggatttagccaattaaccgatagccagattgaagaggacagagaaggtgttggcacaaagtagatggaatgatcgtccacttttggccctgcctgattttgtctcttcttccaattgactggtctctggagtcacttcaaattcaaatatgccttttttaagccttaaagctaccctggacttcacttaatctagcatgtgggccttcttgttggcatatctagtctcatggagaaaggtaagtgaaagaaaagaggcccctcaggatattttggaagggtctgaaatgatccatggaaagaaaaggccaacactttcttcttacccattggctttcgatgtttgtatttgctggcttggttagaacattcctgcagtttaatagtcaggtacataggcatctgcctttttttttttttgagatggagtctcgctctgttgcccaggctggagtgccatggtgtgatctcagctcactgcaacctctgcctcccgtgttcaggcaattctcatgcctcagcctcccaagtagctgggactacaggcgcgtaccaccacacctggctaatttttgtatttcttttttcagtagagttggggtttcaccatgttggccaggctggtctcaaaatccagacctcaagtgatccacctgccttgacctcccaaagtactgggattacaggcatgagccaccgcgcccagccggcatctgctttataatgcaccctcccaattctctttccttctctcctcactctgcacatccccaagagccatcttcactgtagactatggtgtgactgagtttagagctgagtgactcaacttcctggctttgtattcagtcatagcaatgggttcaccagccaggtcagccctcagaacacatggccagcaccccagcctctctaggagaaggccttcagcaacctgtgtggctccaccttcgtcaccctcaggacaaaaccataggagagagctactcccagtagcctgctcccagcatcctgttatagctgatcatgcatcccttggtgcctgtgtcaacaactttattgagacctaagaatgaaatcttcctctttatcctgggccaagctgtaatggcagcccccagcagctaaatattctaagttaacttctctctctctctatttccctccttcctccctactcctttacctttggcagccttattgccttcttggtgtagcctgcctgttactgttggtttgcgtaaaaaaggcaatcgaaagttttgaatcttggttttccccagtctctaagcccatcaaagcaatctgagcagccttaattagtttgctcctccagctgttacctggaactgcatgtgtcagtaaaaaacaatataatcctgaggctgggcgcggtggctcctgcctgtaatcccagcactttgggaggccaaggtgggtggatcaggatgtcaagaggtcgagaccatcctggccaacatggtgaaacccgtctctactaaaaatacaaaaattagctgggcatggtagcgcgtgcctgtagttccagctactcaggaggctgaggcaggagaattgcttgaactcgggagatggaggttgcagtgagccaagatttcaccactgccctccatcctggcgacagagcgagactccatctcaaaaaaaaaaaaaaaaaaagaatataatcctgaaagataatgtgactggcagcaatgaacctccccgtttgccctgagagagaaatccacttaatactttggtctccccttccaattaccttttaattatttacaagctccacaagcccagctggtgcaaacccaggagctgatcctgtctcaaaggggctgccatagcaatatagattttaatcagcagtggagctccactgctttattttccactttattgtttttctcccttccctgaaggatttttaaaggaaaatggaagtgagatcagccaagccgattgtgaagatcagtaattgtttactactatatgtccccactagactaggagctcctcaaggagggccactttgtcattctttcatgtccccagtgctagcacagggccaggcaggaaggtgctcaggacatgtttgctgtgtgagcagtcttgttggttttcctggctcagattgcaacatgcagggtattcaagctgccttgaggtttgggtgcatctgtgtccttcagccagctgccccgtaattgagagtcagcagtagagaacagtctttgctgcatatcctgctgttctgtggcaactgggactgccagattgccatctagtatatttctgagtgaacccaaagcaggagtgagtgactccctttgataatgtcactttatgattcttcaggtcctgagtaaatctttgtcctgtcttcagcacttacgtcaggtatttcactgtttgctggcattaccaacagaagggaaacggttctgtctgccacttgttactttaataaaaggtttctcagcctcagcactgttgactttgggatgggtagtccttgttgtggagactgtcctgtgcactgtaggattttgtttttaattttgagacagggtctcactctgttgcctcagctggagtgcagtggtgcgatcatagctcactacagcctcaaagtgctgagctgaagcctttctcctgtttcagcctcctgagtagctgggactataggtaggcaccaccatgcctggctaacttttttgttctgtagaaatgaggtctcactatgttgcccaggctggtattgaactcctgacctcaagtgatcctcccacctcggcttttcagagtgctgggattacaggtatgagccaccgcacctggttactgtaggacgtttagcagtatccatggcctctatccactagataccaatatcagcccctcagtcacaacaaccaaaaatgtctctagatgtcataaatgtcccctggagggcaaaattgtcccgttgagaccctctggcatggaaagatgagaaagagaataaagatgtaaaatatcctctgcaagaaaaactcttagctgagtgtggtggctcacgcctgtaatcccaccactgtgggaggctgaggtgggaggctcaggtgagtctcagtaacatagtgagaccttctctctacaaaaaatgaaaacaaaattagccaggcatagtgatgcatgcctgtagtcccaagctacttgggaggctgaggtgggcaaattgctcgagccggggacttgggggccgtcatggaggccaacattgcgccactgccctccagcctggccaaaaagtgagaccctgtctcaaaaaaaaaaaaactttttatgaaaatcatcttacctccagtcaggtacatgagagcaagccgtgttaggtagcattgtttcctgtgactgagtgccaaaggagtgagtgctggggcctcaccctggcctgcagtgcagagaaaggctctgagaagagctgtggctctagtgtatcagacccaaccatggaggtggaggaaaaaatgctgtgacacatgtggccctggtgtagctggaagaacccttgttgatggcccagagccaggggccatcctggatgggtcagctggcatgagactctgaagagccatgtttgcccaaaaagcgcttcagtctgtagatatagctgagttattgaaggcaaaatattggctttcaggaaacttgccgtggcagtgtatagttgggctagagaggagagactgaggcaggaagatagtgtagaggttgttattcccagcgatctcctttctagaaaactcttatctggtagtccgaactagagtgagtggttcaggagggttgggagtggggcatggtggctcatgcctataattccagcactttgggaggcctaggtgggaggatcacttgagaccatgagtttgagatcagcctgggcaacgtaacaagaccccatccctgtaatttaaaaaaaaaaaaaagaagatgtaatcccagctacccaggaggctgagtcaggagaatcacttgaacccgggaggcggaggttgcagtgagccaagatcgcaccattgcactccagcctgggtgacgagcgaaactccatctcagaaataaaaaagaagaagaaaattttaaaagaggggtgggagcagattgcacttttattttaattaattattttatttatttttgagacagggtctcactctattgcccaagctggagtgtagtggcgcaatcatggctcatcgcacccttgacctccccaggctcaggtgatcctcccacctcagcctcctgagaatctgggcctacaggtgtgcaccaccacactcagctaatttttctgtttttttgtgtgtgtgtgtgtggagacgaggcccttatgttgcccaggctggtagcaaattcctgggctcaagtgatccaactgcctgagcctcccaaagtgctgggattacaggcatgaaccaccacaccgtgctgggcctcagattacagttttaatcatgtgaggcttgctgtctttgttcctttttttgagacagagtcccagtctggagttcagtggtcgatctcagcttaccgcaaccttcccatcccgggttcaagtgattctcgtgcctcagcctcccaagtagctgagattacagccatgcaccaccatgcctggctaatttttatattttttagtaaaaacagtttcaccatgttggccaggctggtctcaaactcctggcctcgagtgatccgcctgcctccgactcccaaagtactggaattacagacatgagccaccgcacctggcctgtcttttttttgtttttttttgttttttttgttttaagcaaagtctccctctgtagcccaggctggagtgtagtggcaccatctcggctcactgcaacctccacctcctgggttcaagctattctcctgcctcagcctcccaagtagctgggattacaggcatgtaccattgcacctggctaattttttgtatttttagtagagacaggatttcaccatgttggccaggctggttttgagctcccaacctcaggtaatccgcccgcgtcggcctcctaaagtgttaggattacaggcatgagccaccgagcccggctgtctttgttcttaacagaatggtgagaacaagggcccttagacatttgtgacttgtcacttgtggagtgtctgggggacacaggaggcagatcttgctagttgggaccaaggaaaagcctcatagacctcagcagcaggtcagggacttggcctccatagctaatatgaaaggtaagcagtagatatcacaggagtcactggaaatagcctgagttagcctggacaacatagtgagaccctgtctctacaaaaaaaacatttttttttaattagctgagtgtggtggcatgcgcctgtggtctcagctactttggaggctgaggtgggaggatcacttgagcttggaaggtcaaggctacagtgagctgagttcatgccattgcactacaacctgggcaacagagtgagaccttgtctcaaaaaacaaaagaaagaaggaaagggaaagggaaatgcaaggaagaaagaaagaaagaaacgaaagaaaatagcctgagtttgaaaggcccggagacacccaggtgggctgtgagaggggccagcagctttgacacagcaggctgtgcccacagaggaagcagacagctctgagggatgcagcacacagcaggccgccccgaatgaccgcagctgcaggtgataaaatggctgtccagtgggagacagggacgggccataactgctgctttgtgctgtatctcttgcttgttaacatgtttgggtgaattgactgcaacagatgggcctttcagccctcagcaccttggtttctaggcaagaccggggtgacttgcaccttggcgaccccctcccctccctgagcagcagagcaacctgcgcataaagaagcctgagaagattggagtgggacgaggcgcagtgccctgtgggggtggaaagagctctggactggcagtgcaaagccagggctaacatcccttcgttctcctgatcttgagcacatcctccccactctggtggccacagtttccttatctattgaatgagagggttcaattagtgtcatcttggaagtttctattgtctgtattgtgtgtccatgattgtgtctatcgagctacccttgatgaacaaaaaataaaagaagaaaagcccctttagcagttttctatcaaagtaattgtatgaaacatcaccaggaatctccgagaccaaatgcttctctcctgtccttgctgtgtaatatatttcctcttttgctgactgaagccaaattcaactaagcaagttgccctcgattgtcccccaccaccctattcccgccagaatatttctctagaaaagactggttaggtttagaactctgatgcccctttgggctcacctgttgccgtgtgtgtgtgtgtgtgtgtgtgtgtgtgtgtgtgtgtgtgtgtgcgcgcgcgcgcacacgcaaaaaatacacacgtttcagctggacgcattggctcatgcctgtaatcccagcactttgggaggccaaggcaggtggatcacttgaggccaggggtttgagaccagcctggccaccatggtgaaaccccatctctactaaaaatacaagaattaaccaggcatggtggcacatgctggcaatcccagctactcgggaggctgaggcaggagaatcgcctgaacctgggaggcagaggttgcagtgagccaggattgcaccacagcctgagcaacagaatgagactgtcaaaaaaacaaataaaaaacaaaaaacgtgtttctttggcaaacataaagccaaaacagttgtaaataaaattgtctggctaatttaactccctgtgggtggtttctgaaataccattccctcatagattttccatttagtctttcagtgcccaaggggagggactaatttctaagtctaataagcaaaggctattataaacaatttcatttttccttcatcagtgaggaagaaaagcttgttttttgttccctaggaggtgaaacagaagtgtggtttcattaaagagtcaggatgatgatgacgataatggtgattttactgttacttgcatttttattataccatacacattacagaacccttgcaacccattatctgatctgctgctcccctcagctccagctctgtagagtagagagagcaaaggttatcacctgtaaccctgaagaagcagccccaaggttaagtgactcacctaaggccacagagcagacttagcacgcggtctcctaactcccaggccagtgtgctttgcttctcctgccttatctttgagaaacttgttccctagagctagcaaccccatcactcccctttggagaagcaggcaaacctcatgtcttcggcagcattcaccgcctccaagagggtggtggcctgcctccacaggccaccgttcagtagcgcttctgagcatctagctgatgaacacagggtagaacctgatgtgcaagatgggtcttcatctcagggtcagggctgtttctcagagaaatagggaagggcagatgtgacaactcagagtggcacagaggctgccatctgtcaaggcaggatggggtagggcttgggagacacaggaggcacccagaatgcccacaagcaaggctctcttttcctgcccctgccccatctgggcacaccaggctaaggaactgcctggtcacatggaagacaagttttgtcaagccctcacttgtagacctgccctcccgcccccatcagttctcttcaaggctgcaaactgaccttggttttcccaaatggattgctggatcttttttgatgtgtatatacaaagaatttactgtgggaaaagggcttggtctgcttcaaagtgcaacttgagtgtttttccttctgttgtgtgcttatctatccatctcaggcaaggaaatgttcatgacatatattgctttgccttttggtggaggcaatttcttgtatattctttgtatcttaccataaatggtctgtgccctggacacccttcctggcagacgaaaatatgttgtctttttcagacgatataggctttggggcttcattttctaactttatcccgaaatgaaagtctaaaatgcaaatcttttagtgtctggattagccctttgtctcaggccagatccttttctctctctaggtgacccagctgctgttaaaaaaatatactggtttttcccccatttttaatagtcattataatactctataaatacccagttatccacgatcataggaagggagtctggtttttgaaagtcacaattaatttgaatagcctgcttttgtcgttaaattcagcctcttccccttcaaaatcttttattggtatttctaacacatgggaaaattgagttatttgatagttttgcctcttttgtcccaaagtgaaccaatattcagtaaatcatctaagagttggtatggtgaaaagttgcagtgagtgtttggcctgcttacaccatggggaagttctgctgggttttgagagtctagtggcacaacagcattggaaactcagacagccgtgcactgctcaggccagaaggcccatgaggtgtgccccagcccagccagccttccactcctctcctggagatgccaggcagatctgcccagtggcaggcaaagcagggaagaccctgcagtccacctccttctgactcattggccagtttctccgaatgcagttgtcatagccataatctttttttttttttttgagacagagtctcactctgtcgcccaggctggagtgcagtggcgcgatttcggctcactgcaacctccgccgcccgggttcacgccattctcctgcctcagcctcccgagtagctgggattataggcgcctgccaccacgtctggctaatttttatatttttaatatagatggggtgtcaccatgctggacaggctggtctcaaactcccgacctcaggtgatctgcccaccttggcctcccaaaatgttggaattacaggcgtgagccaccgcgcccagccaccataatcttattgttaggcatagcagaatacaatattacatttaccgttgaacttcacctaaagagattagtccaagctggagtagcaaaaaaggtaatgagtttaaaattagcctccaaggttgtagaaccaccagctctcccatgcattacagctgggagtgtaaagggatacaactactttggaagtctgtttggcagtgttcgctaaagctaaacatacctggaccttgttacccagcagttgcactcctgggtgtattcccaacagaaatgagtgcttgtgttcactgaaagatacaggtaagcatattcatagcagctccattcattatagccaaaaactggaaagaattccaatgtccatcagtagtagaatggataaataaatgtagcatagtcacatatcggaacactacacagccgtagaaagttatgaactagccgggtacggtggctcacacctgtaatcccagcactttgggagggtgaggcaggtggatcacttgagctcagaagttcaagagcagcctgggcaacatggtgaaaccccatctctaccaaaaaaaaaaaaaaaaaaattagctggatgtggtggcacctgcctgtagtcccagctacttgggaggctgaggtgagagaagtgcttgagcctgggaggcagaggctgcagtaaggcgagatcatgtcactgcactctagcctgggctacagagtgagactccacctaaaaaaaaaaagttgtgaactactgctttacgcagctgggatgactctcagacctgatattgagcaaaagaagccagacacagaatatatactatgtgagtccatttatataaagttcaaaaaaatatatgtcagaatagcattttatttccagagtgggtagggtggagggatggatattgattggaaagaggcatgagagagttttctaggggtgctgtaaatgttctgtgttttggccagacatggtggctcacggcagtcatcccagcactttgggaggctgaggcaggcggatcatctgtggtgaggagtttgagaccagcctggccaaatggtgaaaccctgtctccactaaaaatgcaaaaattagccaggcatggtggcaagcgcctgtaatcccagccacttgggagccggaggcaggagaatcgcttgaacctgggaggtggagtttgcagcgagccaagatcacactactgcactccaacctgggcaacagagcgagactctgtctcaaaaaaaaaaaaaaagttctttattttgatctgagggatggttgtggaggtgtatttggaagtacacatctagtgagctgtatggttaaggttaatgcactataccatatgtaagttagacccactcagtgggcagttggaggtggaaggcttaaggattcttgtcagtctatactagcatattggcacatgcttgcctctggcctgtcttgtggaacagtgcaactacaagctgcacggcagactaccagacactgctgcctgatttcccagtgggagacctttttccttttcctttcccgtttctttttcctttccctttcctattaaaacttttgttagaggttcaggtggtacatgtgcaggttttttacatggatatactgcagggcactgaggtttggggtacgattgatcctgtcgcccaggttgtatgcatagtacccaataggtagtttttcagcccttgtcccctgtagtagttgccagtatctgttgtgatattctctatatgaacaagtcatggggggaaatcagcagtcatttctctgctggcttctggggagcagttctagagcagggcaagaatgaagatgcagaggaatgttcaggaagcctgcctgcctgcgcacattccctgcttaacacaggtcttaactcttccaggctctctggtcagctctcttgacagtcaggctatggaaatgattaatgatctttctcaaagcctggaaaaagcagcaagggtccctggcagggccacaccctgggtcctgggccctcacccctgcccagtgggcaggaaggcagccatatgagtctgtctggggtccctgcccctgtttgcttctggacttccctggaaccggcccattctctgcaatggggaggaagtggctttcccttcaacactcttaccatctctcatctttgtctccaaagccagaagaggccatctcttctgccctcacccctatccccagctacatcttggttgtctgagtggcaggaaggaaaacaaagtaccagggagcagcttttgtttggccacatctgcactggaagctcctgatcacagctgtggcctgctagtgccagcgcccagcggcattcccaccaacaagggttaaagccccaggagtcccgccagcttcactgggtccatggccctcataaaagccttttacatccgtccctcaggctgcaggctccctggctgaaatctgataaggggcctctttgttgcaactgtcagtctcctttattgaggagggaactggagaccagtggcacttcttggggtgcagataaggccctggattcctgtcagagagagcatgattaattaccctcaatcccagctcctgctttgatagcagtgactgacagtccacaggcttccccatcaggtgctcacccccttctgggaggcatgatgggggtggagatttggtctcctgtagggccaacaccagtgacccacaaagatctctcttcagtgggtgtttgcctccttcctggtgctctgtgggttgcttttgcatttcttgtggacagaggcctctctctctcaggtgaagagcttccttagaggaagatagaatacagcccagagagcaggccagagaccccttgctccctcccgcaaagactgggaaaggagccattgcttgtggacgtgaacttcacaaatctggccttaagccaggggcccttcacagagaaaatctcaaactatctgtatcaaggccacttgacaatattactctctaattcaggcaagttcctaaaaccatgtgattctccctttggtaataatcacaactgtcaatttttgtttatcgatttatatcttgctggtttgaaggtacatcagcagaatttttgttttaattttttattcatagactttagaactgaaaatcatctagtccaaattcctcacttcacatttgcggaaactgaggcctgagtctgtcgattgcctattggttcttgttcagcaggtaaacttagcttaaaggccttctctctttcttcatagtagaatctactttggacaagagaaatggctaccaggtccattaagcacaaagcaaactgctgagaccaacctgcagattctgcttctctcagttgttagaagaatcaaagacgcggcaggcttttgtgtctggattatctgatgggagaaagcgccactgtcatctagagagccctcggcatagcctccgctctgtttctgatggcaccaagggccagcctgcactgggagccactgacagtttcacagagggccagccacagggaataatgcgcccaatctccttatcagcttgatctccagaaccagggtgcctgatcagggcatgggggctcgtgtgaggagagttcactgtggagtgaggaaaacagcttcccaagtatgccctgggtggagctgggccacacagcagggtgcaggggccaccaccacggtttccagtgcacctcttacctgcggtttctctgtagtgtgatgacagttcccagaagagtacactttcccctctgggaagagatcacttattagttaggttacaaccttgacttcagacaccactgtgacccttccttgtctcctcaggttctgtatctgccattgttcccctggccctaagcagttctcagtctaatataatacagtcacgttgtgtgtgactataaagaggctaatttttaatgaaatttctacatctataacaatgttgtccttcaaagatgccatctcaaacagccaggcaattagtccaatgactactcaaaatgaatttgtaattcctctctggggagttgccttcagaggcagtttgaaccacactagaaaatctcagccgggtgcgtggctcacgcctgtcatcccaacactttgggaggctgaagtgggaggattgcttgagtccaggagtttgagaccagcctgggcaacatagtgagacctcgagaaacatttctgggtaggttaatttattaacactataaggcatggtaggcatggtaaaggaaagacaacccctgccttcatagagctgacagtcctcctgggatatcggatggacagatgtgaaacaattagagaaggacaatttgctaaacttataggggcatgatagaaattctgagagggaagaaacccacatgaactggggtagtgagaacatgcttcctggaaggagtggatatggaagaacactgtgaaggatttgaggggaggcacaaaagagcgtgttttgggggcaatagggagaaggcccagtgagttggagtacaagagagttgcttggatatgccaggaatacttcacatgtgatcttctaagggagtgttgaggaacatgggtcatgcgattggacatgtgagatgggctaggtaagcaataagagttttcataggtttttaaacaaggaggtgagtaatatggtaaaagtagtattttaataagattggctgcagtgttcaagttgatcgtatggctaagaggctgctgcaggcatctaactgtgggccagagagggcctggaccaggatggtggctgcaggccaaaaaggaagatgcctttgagaggtacctccaaggacgaatcatgaagccttctaacaccctgaaagtgggtgatagggagaggagaggagccagtgctgacacgaggttcctgccttcctgcctaacttccaagggtggtagtgttgctgggaaaaaatgaggtgtggggaaagggagctagtttaggggaatgaagatgagcccagcacaaacattctgacttggaagtaaacgggtcacacgtgtgaagatgccctaggagcttccggaaatgtgagcttaggagccctgtgtgaggggacctggggagtggtcctctcagacactccaggtaatgccttggaaggtgtggactcaaggccatgggtgtgtttgggcagataggcctccaaaaggaggtcgacgttagccctgtcctgctgggggcttttgtctttctggtagggggaaggtttactgtccagaacagcactgggagaagtcaaccagcacatgagctgtgtgtcttaggagtatgcccgtaatcctctgttattttacctatgaatttgtggatctaattccatgacccctttgtccttgaccctccaaggaccagcaggtcaagataaaggtcttcaaggtcactaaccccctccccacacttaggaaagaggcctaagccaggtgctgtggctcacgctgcagtccatgtgctttgggaggctgaggcaggaggattgcttgagcttaggagtttgagaccagcctgggcaacataggaagatcctgtctctacagaaaatgtttttaaattccctgagtgtggtggtgtgtgcctgtattcccagctacttaagaggctgagtgggaggatggctggaggttaagtctgcaataagtcatgattgcaccgctgcactccagtctgggcaacagagtgagaccctatcttttaaaaaaaaaaaaaaagaagaagaagaggcctggtcctgccgcagcagccccacatatccatgcccacagtgcttccttttcattctctggcttgaaccatcctgtaaaagagttggtgaggctgccattcagagctgagaaaactgctgtgcctttagggaaagaaggcggatggagcagaaacaaacagctcttccctgctcaggttggtttaaggtccaccaggcagcccagtgagacctcagcgagactggggcaatgggagggggcaaggcagaggagcagtagtctgtgtacagtaaaaggagtttgccatcaaaaggcaacaagtctcataccctgccctggacggtgacccttccctgtggaattctcccctctgacctccagatcattaatcccgaggctgccaaatgacagtcatccatcacgcctcctgatgagcatcccagccggctgtgaaaggacttgccccgccctcaccatatcccctggtgctcattagtagcccttcctcctcggtgccaggtttcctaatcaagtccctggctcctctcacttcccctcggggccattgggtggaagctgctctgaccctccccctttcagaggccagggagtgggtggagtgattggtgtggggagagaattgagtggcttttcattcctctggagacctgtgtgtccagcagctcctttgacatggcggggcacacgagagagaaataaaccatttctccatcaagcaggagaggagaaagcaggcatgtgcaaacaagcacactcttttttttttttttttttttttttttttaagacagtctcactgtcgcccaggctggagtgcagtggtgtgatctcggctcactgcaagctccgcctcccgggttcatgccattctcctgtctcagccttccgagtagctgggactacaggcgcctgccaccatgccaggctaattttttttgtatttttagtagagacggggtttcgccatgttagccaggatggtctcgatctcctgacctcgtgatctgcccgcttcggcctcccaaagtgctaggattacaggcgtgagccaccgcacccagccagcgagcacactcttataagcagcactgagcgctgccaggagggtgactaggcagggctccccttctaggaagtcagagaaaggcatcccagaggaagctgccgctgaatggagtctgaaagctgcagagataagtcgccagatcactaggaatagtctggaatcatactgccagcaaaacaaaaacaaaaacacacacacacgaactaaaaaacaagcacctttgaaatcatctagtctggccctcttatttacagacggcaaaacagaaccagagaggctaagtgctttgccaaaggcccacacagcctgtgcgttggacctgtcctgacagctagtctgagtgttcaggcttggggagtttgagttaaattacacttccaggttgatgagcattgtttccagctcggctaaaggtgggcatacacggaatctttcttctcagcctgatgatgatcccgctgtctctttctctcgttggacaaccacagggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtgagtggccagggcctgggagaaggaagctgaggctggagaaaggggatgttgtaacctagaggagaggaaggaaggaaattcctttgtatggttagcaagatgagtggattcccgaaacagtggggagctttctgagatgaatccctcactaaaccaagtagtgatgagaaccaccatttaccaagtgtctactctgtgctggtactttactatttcatttaaacctcacagtcaaccctgtaaagtaggtatgcccccatttcccacattacaaaaatgaagtctccatggttaaataatttggctaaggtcatataccagccagtaagtggtagagctgagattcagacctgggcttctgtctctaagacctgtgccccttccaggacattgtcttccaaacagcatctccaccccaagtggcccctcttacctgatattcagcttacccagcggcagaggacccagagaaaggcaggcaggaaggcccccttggattggtgacctggttttgtcagcatttgagttaattacatgggtgatggaagcggtgaaaccaatagtagcactgaagaatgagggccagagaggaatcttttcttctggaacactctggaagttgttctgtgaagagtatgcaatgaacaactgacatcagttaggtagcatgttgtagctacaaccagaatggcaaggttcttgggtagagaactgcttcttgggacctaagacacaaagaatgacagtgtctaggtcccatgcacaatgggaagaattgctcctatctgactagcccagctctgaatggttataagatcaagaagtcagaaagcccttgtaaaacatgggcctaatttttcccagggcttcaaaacaaatgtgaaaacgccaactaagatgttatttatttcccctaatgaatggtgcttcaaagtagagcctatttaggattgagtggcagtcagaggaggctggggcagagtgtccggccatcccagacttttctgccaagtataccaaggttgcaatcctttgccctagagtcctgcccaacagagactgcttccagagacccaccaacctcaactgggtggtctctggtgctgttttggattattctccctgcttgcttcctttcctccaggtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtcagcagggctcctgggggagaaggaagaaagggaggaagggatgccagttccctgtgttcaagactggggttttggggcaagagggtcaattgtggattggtccagctccagttcctttgcaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcaggggtgagccaggctcagggccgggccttcccttcctggaaaccccaagcccattcacgcctcctgggactggtggggcaggggtggtgaggcacatactcctgacctggaagaggcccctccaggttctgccttccaggcccctagaagagaggcactgagatcttagttcaccaagctgaggttgtttggtagaggggaccacatgttgcctcaggcagtgccctgttctctagtaagagggaaaagcagttattcacagaggaggagccagaggccttcagagagctgctgcgtttccccaccagccattaccccagcacctcactggatgtaggcaagagcagggcaccgtctgcaggtctgggaggaagacaccccatgttcctgaggctcagcgaggggccaagttgccccgggctggacagtgggactcaggaatatagacagaaggaggaaacacaagtttggcagcataattgacatcctttcccttcctcttcacattgttctggtgccccacattctcttcctcaagccacacgccccttttcccattcacacacattctttcccattctggtcctgatgctatctcaaagcaaacatgaatgagatgtgtgggaaggagccaggtgtgaagggagctatacatattcccaggctgcccctcctaccccattgcccttggggaccagaaggaaactgggaggtaacagctcatccagggccaggtaccctgctcctgcacaaagcaaagggctgttagaaaagacagctcaccgggaagaattctgagtctggggtgagccagccaaaggccgtgtgtgccagcacttgcaggcttccacaaacgccagctgcctgggtggtcatggaggggaggggctgagggcgtagactcctctctctgagggactcagagtcaaaggaaagaaagggcaggtgggtcctcaaagttggggctgggtctcattgatctctgatttcctgggcctggtgtatagtgtagttcagggtttgcccgtcacttggaaagtgccagtgcagagtggtggggccggagccggcctccttgcctactgtgattccttttctctgggagcagaggtagttgaggggatgaactgggtcagtggaaaaagccagcaacaggagattggcgagcctgggatctcctgccataccctacactcaggagaaggttacatagatgccttttaacagcgtgaggctttgaccaggggtggccaggcagcatcagagaggacaacaggagtgctgtggaaggcttgaccaggcccactgtctccctgtccccagcagaagacagagcagaggcctcggctgcagcactgaacctgaccacgagtagcattgggagcattaacatgtctgtggacatcgatggcaccacctatgcaggtgaggccctggagctctgggggaggcccacgtggccgcagctagccacagggcagctctgcggctggccctgcctcttaccctctgtctgaacacctcccacagtggcttcctttttcctggtctcagagttgcaaaggtcaagtggtcctctggactagtagactgtggattgttaacaggatgataggtccctcccactttggcagaaacccttcacctaacccttttagaccagtggttggctcgttaattgaagaagtcagtcagtgtcccacaatccccaggtcttctcatgcacagcctttctctgactgtaattcagctcttctcttccttttgcagactgagacacaggcaaaggaaccccagtataggagaatcagcttacattgttaagctccctgccccccagtcttttacagttatcttttcctaaacctaatttggcaacagtgttttgttggttggttgatttcgcacctttacagagtctttctaagggtttaacttagtattcatgactgggcacggtggctgatgcctgtaatccttgcactttgggaggctgaggcaagaggaccacttgagcccaggagtttgagaccagcctgagcaacatagcaaaatcccaaatctacaaaatacaaaaaaaaatagccaggcatggtggtgcacacctgtggtcccagctacttgggaggctgaggccaggaggatcacttgagcccaggaggtcgaggctgcagtaagccgtgattgtaccactgcattccagcctgagtgacaaagcaagaccttgtctcaattaaaaaaaaaaaaaacaaaacttaatattcataaaaacagcagtccttttcccattcccatttcattggtttacggacgagcttgggaacaagcccacctgactcttgttaagcacagcattgctgggcgcggtggctcacgcctgtaatcccagcattttgggaggccaaggcgggtggatcacgaagtcaggatatcgagaccatcctggctaacacagtgaaaccccgtctctactaaaaatacaaaaagttagccaggcgtgggggcgggtgcctgtagtcccagctactcgggaggctgaggcaggagaatggcgtgaacctgggaggcagagcttgcagtgagctgagatcgcgccactgcactccagcctgggcgacagagtgagactccgtctcaaaaaaaaaaagcacagtattatgagtgggggccaccaggcctggcccagggcatcacccacctgttttaccaagggcccaagggcatgcggagtgtcagccagcctggcaaggtgtctcgtggagacaggcgaaagccctacaactgcaccttctatcacaactgggagtgtttcctcagggcctactcccattctaagggccacactccctcagagcaccgccctgcaggcctcctgggagcatgctctggatctctgctgggccactcacttcagagagaggacagagtgtagaggagcagtggtgccaagtgggctcaccagtcatgctatgtctgcagactctgctcagaggtctctacctgtcacaggaggcccctggaggaggtggggcctggtgccctttgcctcttcattgtgctgtggtttgggagggttgggggttggaattaggtccatggagaaagcagggaagtaggaattcaaggcctggatcttgatatccttttgtcctctgtcaaggagaaaggagaaggtaactccttccctctcagaatgaggaagggtcagaagttgaaggctcctcaaacccctgacaagaagggagccagtcacccaccccacctggctctgtcacccaggctggagtgcattggtgcggtcatagctcactgcagcttcaacctcctgggctcaagtgatcctcctgcctcagccccctgagtagctgggactacccatgcccagctaattttaaaaaaaatttttatagagacaaggctcttgctgtattgcccagtctggtctcaaactcctggccttgagctattctcctgcctcaccctcccaaagtgctgggattatagttgtgagccaccacacctggccttggtgttcctctttgtgtaccctgggtacaccttgtctcagagcatttatgacattttagcaaaattactctgtcgacctatctgtccccctccccagcccatcagcacttcaaggcaggacagcatttggatcttctcccatcaccccctagcacagtgtctacagcggagtcaggcacaggctaggccagcggtgaatacttactgaaaggagctggccctccccttcgctcttcctctgcccacacttgcttctcttccacccaccaaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaactgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacacaagcaggtctctctcagttgctttgagtggcctttccactggacagtactggggagaggtgagctccttcagagtgaaaggggactgagtgaactactcctgaccccttgatttctcctgaaccttctccccttcacccacgccttcttcaaagggaaagctcactgagctcactctcagctaaccttgtgtgttagcaggtttctctggcgttaccccagaagctcctagaaaagcctgcccggcagcaagccacaggccccgccacgccattggccaggattgagtcacgtgccctccccagagccaatgggagcgagggggcagggtgaccgggaatgaccttagactgcccgccctgcgcggagggagatccactacaggctgcgcctctgcccctgcgaggggcacccctgggtctctgggaaacggaatggagggtcttatggaagagaaggtttggaaccaccgctggagggaaggggagaagaaagcaagcaggagtggcgcgaacaggaagggactagggatagaagccgggcttggacacagtgaggcacgaaccccgacagacacagagacagacaaggggtgctgatctcctcactgggcggggtgggcaggaaaaggaacaggagctggagctagagcgagggctgcgagcggcgagtggatacccggcctcagggaggagcttccaggagggcaggggtctcctttggagcagcaccggggacgtttgctcggcaagggctttttgtgcgaagtaaccgaagccagtcaggctaatggcggcagagagaaggatttattcttgcacccagggtgtgcggaggagcccaagggcatttggacctgtgttgacgtccggaagggcccggaacccaggaagctctgcccgcagagggtattcctctccctctgaagaccacctcaaagctcaactttatcacctccacgcatgagaccgccggcggctgaactaaaatctcaccatcccaattccagtttctgggaattgtcacctccattcgctctcattagaaatccagcttttttcacgaggtgaataacagggcagttgacagttcccaagttttctgtgtccaatcttcagccctggagggactcttctgctccaagtccagcgatcccgggagggggcccactggtccagtacggctcagtacccagccctggatccaccagctgacgctggaaggagtgggtcatgaagaactcagcacgaacgcagctgggtacgaattcccagagatgtcctgtccctccacggtaccaaggacccctcctttaagaaactgcttcactgaaggcgcagatggagggagggatcggcaacagagttcagaggggttccgggggcacatggctcagccggaggaagcaggctgaggaggggcgttcagaatggccagatgacctcgaggggaatgccaagcctcagcccactttgcctgtggctcctgaggatgttcatgctgtcaagctcagaacagctgagaaactacctttctggggcagattaggggaccagggggcttagttgctggtttgctgtgtgacctatgacaaactctgggcagtttgtctgtgaaatggggactctagtgtgatcggagacacaagtgaatgagaactcactttgaaatgtctaaagcccagtgcctaaggccttccttggcaagacagagagtccctggtgggcactgtccgatggcattagggcagtaattgggccaaccaagcctacaggcccgcagcaccccctatggtgttgggcagtgcctgcctagctctactcttagccacagggtcccctgggaaagtgccaggtggtctcatccaccaagagccatattggcaacattgtgccaacatgggcatttcaggcctgtgtcagggaggggacaaggagtggtttctgccagggaggcctcagactgcagttgcctatgacaggctccaggcttcaggcctcatagaaaccctggccttgggggctgaaggccagccaaacgggcctcccctcttcccaagtccttgcccagccgcggttgcctaaggccttttttttttttttttttttttttttgagacagagtctcactctcacccaggctgaagtgcagtggtgcgatctcgactcactgcaacctccacctcctgggttcaagcgattctcctgcctcagcctcctgagtagttgggattacaggcatgtgccaccacgcccagctaattttgaattttttagtggaaacagagtttccccatgttaaccaggctgttcttgaactcctggcctcaagtgatccacctgcctcagcctcctaaagtgctgggattgcaggtgtgagccaccatgcccaactcactgaggcctctcaattcagcttttctatgccaggacccttcagctcactgggcgggggtgcagggcctgacctcaatctcttgtgctgcagagtgaggctgtgaatctgcctcctgctggctctgggcacagtctctacactgcctgggcactgcccctggcttccaacttttctcagatgcccttctttgggctccagggccatggctgggatctgggggcagatgagacagaggctgataccatgggggtcagagaggcagggcagggggtagcttccgctctgtccagggatggggaggccagctcaggaatccatttagaaccagtaaaagcctgagctggaagggcctttctagccttctgtttcccctctacaacctgcagatgggaaggccacgggacagaaaggaactgggcagaggtcactccccaccccatctagagggtccacatatgctaccttcaggggctgcaaggtggaggtggctggaggctcctgtcctggtgctggagcccttggtgctcagacctgcagcagctcccactccctgaggacacaattctcagcctgaccatcagaactcttagggtctcctagaccccatcggcggctctgaccctcttttatgaaagcacccaaagagcacctgaggcaaaggacagcatcccccaccctattgagctcctcattgcaggagctcaaagatgatgacctcagtcagaatgaaatggtatttaagcacaagccagtagctgttgccatcctggggaatgtgctgtattgtctgtcactggcagcattgcattacatcaaactattgcctgaatatcacaagaagtgcaaacaaagccttatggattgaacattgcataaaataggccttgtgtgtggcgcagtggctcacgcctgtaatcccagcactttgggaggcccaggtgggtggaccacctgaggtcaggagttcaagaccagcctggccaacaaggagaaaccccatctctattaaaaatacaaaattagccaggtatggtggcgcatgcctgtaatcccagctacttgggaggctgaggcaggagagtcgcttgaacccaggaggcagaggttgtggtgagccgagatcacgccattgcactccagcctgggcaacaagagcaaaactccatctcaaaaaaaaaaaaaaaaaaggctttgggactaaagcccgtatgcagccgcccctgggcacatatacgtggttttatgactttggtactgactcagcctaactggaccccagatacaggagaaactgagaaggacggagaacataagcactgtccccggtgcactgtgtcccatgtcatcctcacatcaatcctgtgtcataggtactgtccgtgtttccattttacagaggatagtgaggcttagtgaaggcaggacttgctcatgctcgccaagctggggagtggtggagagtgaagtgtaagacttctcggttctactgccattctccttccatccattgctccaggcccaggggcccagatggtctgattccctgtgccccacagcccaccctcctgctgctgctttccctggcttcccctcttcagagagaagaaggcagaccaggagataggtcaggcctcaggccgctgctcagccccacccatcctaacccctgaggggatgagagggcagcctccacaacgtgtccctaaatgcccctgcccccctgccccctgccccaggttctcagagaagaggaagagctgtgggggctgaggagcatctctgggagggagggtggggtttctccccaaagagcccctcagatgcaggcacccctcaccccgcagtcactgcttctctaccagctccttttcagctgctgctgcagcctcagtttctcagggaggctctccaccagcttagaggtgggcggggggaagcagtgaacacgttccaggctgagccctcccagtgggcagcaagggcttgggaggaacttgagtgacggagtgtggggaaggaaaggtcaaggcctgcatgggcaccatgcggcaggcagcagggatcgggcatgggggagcctgtgggagccatgcaggccagtcggaagcacagtgcaggggggcagctgctgagcacctggtcctgggcagcctccagggcccactgctcagctctcagctctgagtctcaagcttccagcacattgcagaccttctcgagctcagtctgcatctcagccagctctgaacccacctcctgcaaagaagtctgtgatggaggagggtggggctggcgcgtatcttgatctgcaggctccccaagaacttcgctcccccttggattcagagctccagcctcacaggggccttcctagggactgttcttcgccccaaagaggccaccatggcggcatcaggtgcagtgctgacggaacagcaccaggggagggggcaagagggctcaccttcccctccaagctgtgcaggtgactgaagtccagaacacttgccctgaacccctgatccttcactccctcttttaccctgagtcccgcagcgctccccatacgggtagtactgcctagcccaggagcccctgagggcaggcctcacatcgccctccatctccacatcctttccagggtccctgcacagtttgcctgcacagggctgggcccgcaaagcctcgctccccaacgcacttgtttcatcacttcaattggtgagtccaccctgccaaggagtgaggcctagtcccctctcagggccacgctgaggttgtacgaggacagggcagccggggttacgggcctgggatgagtctaggctgagtccttggtgctcaatggagaacccccatcccaattcattggttccaacaagccaggcttcctactccaacccctgccccccggcccaggccctgccttcacttcacatggtccctgtctcagctcctccagctcctggaaacaagggcccagtgtggtcccagagggcccagtccacatggcaatgggagaccagagccaagttctctgcctgggaggtcccacctccatccagcctgatctcagggagggcaaccagggctgccccacaccagctctcacccctggatggggctgtcccagctccaccccagtctgcccttgagctcacccattggcctctggtggagtccacactgcagactccagctccttggcagacctgggctcccacagctcctgggggatgggaggcagaaacgctgctggggtgtggcagggacagcaggaccctgtccccttgcccccaccccgttctgtgttctgtgcatcattagctccaccaaggccactgggtaactcaaatgtggcacaggcccagttctatacagctggggagaccgacgcagggacagtgacccagtgagtaaactgaacagggtcataggatcactgagtgtcagagctccccagagtccccccagcaccacacccaatgtacagatggaacctgagccccagagtagtgaggggcttggccaaggccactggccagtttgtggcagagctgggactgccacagtcccatcagtgtttgtggaacccgtcgctttactggccagtgaggattcccagcggccccacccacaggctgtggggctggaggtgtgtgggtgggtcttggctggtgcccactcaggtaaatgcctgtgtagtacccaggagaagccacagtgggctgggtggggcaggggtgaggtgggacccacctttcatttgcagactccgggggctggcctggggtctctgctgcggtctgccctgtgggcagaggggaggtggcaaggactcaggagcacttgggctgctccagggtggctgccctcccttcaggctggcaggattgtccagattcttatgtccctgtccttgggtgggcaggctcaggccaccttgacctgggggcacccgaccctcacccctagcagctggtgctgagggttctggtgccagtggtggccaaagtcctgcttctgtccacaggcacccagctcaagctggagggcaaggccctttctgttcacggacagatgggccatagtagccctggaggccccacacccctgggcctgagctccccggtactcagggccagggtggggagcttgggacccattaaacaatcaggaagctgaggccccatgagaagagctgtggctgtggcacagcccgggcctccactttattgcacaaggcccctgacttcaggcttggggagggctctagggtacttaggaggggttctttgggggccctgactgtaggtggggccacctcacaccaccccaggcagcccagctcctgcccaccttttgcctctggatcccagcagccatctggtcattctccctctccagagcctgcatcctgctcctgtggctgactggggaggggccagctgcatccccatctaggggccctgctcccccatcctctcatgcctgcagaaaccttcaccctggctcttgggtttgggcaggtccagcctgcagaggggagcggatctcctcctgggccctggcctgccctccctggctggcatgtggactaggggcctgggggctcactggatggtgcccgcccagactcacggcagctcctcctgcgtgcactctggcctgtgcagctgtgtaagggtcctgcggttacatgatgggaaaagcaagagggagcatctggggccctgaagtcccaagtcacacccaaaccaaaccacccagccaggaagatagcaggaagcaaattggaggcgttctgggttgaactgtatccccagcaacaacaacaaaaagatatattgacatccccagtacctcctaatgagacagaatcattacagaggtaatcagactaaaatgaagtcaataggctgggctttcatccaaggtgactatacaaaggggaaatgtggacacgggcacacacagagggagacaccacgcggacatcctggaggaatgtcaaagcctgctggcaaagcaccagaagctggggacaaggcctagaacagaccctccctcacaggcctcaggaggaaccaaccctgccgacaccctgacctgaacttcagccttcagaaccaagagacaatgaatgcctgccattgaagctaccgtcttcagcactttgttatcacagccctagcaaactcacagagggtaagtgggatccagccccatgtggcagctctctggccccaaaaggaccctgacttcgaggagaactttctcctcaaagtgaccacacctgcagcagcaggaactgtgcaatcatagtggctaatgcttcatgactgaatgccatgtgttttcacgtgcttgtcaaatgtcatcctcttaggcactcattcagggaggataactgttattttcacttttacagataaggcccagagaggcagaggaactgcccaaggtcacacagctagtatattgtggagccaagatttaaacccacaatcttagccactaatctggggacagtgcagactactgaatccttggatggaagacagactgaggtagacacccagagagggttgggtggaggagcttgaggctggggatgggactggaggtggagcatgccagaggccctgggagcgctgggtgctgagcccgtgaaccccctggccagccggacgttgatgcaatatggctttgtccagaccctatccagctgctgccccatctccaagagcctcgccctgctggaagtgcactgctagtctggttcatcagccactctgcacaggacccctgcccaggacccagggtctgcattttaggccatccttgctggataggcccagagcccagggtccccacctgcctgtagaaggtgagtcctgggttggccttctaggggtccagggagggagtaaaaatggcctggacagtctctgaggggctggaaggccctgcatgtggggcccaaagtggcactggcttatgcatcacgtgcaggttaagtgcatccggctcacctagcacctcttcctgctaggagacaaatctgccgagggcccagccctctgtcactccactaccttctcactgacattgcccactgcaagtcctcagacttgaccaaagaatatagcccatccaggcgctgaggatatatcttctgaccctcaagggtctggtttgagaaatagacaaaaacaaacaaacaaaaaaaaaaaacaacaaaacaaaaaactgagattttcctctgtacaaatatatagtggcagactacactgcagacttaaggaacagccccctatgagcacagttgtgtacccatttgagatacactgatttagaccaactcaacctttatgaggcccaaagccagctaagctttctctccttttccttccatcgagatcagcagatcagcttcagtcaggtgccttgtggcagagcgtggatcccacatggggtccttagaatactacttccctatggctcccaggcacctcgttggtgtctgtatctctctctgtgtctgtgtgtgtgcatatctgggggtgtctgcagatgtctgatgtgtatcctgggggtgtgtgtgtgcatgcatgtctgtgtgtctgtctgtccatgcacacatacacttgcccaggagactaagggatgctgaccaggagaaggcagccaccaagctggaggtgaagtcaggtggacaggagctgggacatctaaaccctagatctggcccctgtcccatgtccatagtaaccccctcacccactctccttctcaagtggatcaggggctatttacaacactcctcccctgtctctctgggtatatgtatgtgcagtttcctcttgctgaaatgcccttcatttcctctctcctcctggaaaatgcctgtctatccttgtgtgagggttcagaggctcagaaaccccttctctgggagggactctcctatctgccaccccttaaccagctcccactgtgcctcttccctcatctggcacattaaattattacttgcaaaataggcacagtggttcatgcctgtagtctcagaactttgggaggccaaggtgggagaactgcttgagggtcagaagttcaagaccaccctgggcaatgtagtgagacccccatctctacaaaaaaaaaaaaaaaaaaaaaaacttagccaggcatggtgatgcgtgcctgcagtcccagctacctgaggcaggaggatcgcttgagtccaggagtttgaagctgcagtgagttatgattgcaccactgcacctcagtctgggtgacagagaccctgatgcaatcaatcaatcgattataaatcaatcaataataaataaataattgcttactcaattaccgggtgcccccaaaccataagctgttgaggacaaggagtgatctgatttgacattgcttctgcacacagaagagggccaggcatgtagcagatgctcaataaatgcatgctgaaaacatggatggagaatgatggggcatgatgaggaagaggcagaaaatgggaaggaagtataggatcaagatgggggcatcctaaggaggggtaagagactaattggtttgtatgggaaagactgggcagtggggaagacaatggggagaacggggttgagggggtggagaagaaggtgggagacagtgcccacctggggaggccaggtcccactctgcctctggagtctctgcagttcctcctctttaaatttcagggcaactgccagccggtgccagcgtgccttccaatattcagccatctcctcatgaagcctgggatgtgattcttgtgcctctagctctttcctgaggggcactggtacctccaggacctggagtgtactggaagaaatggtgcagtccaggtacagcatggaccccagatcacccccaccccactccctttcagtgattattgtcttatgaactaggagggggagtggggcagagatgcctctttcatggctccctgcacacacagaacccctttgtactgggcacttctactcccaaggaccctgacttgcacccagcagctaaggtcatctcacccccacctcccacctgcccctgggccagcaggaggggcttggccatatgtaggcgagacaggacttcttgaagctgaaagatttcccaccccataaaagagccagaatgtgacaaccaggagcgctgatacctggggaagggagactggctctggtcgtgtgattccgggtttagggctctgggccattccccctcagccagctggtgacagagactggcccaccgcctgctgagagggccatctcacctacagtgagaacagagcccccaccccagcctggcttggacactctgaggatgggcccaagcagccacctaccaggactcttggcccggggccacacccagtgctgctagcagccccaccttctcctgaagtagccaggtgtgctctgcctccagggcctgcaatggccccccaacaccatctgctctccctgcagatgctgcagctgctccaagcaggcccctagttgctggtggctctggcccagctcttctgagtctcttgttcacctggggagatccccaccccaccgagttgtggctcagcctccaccagggttgtggagctccagcctttacccatgcagcccctcctcagaggccccgaactccacttcctctgggtctcagcccttccaggaggcctctctgaccaccccagcccgcagaggcttctctacactccaggctacgactctggaccagtgcctggctgcacactagcaggggggccagttatgtgaagatgaggatggtgctctctggagtgtcactgtgtggacgccctgctagaatctctctctcctggtcattctcctttcctctgtgcccctagagccccttgccctacattggaatcccccaggaatggggcccaggctcccttgcctctgccccctggtacagatgggcatggcctggatcagctaatgcccagattccctttcctgtggggctgcccctgccagctgtcttgaccaacctcagtgagtatcagcaactgctcctgcagacggactgtgtcctgagcctgggcaggggtctcagctgctggcatggagactctgggtcccgaagctcctgggccctgcctccatcccagctctgctcttggatctgcaggcctggcaccagcatctcctgtagatacacttggtccagaatcctggggtctccttccagcttccagaccacactggggtggtcttggcagaccgttgatgcctcagggcatgttgtggcagggtcctggccccaactcaagttatgactctgaacaagctctcctctgctctctggtctcagttttcccatctgaaccaggagggaagtcactgaatgatcccagggtattcccaaatgttggaagaggatccctctcttggctggactaagcccctgcgctgccttccttctctagataatgcttcaataatgaggaccagagaataaagtgtggggcagagtcaaaggtacagcagggccagtgcgcagggcctgccatgcacccacttgggggatccccaggctgggctctgggccaacaggctgttgggtcatttggtccaaatgccgctaggccttttccacttctgtctgcagcagcaggatcctgtgggtagaagggatggtctgcctgttccctgccaccccacccctcccccacagcccagccccactcacttgtcttctatgttctggtctggcctcctccactcagcctgtccctgggatccctgcatctggtgcctctcctgctccaggcaggccagggagcactccacctgctaggaggaggctgagtgggagggctgaaggcagcacagagcctcagataggtagggctagcttccctgcctcccaccaggcagggcagtgtctgcagcctttgataacgcaggcggactggcagccagcagcccagctgacagcccaacatggacccatgccctggcttatatacaagggactgtgccctggggccctgaggggctgcttttggctgttatctatcacgacaggctccagctgtgcatctctacctccagctgggcccgagatacaccgcctctccagctgctctccagctgctgacagcttcagggtggaggccagcaggactgctgtggcatgctaaagggcaggcagacatgaggttgtcaactgggtcccaagggtcccccaggcctggtagggagcagtggctccaggtgggccagctgtgagctaagacacagagtcactgaaggcttgcgtaactgggccatcacacggtgtccctttcctaccctcacatgaggcagagatcctggtaaccttcccaagaaccctcagcttgcacagccatctccccctctctggggctcgcctgtttcactcggggagattgggcttctaaggaagctcttcagtctatggagctaaaaccagcccctccctccctcagattctccctggggggccacagggaccctggcccttccttcacctccagcagtgtccctagccacccccagcatatgcctctcaggcaacaccctgcacccttccaggggcaccattcagagacatctctgttcaacaccgcagccttgctggggactccatttccctttctcctctgggtgccccagaccccggaaagcctccctgagaatatggcaccagatgtggacaccagctctgggcattctggagcttcagcctgctaaggggatcttgctagctcaggggacctcctttcagctacagaaagcccaggaagaaggaatgggggaggacagggcctcactttctgctttagggaccagccaagtcccagcttgtgctcccgcctctgcagcaccagggcttgctccgacagggcctccggcactgcccgaagacggcttgccagctcggccctctgctgcctgctttctgccagctgctcccacaggtccttctctgcccgcctccagtcccgctcgggggccctgttggagcacatgccagggaaagaggagccagacttcagcccaggccccagggggctgccatgcccaactttcctatgctcacctgcacccttcagtggggcttggtgggcagacacggtccaatgccccgaggaaataggagttccagagacagcgggcagggctgggcatcaagtccatgggctctgcctcagtgggacctgagaacaggacagatcctggagctggggtagtcttggcttcccaaagcaccaggctctgaggcctcttctcagactcagaattgaggccctttggctgagcacgcactaaaacccttcaaccctgatcctctggcccgaaagtctcctggtgattggaacttcactaaacaccagcctcaactccactaaacagttctcagttcccagtggtttccatgagctgtgggtgctgccaggggtggccacttgctgaacacaaaccccattatcctcacagcagctggtctggggaggcgcagcaggcactcctgaggggaaattggtgcccaagtccggcagggagtcccgtgaggagctgcaatccccacccaacactgtctgcaccagagccacgttcccccttccagtgtggaagtctggaaatggcaggggagcatttgggggccaccacagtttagctatgatgtgggggtcagagcccttaagtcaagtcactgctcaggtacctctctggcttccatagcttcagctgtaatatggaggccctgacggacctctcacccaccagcttggtgaggaaggtcagagggtagacaggggctattctgccagtgttgccatccctacacccctcaccatcaccctcctcacctctagggtctgggcccaagtccactgcctcccaactcccaaccctgggcacgaggcaccctgccctggctctgaaagggcacaggagttgtcttcacctaagcagtggttacacctagcacctctaccacccccaccctgacctccccactcctcacattcccaggccttctccactcaggatggcaccatcgcccaccaggccttctccccactggacagcttgactctcctctccccttactccaggcccaggctcctgcagccccctccaaaattgtctcccctccaaaatgtcactgccacacaaggcttctctaagacagaccatgaggactggccgctgcccccacctcccatactgggtacagctcccacaatgccactctacctgggtgctctgtcttgccagttagaagtgacaggctttccatggcagccccctgcccttagtgagaagctgagctgtgcccagcttggtccgggaggggctcatggtccacagaatggagtgcacatgcaggccagattgtcctgagcaggggggcaggccagggcagccccaggaaggctttccagggaggtgaccctggggccaaggctcagaggtgaattaactgcctccagagaaggcaaagtcagatgaggcagacagaggagacagtaaggacaatagaacaaggagggcatcagagcagctgggcctggcgggcagtgaactgagccctaagcttggtggaagtggaggtggggggcaaaagggagaccaaaaggggtgagaggagctgtggggtttgggaggatgcagggcagcggcacctccccagtgcccttgagatatgctacagacctcaactccacagaggctgaggacccagacaggagcttgggcctgaggggcagtggaggtggagcaagcctcctctgaggtggggatgggagtggaggagttacccaaacctcacctgggggcagatctttctccaagtttctgaaaggtgtgaaagtcacaaaagaatgaagctctaagggtagaatctcaggcaggatggcctccaggctgcaaagtgtggagagggagacagctgggagatggcttctgttccacctcagaaaaagagagttgcttcgtggctgggaggtagggactcctggattctcagtggtgggcagttttgtgggaaggtgactaacttaccccatcagagcctatagctcagggcagggctggggacagaagcttctctgagaacatccatcccggggacagaagcttctctgagaacatccatccctcagggctagtatcctggagccatggaaactcaggcaacactaagtggtgggaggaggagacaccagagaggcctcctactccacctcatctgagctgatgaaaccccgagatggaacctggctagtgtggtcgaggccatgggtaccaggcaggaatggcatctcagatggcctgggatttttcaaaatcttcagcttttgagataggaccttagggggcaggacctcagcagccaatctgggtcacccactgtacactgaagcggctcctaactttcttttttgagacggagttttgctctcttgcgcaggctgcagtgaagtggcgcgatctcggctcactgcaatctctgcctcccgggtttaagtgattctcccacctcagcctcccgagcatctgggactacaggcgcgtgccaccacgtctagctaatttttgtatttttagtagagacggggtttcgccatgttggccagactggtctcgaattcctgacctcaggtgatcatccacctcagcctcccaaagtactgggattagaggggtgaaccaccgcgcttggccgattttttgtttattttttgagacagggtctccttctgtcgaccaggctggagtgcagtggtgtgatcatagctcactgcaatctcaacctcctgggatcaagcgatcctcctgcctcagtcccctgcaaggagctggaactacaggcatgcgccacccagtccggctaatttttgtaattttttggaaggggacccagttttgaattagcttctgttgtttacttcggatagccatggtggagctggcagagatttaggggatactaaacacccctacaaatcacgccttgaaaccccccgtttcagggagagccgctggcgaaggacttgatgcgcagccgcagctcggaagcggggggctcccctgcgacacctccccgcttcaggggcgggcccagacccgcggggaggggcatgggcggggccgcggctggctggcggccgccggggcggtgctggggaaacccttggcgcccccgcggagcggtcccaaggagggggcggtgcctggagggatggtccgccccgactgcgggtttctagccctcgcgtggcgtggggacaattaggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacggtaagtgtgggctggggtccgcggcggcgacagcggcggcggcggccgggggtgagtcggcggggcaggcgcgctggtgccattcggtctcggcctactccctttctttctcctcttcggcccatatcgggccgcgacctctcacccctgacccgctgcttctgccccggagggcggtcactgcagaccctgacctcgaccccacggtgttgaaggcggagcctgaacggcctctggggccgctcaagggtccagtttgggctctgtgcctgcccgcggaatggggtcggggtccgacgtagaagagccagagaagcccttcagacccctcccctacccctggcttcaggcttagtccgcagatgactcctcccttggcggcctggagtttgattctggcccagtccggctttccctctgtccccgggtctcccctcggcgccactggtggcggttacaggggatgggactctgagaccccctgggacctggggcggcaggaagggacgcgaacgagggcgcaggctcccctgtgtgttttgttgtggtggtagagccactccagcccggaggatgggctaggccaagctgacagttcaaatcccctggctgctcctccgtcccgcccgggagtctctagctttagttccgggtgtgggtgccctgatgtggagctggggtggaaattgcctgaaccaggcccccatcagaggcggagttggcggccttccagcttcccttcttgatgcccttgaaaaggaggagcgtttcaccgttggtggtggaggcttgcgaggtggcaggtttgaggttgcagtggtagggcagtccagccaaaaataaccatgggtgctggggtggctggaatccgggagggcagccgctgacctggctggctgcacttctagtcagcccagttctctggccaggaacagcaaatgagaagccgacaaggcctgtgctcaaagttgacatccttggcttggttttcttcatatcacctttttcctcattgtgcagagcagagcttcccaaagcataattgtggcctttagctgctttttaaacaagctgtttgctgaggttttcgagaatcagagataattgagaaatgggccctagagccctggctgggaggatgatatctgctatttccaatattttacttgcctagaatgtgttaaaggaaggatactcttctctgttattgctttgtgtgtggtaccttataactctcatgcttgtcatctcttttgccaggctgagagatgttatctccattttccaggcatgctaaccaaggcctagagtgacttgtctaaggtcatgaggctggtatgtgacagcactaggatttagtttagttttctgccagagctcttgcctcccagtttccttggaagggacttataaaatgtctgtaaggcatttaacacagccctgaagtgttacctggaactttcagatgttcatgaaaagctgccactagtacctctgtgggcacaaagctgtgctaggcatttcacttataggagagagatatttaatcctcacagaaccttgtaagagattactattcccttgttgcaagatgaagctgacggtcagagtagtgtaataatttgttcaaaggcacacagctagaagtggcaagccatgattcagattgacatctatatgactctgaaattttgttttccattgatgtgaatatgtatggacataagaatcttctaggtcccaggaggtagtctttggcgtggtgtgactgtgactgtgtcctccagctctggtgtttgtctgcccagtgaggatgggcaggaccatacttgccttgtggcacgacatgtgccctggccaatagagcatcttctgggtcaattagtggggtgtgagttcctgctttcattccatagcttgggcacctgacccagagtaattgcaggaaaacagtgaaatattagtcagctgattaccaaaacaacaaatctaagcttttggggaggtgatttcacaaaatatttatctccaaagacttcccaggtacacgggggaagacaagttagtggggagatggagggctttcttagggacacggagaggctcccaggggtttggtcacataggcctcactgtcctgctcaagcatggggagctgttctatgctgcttttctcctgacagaccctgctggtgagatggggcagcctcagtgggtttgtacaaaatgtgcttggccaggcaagctcaggactgaccatgactggaggttggctgtggccaagtgtgagtgttgggaagaaggctggctccatggaggcagtcagggattgacgtatgggtggagcaggttgctggcctcacatggccagctttctccgctggtggcagatccagcctggcaatttcatttggtggatataagtcctcactgaacagggatagtgaggtggggctcttttacctgccagatggctaaccctctggctatcctgggataggcggagggtaggatactagagccagagagctagaagaagggacagtaacggtactgttggataaaggcaaggcacctggcagggcactgtgggggtctaaaagggtgctaaatgggcctctggaaagaaagttagatgcgctgggtccacgtccccttgggttgaccctcaggagggctatggaatgtttgtgaggcctgtgtgcctctttctccaagggctgctcttctagtctcttgtggctcctcatgctcacttgtggtccttactcccttgagtggggtccagttcagggccctagccagacagcgttcagcttctcaaacttgagggctttgagccctcgcctcctgtgtacagccctttgcctggcctttggctttacagagcattcacttcacgggaccgcccccccgggcgggagggaatagagtgcaggaggctcccctttctcctgcctttgatctccctgtggtagtgttcaccgtccccacccagggttactgcctcagcccctggccctggctcacccagttccctgagcacccaggccaccaggctagtgatgctctgctgggagctgtttgtttgttcactggcagagaaagttgtttcctattgtctgctgtttgaccagtgtgacctcagagttcttcttcacttcataaacctctgggaggggccgccttcaaacagaacaatgggcctcttcaggagcaaccgggaagccccagcagccccatggctggaggtggctggctgtgtgtttagcagggctctctgttcctcgtggcctagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaaggtgagagggaactagataggagggaaagactccttctgtcagctgggctcagctgtggcagctccagactccttgagatgactccatccctgcccagctgtccctggatccctgccctgtcctctttgggctcctccactaacctcacctgcatgccttggcctcagcagtagctaccatccttgccgcccactctttctctgtcttggagtgccttttcttctccccacacattcccccattttctaggccagcatctttccgcttaacctcctaagccttccttggtgaggattaggaacataacctcacccctggaaagtttgctccctgggcctatcttagctcccaggtcaaacttagagttgcagcaggccacagggaactctggaagggtatagaacccttggaggcactctaccatactccccttcccctgtacccctcctcctacagctggaggatgctgtcgttggacagggctctggagggcgggcttagtacctttgcaccctcccctctctgcccacttcccaccagtgtggatgcttttagcacaggctgtccccctttagccctttacagtggccttaccacaggtctcttgcttgctaacagcaaggacccagctgaccagcgtccccatcccccttttggcagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcggtgagtggtagccagagtgtgctggctggggcttaaaggcctcatctcttcctagccttctctcaggctggctggtccgggtgagtactgccagccctgtgcacgtgcactggtgtgcgtgcatgtgtgtgtgtatgtgttgtctggtccaggtgtagggctgatcacagggtcctggcctctgtgtcttctggctctttccagtggcaactgtaggaactctggctccgatgctggctggcccctggcctgtctatgtctacacagtgctccagacaaaggccacgtggtgcaagtggctggggacacttcttaggacacttcttagggatcctagtagagtggctggtatggtggtctgcagctatatggcctggtccttcccacccagagactgcctcctcgtgtaactgagtgctctgatgtggactgcacccacctctgcgtctcatctgcacaccccttcccaaaggcccccagtctggagtgcctcacaggaccggaggatttgcctgtcagccagctcagactgggaacttcccttctgatctccagccaggccctctccagccgagcctctttacgaggggcagtcgcggtgaggaggggcaggtgcctgtgtgatggggcatgtgaagaaatggcagaaaggctgccgccccaggcctcgtccagttgcaggccacatgcccagagcagggcctggccagtattcctagcatggagggttgtaaggtctctggagcccacattgcgctcagtcccctggggaagcaaagccagttgtgtatttccgaggttacgtgcggtcttctcttctcccccatccctcttccctgcctccctcctgccggccttgaggcccctgaggagcagtggagaggccaggtgtcttctctgcccagcgctttctgtgacttctttgagtggctacaggttgagggttgactgtgcgggcgattgcagcgtggccctttcacctctttgcacactgccacatgctgccacaggatggcagtgcaggtctggctctgtttctctgtttggtgccctctatcgatcgtcgtgaggcttgggatgggcctagattgtgagcagcatgggtgccaaggccagggcaggagctggcatggggcctgtgtgggccattgtggtaggaagcctggcagtcgactggcccagaggatcccaggctgctttccttcttgaggctggtggcaggagggctgctgacggaaggctgtttctggtagtgatggtgaaatctggccaaggatgccgtctggaggcaggtagcagcttggctgtgagtggcagctgtcaggcatgtgcaagtctgcgtgggcgaacagaggcaggcaaggacaggctgggcattctgcagctgaagccggagcagccgctgaccagtctggatggttggacccaggcggggccagctgccttcttgcgccgccgttctcactgcatcttccgctctggcccaaagccacatgggagggtctgggagggagagactcggaggaggaggaggagggagtcggggcgatggctctcctcacagcgtggccctcagcagcagaggcaggtcatcttcctgagcgtttgtggcgctcctcttaaagataatgtccgagttttctttacatacctgtagctgtttttacttttctgtttttgaagtcagtttgtgtcttgacgtgtcccttgcaatatccctatcgttatatatgctgtgtgccttatgaaatgctgggatctggaaaatccaaccaaccaacccaccggctcctcaccgtctccacctctgcctttgactgacacctcaatctgtcaatcggaaccgcctaccatgcgattggtcggatggcgtttcggggggcggtgcatgcagagaagccaacagagcagtaagcgcagcagccggagtgtggaagatgacaaggagggtcacctggtgtgccggatcggcgattggctccaagagcgatgtacagccacctttcgtaaaactttacctctctactttctaccccccttgttagacgagacctctcctgcctggaggggcctctagtgcgcgtggtgccttagcggggccaccagtaattgcctgaatgacacagacactagcaacttccatttttaagagtgtagcagtgagagagaaaccttttttgtttttgagaatttgaatgctgtgaacttgcaggagctgccaaccccctgccctccagattctcatgcccaatttcttttctctcctagatgagattgtggggaacctgggtgaaggcacctttggcaaggtggtggagtgcttggaccatgccaggtgagcgagctgcggcagtacagctggctccggatgtgatcttcctgggaagagctggcctgaggttcttgagggtggcagctatcagagcttaacttttttctttttgaagggtggcatcaaagtagggttccgacctgtccatgttggggttttgctgaccccctgtaataagggagaaattcttgggtcctgcagttatgtggcatccctacccaagaattgttggtcagtgaaaggttctgctccaatctcttcacttctccagggctgtggtggtggatatcagaacagggccaaggccccggctcccctgtggcttggagctgcttcctgtgataacttttaggttcttggcttagcaaggggctaggagtaccaataagcccagcccaagcataagtcccattccctgagggtctgcctgagaggctgtgcagatctcagtcgagagaaacatgaccctgggctttctcaccaagcaggctgctgccttcttcagtgtgactagggtagtgtgtggtctccgctgagtgtgcctgggagagtggggtatacctgtgtgtgtcatgctgcacctcactctctcccaagcccaacagtacaatagttttttccccttaccattccacaagactagaacatttgcttcctctcctataggtctgggttggggaggccacctccagggagccagttgccaccctgccataggctctctagttggtttggcacttcagctacaaagtgcttgtgtcctcattggagccacatgccacccatatgtggccctctcgctatttcagagatgaataaacatgctcagggtttgcctgcatcatactccagttaacagcagagctggccaccactgcgctgtagtgctcctacattaaatggggtgttcaggtcattcagacccaggcgtccagcctttcctgtggccacgagatagactgagaggaagtgtccatttgctccaagttcctatgtaaatgcctgtacgactcagcgtggcccaagaggttagggttgggaccagtgggtggagggacatgcacaaccacaccgtggccaggtggagacatggcagactcaacagccgggatgcatgtaggcattctgggctgctcctctctcaggagctggagggaaaatgagcctctggagtcactagggggcaggtggagggtccagggaaactttacgggactcaaagggagccagggccagtgggggttgtcatgcagaggcagaattcagctcagcgaaaggcagggtcttattctaagagcagtgcaactctgacaggggctgccttggaagtgatgagctccctgtgctgaggactggaatgccacggagggaccctgttttaggaggaggccggagtgcatggcctttcccctgaggtcccttcctgccctgagaatctgggaaaataggtagggagaaaaaagcaggggattctctagaaggtccctttatcctgggcctgtgagccttaggcaccacagtcagcctccctgaggcctcagaggacacgcccttccaggctaggactgtctcgttccccactgggcatctgaattctagctgtcctttcctgacagggcctggcagttgagcctcagcaggtttccttctctgctggctccctgcagatggcctcctggggtgaggttgggggtgggaggcacagagcagggactgttaaaaccttctttggacacttaagaagggttcctggcattttgtggtcactgataaacactgtggcaggtaggtgcggctggagaggggtgtggtaaagggagtggccctgggcctcacagtgagaggtacccttgctggtacccctacctcttgccagatctttactcgatcctggaacccccatccctgtttgctcagacttgcagacaagctcaggaaggtcaagaggcgccgcaggagggttctcggtgggacagcctggccagggttggggctgcctggcctataggttaggtcactgtgtgagctcttggactggcactggttaagcaggattggcctctactctcccacactcctttgggagctggcagtggctgagaacataaaagcctaaggatggcaaggatgctaagagcattaactcacagatctcagggagcttgctgttgggtgggcaaaggtctggtgttgcatggggcaggctgggcatccagtatctgctctcttcagtgccggctgctcctggagtggtgtttgttgggagttgctgggttggggtggagggttggggaaggactgggcagctgctgatgagaacctctgtttccttcccgggtaccagagggaagtctcaggttgccctgaagatcatccgcaacgtgggcaagtaccgggaggctgcccggctagaaatcaacgtgctcaaaaaaatcaaggagaaggacaaagaaaacaagttgtgagtatctgcaaggagtgggagggaagccttcagtggggctgctggacccccaggggcttagtagtgtgccttcacccatccgcactgtgccttctccccacactcagaaccaggggagtgtggcaaaggtcttgctggaagcctttagactgcagtccagtcttcaccccagctgtctctgtgtcctgaggaaggcctcccagccctgcgttttgtgaattggggagctcactgggttatgctgggcataaaacaagataaaaacatgaagttggggctctcacatagtaggagatacccaaaggagggcctttctgtggcagacacactgagcactctcctccacgcactgtgctgagcctgggcagatgggtgaatccagcacagaccctcacgaagctcagcagagtgagcaagtggagaaaagcagcaccagtcctgcggagtgcactagcactttccatctctccctcagcaactctgaggcagggctgcttccatatcataagtagggaagctcggagggcttggaccagaaccgtggacatctcccctaccccccgcaggaagcttagtccttgcccagagctcatctgggtattgggtgatggctggtggggagaggtgctcttgctctgatttctcttgcactgtgtgtatctgcattctggtgtgtgacccggtggcctaggagagagttgggaactgtcttcatctgagagagggggtgaggcaggcccccagcacacagcctgagccctgcccatcctcctcctccagcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatgtaagtgtccaccctcaaaagaagcatgggcagccacatgcctgcagccaagtcatctggttacttgttgtccccattcattccagcacgttactaaccattctcctgggcctgagggacaccagatcccctttggcggaaaggcctgtctttgggtgggaatctcagtgtgaggatggaaaggctagggctccctccagggacctcctggaccagcctctctacccccaggcactcaggaagaaaacagaaacgaactgctctggaattggcctaaccaccaaccctgcctccctgcttcatgcatgggataaaaaggtagaagcctgacctgacagatagcaccacaggtcctgcccacatggagaccctcggtctaaccctgacttgtcatctccctgccagcctggaaaagcattatttggcagtgccagggctcagcgcagtaggatttgcaatggttgcagcagtacagaaaggctccttggtgaagttggtaggcgttgagctagaatcgctcaaggtcaccccgcatcgctcccctaccctgagcactgctactgtgataggctgcaggccactggggtgggaagccccacatggatgagaagacaggtgtcttcctcctcccacaggatctgcaagatgggacagggacaaggattccaagcaaggggaacagcttggtgaggcctggagcctgttaacgggctgagaattggctccagtggagtagactgccactggggagtggtgggccacatagttgtgagggtcttgagtgccagatgggatccttgagctgaaaagtgactactagcaagaagccactgtcagaaggggctggaggggaaaggcttgcctgcttatgactagcaatgagaggcggggctgtcttcctgggtatgcgacctgtgcactcagtcgcacaggaccctgtgcttgatttaatgtccttttgccaccaccttaatattcttagtaacttgaacaggggacctgcattttcattttgcaaagggccctgcaaattatgtagctggtgcagggaagagggaaccacctcgaggctgttgctgtagctctgctgagagacaggtgaggaggcctggtctctgcagaggagaggtggagggaggtttttcgaatggcaaatttctttcctacccccctgctaaagtatcagaaccctccaaggcctcaagtacagagaacccttgagagggaggccagcacagaggcaggctgtagtccagctccctgctgaggtgggggtgtgaggacctctggcagttgctggcattggaagaggggtctggcctagagctggcaggagagccagcttctcagtgcctacttccccttctttccctgctaccttagttctgcatgagaatcagctgacccatacagacttgaaaccagagaacatcctgtttgtgaattctgagtttgaaaccctctacaatgagcacaaggtattggtgggggtaagggtgaggccctgtttcaggggtgggttacccgctggtgcagactcctgacctggcaggcctgccttgcctttcagagctgtgaggagaagtcagtgaagaacaccagcatccgagtggctgactttggcagtgccacatttgaccatgagcaccacaccaccattgtggccacccgtcactatcgcccgcctgaggtgatccttggtgagtgactgtatggcctgtgaccttgtcatactggactgttgttgggagggtatgagcagaggcagtggcatgcctgtcattctctgccacccagggcaggcagagtttctcagaccaaggggccagtgtcatgagacacaggtgactgacctggctttatctgtcagccttactgagagagggcctcgtactgggatttgggcaagagtcctgccagccggtgtggtggctgccttgtgacttccaggctggaagcataaggccggatctcacagcctctccccatcttggcttgcagagctgggctgggcacagccctgtgacgtctggagcattggctgcattctctttgagtactaccggggcttcacactcttccaggtacagccaccctgcattggtcccctaccctgagtactgctactgtgataggctgcaggccactggggtgggaagccccacatggatgagaagacaggtgtcttcctcctcccactaatcatcatgtgagattcagaccctttaaggatgtagatgctaaagggaaggcagaggtcagggtagctggaacactcagaggagtcttatgctaggccatcgaggatggaggatggggtaggaggtgacctgaccttctagataaggggcacagatgactaaaggcatcgggatgggctgggacagggcatgttctgggcagggagtgaagagctaaccagagagaaatgtagtcacagcccagtccacctccacccacaagggctgaggagcctaggcacaggctggcaggagaagctggggctgccgcttcattggtaggtttgcatgtcctggggcagtgagggcacttgcccatctttcttgttcctttttctccttgaaggggccagagctagtactgacccccttgcactgtccctaatcttccacagacccacgaaaaccgagagcacctggtgatgatggagaagatcctagggcccatcccatcacacatgatccaccgtaccaggtaaggaccccagtagccccctcagggttggtatagaggcctttctcttcttggctgtgggtcagcagggtactggatgtggtgagtctttgctggacagtccatggttccgcaggctcctaaaagccttccctgtgtgcccctgcagacctgttgccctggttctgctgctgtcttgggagctgctcttccccacctcccaccagaggcttgtccccttactactcccacacttgactccacccccttaattttcaggaagcagaaatatttctacaaagggggcctagtttgggatgagaacagctctgacggccggtatgtgaaggagaactgcaaacctctgaaggtcagtttctggctacccccagctgaactcatgccaaggagagaccccaggcactgggcagacatacagcagagacaggccaggccgctaaaggctgcctccttgatccagctctatgggaggcggcacccaagactgctgggtgctggcaatggggcttcttgcaaactgccccagaggggcccttagccctaccccttccccatagggtggctatgaatgtaattggggaacaccagaagagccagatgtcagaagccctgctgcttcctgtccctctctctcctcgaaattttgggaagaactaggcaggactgaggtgagggggagggaagacctagacatggccaggaagcctctgtcaactgcatttggtgctcggacaagtgaatttcgcagaggtgatctctacccacctgtcaggactttgcatgtgggggcagaggcatcaacccagcaagacacctagtagcctggcaagttccgagcaaaacgttaaacaggcatgaaaggaaaggagctgctcattgtccaggagggcggaagtagagtcctccaaggaggcatcactgcctcctcgatccagtccagcaaggcgtcccagaggcaaggggacctgctgtggcttcccacgaccctgccgtcacactgaggcaccttgtgtccctgagcagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttcagcttgtggagagctaagtgtgaactgggccaggcacagaagagctaggcaggggtaagaccagaattggggacatcctctgggcccaggctgctgagcagtcctagatggcacctctgccctgctggcttctgtacctctcagccccagagaacctaagggaatcagcccaccgtggctagccaggtggggtctggttttccacagcctgccagtcccattactggccaggactttaggctgtatgtgcccaacaactatggcctgctgagggcaggagacgagtggggcgggttcctaggctgggacagacagcacctcatgacagcctacagagcaagtcacacggcacaggactcagtcagtcattcagctttatttcagtgctggtttttggttccctaagagctgcatgagtgctaggcttcaccacgtgactgggggccccttgggaactgggtactatgggcaggatgcccctgaaaagaactgaagacagaggaatcatacttctctttaatacctctggggaaggcccaggctaaggatgagggcagggaccagtcccagtgccccctggggagagaagagggagaagcttgggcacaaactcccagtggccctgcaaggctatcatccctggatcttgctggagtggacagtcttctgggccagggttgttctagcttgtttctcactgtacctaatcagggggcctaactgcattaacaggcagccagaacctacctaccaaaaagcctgtaacctagactgctcctcagattttggccaagagagggccccggcttgggagctgcttggccctgagagtgagcagaggctcagagaatacacagcacaagggttacagtccctggcctcttcccatcgctggagacaatttaagactgaagggaagatgagaggaggggccagccctctaccctggctcatctgcttctggctatgttcctacaagggaagtgataacagcctgaaacccgtggtaccagggcctaccctatgtccacaatccttggtgagcccttctgtccacccatccacccgctcagccagcctgggcagacacagagcagaagcagcctgaagccctgaagcaggcttaaacacaagtccttgacaggaatccctgccaggattccaggcatagatcctgttctaccagcctccagggcctagagcttggcaccttaggatttgagcatcagtgtgttcctatggttggaacccacaccagctagctcatccagaactagcctcattttgccatctttgagacagggtgctggccccaagcctactcatctagactggacaaatgtaaaaggttcaaagcccagatgatgtaagagctggggtggagctcaagcacgggagcccatctgcctgctctgggatgacagctgcaaaggaccgtttcaggggaagggcagaggggatgaaagagtaggtggggcatgtatgtgcgggcaaagggctggaggagtggtggcctaggacagaagcaccaggaagcctcttctggttcagcaccaggctcccccagggatatccccatctgaggggtctggccccagactaggcaaaggctcaacctgctcagctttgagggtgggggcgggcactgctggcaagatgggcactgtggttctacagtaatataaccttatactacctgtgctgaagacgacagaacaacataaaatcccaatacagtaacaccatcctaatgccgcccccttccctacctctgagtgatggagggaaaaggagggagagatccttggaaaaatcagcataaaacttggatcagctcaggagtaagggtcaaaaccccccaaatcaacttgtggggctaggggaaggcctggtctgtcacagccctggacatgaatggagagtgcaggtctgccctctggtggacagctgccgtgcagctggttctacagaggaagggctgtctgcgtggggaaagcaggggagacacaaagccacaagctctgaaatagagcaggtacaggcccccagacaggacctggcccactcttcaatgtgtgtgcccaggcccagtggctgtaaacctgaaacacagtcttgagagctgcctacggctgtaaacaaaggcccacctggccgtgcagggggctgagggtagagatgcctggagttgctgcacgctcagcctgccacccagcccggaacccagtgggaaagacttccctggctaagagcaagtgacaggtcagttttaagtaagttctgttctctcacagaagaaacaaacccaaaagagaaaaaactttaacaaggtccatgaagcttcatatccttaaggcgtttgttatcaggagcagcaggggacagcagagtcctgcctgcgcaggaaccctctaagcagagtgcagtgggataacaaacttgcagccaaagggcgagtggtagttgatgcccacctcctggaagacctgctggggaatgccaatgtcgcacaaatagatacggcctgcgtgctcccccagtggcagaggcaggcccagtgccagtgaccatttggcatcaatgccctgttcgacttcatgcacaggagggtctatgctgagtactggtgcccggttctggttggcccaggccacagctgccttgtaccagggttgatcgcgcaggaagacgttctcagggcaatccaggcagttgatgaccaggtccacagggctagtgggcagatctgcaggtggaaagagtgccatctgaaagtccctatgagcagagagcagcccaggctgggactagggcccaggtcaccccaagggtgtctttgttttccagacaccactcgaatgcctctccaaaggctggccttcttaaagctgggccagggcacaggccctaggagttgcaagctggctgggctgagtgctagagaccaagtgcatgtcagcccagcagaccactgccctcctggagttctcaggatgaaccattgtcgtcctgagtgtgcagagcttctcagggcacaaagccctcacctcctctgccttctcaggcatgcctctgtatatccaactaatgccctgggcaccttatgacctctgggaaggcagagtccactgtcaaggtggccatcacagggaaaccccactcaggtccagcaaaaacaggagctgactgctatctgctgacccaagaagggtgagcaggtgagagcatgcttattctattccagctggcctactcattctactctagcaagcctgtcccctctcgtactcattatctcacaggaatgggtcctccactcagcccaaccttaattaagaattaagagggaacctattactattctcccaggctcctctgctctaaccaggcttctgggacagtattagaaaaggatgtctcaacaagtatgtagatcctgtactggcctaagaagttaaactgagaatagcataaatcagaccaaacttaatggtcgttgagacttgtgtcctggagcagctgggataggaaaacttttgggcagcaagaggaagaactgcctggaagggggcatcatgttaaaaattacaaggggaacccacaccaggcccccttcccagctctcagcctagagtattagcatttctcagctagagactcacaacttccttgcttagaatgtgccaccggggggagtccctgtgggtgatgaggctctcaagagtgagagtggcatcctatcttctgtgtgcccacaggagcctggcccgagacttagcaggtgaagtttctggtccaggctttgcccttgactcactatgtgacctctggtggagtcccttctctgggccatatttgctctctccaattcttctccctgctgttctcatttaaacccattccagtcagactctgtccctaccactccacttaagaccactcatcaagctcaccaggagcctccacagagatgctaaatccagtggtcgattctgtcttcctttgaccttaacctagaacggggcttgctgacacactgaccacatgctcctttcttcacttggctttcagctaccatactctcctggttttcttcctccctcactgaccattcctgtcccatctccttggttaggctctttactccctgacttctaaataaagagctcagttttccaacttctgtatctactctcttcctatgtgacagcatatccaggctcctcatggcttaaatattccctatggcttgtaactctaggctgaatcctttcacttcagattcatataactcgttccctatcaacatttccacctgcatatccaataggtgtctcaagctgagcttctgctgttcctccccaaaccttctctatcaagttttcccatctcagtgatcgcacctcagttactgaggccaaaaactttggagccattgccaactcttctctttctcccaccccccatacatccagtctgtggattctatctccaaaactgatttagaaactaactaccttcaccacctctggcactaccactcttgtcttagccaccataatctctctctcccatgatcacaacagcatcttgacacttctctgtactcctctgtgtagtctactctcaaacagcacccagaatgatcatctggaacctaaatttgattatatcatttctctacttattccttcaatgactgcccatctcaccagagtaaaagcccaaatccttgtggtcatccccaaggcccatcatgacctgaccctgaaatgtccaagtctcctactctccacccagtcctccaacatgcctcctttccctgctttgtttttatccacatcacttactacaactacacaagtatgttacatgtctttttgttcctcctaaccagaatataagctccacagaagaatggatttaaaaaaatctgttgccatatccctagcatcaggaagagtgcctgttcaacgaatatttgtggaatggaccaatgggtccccagctcttcatgtgagtagttggagagggagaagcataaggggatgggaagtagtatattactgttctaagactccttagaggcgaagcaccatccttacacacgtagtgcctttccacctgtcgccactgggtggcatgacgagaccatcaaactgctaaggagggaggaggccttcagcccagccctgcctaagtgctcacctttgaggctagacacttgttggccttgggtcttgctgaagagcgacagctcattggtgatagattccaacatcttgacaaaattgggcaggaaaaggatgacctggacatcatggttggctaggtgccttccacagctgataccctgagcccccttcacatgaggtccacacagtagagccactgtaggcctctggtgaacatttttgggattcaacctggaaaagaaggtgaagaagcagtatcagctacatacttgccaatcccttgcaccctataccagacaattgcctgtagcacctattggtctcagatctcttacccactgctcaccaagtcccaggctccagagggggacaaaatccactgcaggccaggtctatagggtggcactcctgttgtcccaaaccccaacctcacatcattgctgggtcctcccactaagtggttcacccagatcttgctccacacaacactgttgccacaacaccgctttgctgacccatgaacacttaatagttcctctgcagccttgtctgctcttcttccccaacgtgtctgcttcactccagcagggctggtctcatcctctcctgcacttgtaaggctctttcctgcttatgctcaaactacatcccctgcccagaaagcctttcactttccaaactctgaaccgccttttcttggagatccagttcaagacttacctctgctgggattactctggctcatgcctttacctctcctcaactcctaataagctcacagcaagtaccatagctctccattctcctcagtcagttgccaatggttctctttactgagcttagtagcttactgaagttaatgaaagcaatgctgcaggcattaacagtatctatttcataggatgctgtgcagattatcggatgcccagcacttagcagtgcctaacacaaagaaggtaaggtactcagtcagtgctgaccatggcggaggcagcaggccaagggttacctggcctcctaggctagcagctgccttggatgaagttgtcacttccagttttctgctattcaaagctgagactcctctagactcagagaagccacaaataaggagataaagaggattagccccagagctgtgcccaactcataggcagcacagttggctcacggggcagcaatgtagggaggagatggacggcaaggccataggtccctgcctagtggcagagcaatgatagtcacttaccggtttcccaaagggaggaagatgacaagatgttgtcaagctaagaggagcttcataactgcccccattcccaaacacattttggagaatttaacaatctactctatattccagacaccaaaccattcgccttcccatttctgcatttagaggaaatatgatgagaattgctcccttcagaggatgctgcagagttgtggaatctgactcactttgttctctaaaagggttcttcctctcagggagaacctctcccacccccaatcaaaagaagcagagcatggcattcacacacccagcggcaaggtgtagagtatatgggcactggaaatggacctatgtggattagaggcctggctggactgtgtaccagcagtatcatgtgggcaagtccctcagctctctgagccacagtgtgcttatccaaaaacacagggctattatttagctttgaggtgaagttatgaggaccacattaaattatgttgtgaaagcactgtggaacactgcatggcacctgacatacattaaacttcaagattactaaccacgggtctgatttctcaacatcagcaactgctacaaaggacaggagatggacctttggatagttcagacactaagagaaaagactggcacaaggacagccagccccaagaagctggctagagaggagtgtgatttggtaaggacattcagctcctgctccaaaactaatgtttctgggaagccacttaatggtctcaaagtgcccccaacagtggctctgggaggaggtgcaggagacaccagacacacgggcctgatgctctttcagagggcacctcacactaccccctcctgtaggcatttccctggctcttccctggcacaggagagcccaaggatctaacagctaggaagcaggcctaaatcaaagaaaaaggaaaaactaacactccaacccccaactcaaataggatgagggaggtggaaatcttacatctggcttggagtaagcctgcttgaattaagatcacttcagaatcaggagatgccttccatccaaacacattatcaggcccagagaatgaaaataggctggagtgaggagctacaggatttatctgcaatatcagttttctggcaagcactcccaaacaccatggctggaagcacaagccaaggaccaggttccattttgcaaatagggaaggggccctgtgggaagcaacatcctatcatgtgaggctttggatctgtgagtgctgctcagggaaaggaggctttccttgccccagtgaacccagatctgccctgctctttggaagtggcctccccactccagacaccactctcccacaaggttgcctacatcctcctctttaccgaaaaatccaacaggcacttgtcaactctaattttgattgatctctcagcactaccattgccggccgttccttttttcttcaaagactatttccttggttcttacacgctaccctcttggtttcttacctctcctgccttcttcttcatccttctaactgtgccttacatgccgacgttccccagaatcccaccctaggccctttctgttcacaccttctccttatatgatctcatctactcttacaccatctacaagctgacaactcctaaatctctagcatcagctaagacccttttctgaacttcagatcttttttttttttttttttttttttgagatggagtcttgctcttgttgcccaggctggagtgcagtggtgtgatctcagctcactgcaacctcctcctcccagattcaagcatttctcttgcctcagcctcctgagtagctgggactacaggcacctgccaccatgcctggctaatttttatatttttagtagagacagggtttcgccatgttggccaggctggttttgacctcctgacctcaagtgatctgcccgccttggcctcccgaagtatagggattacaggtgtgagtcactgcgcctggcctaagtttcagatccttatagctaagagactatttggatatctcacaggtattccaaactcaacacatccaaaacaaaacccaccatctctcccaaacctgctcttcttcccatgtttcctatcacagtgaatgtaaccaccatccaatcagatgtccaggctagaaaacttgaagttcactgatttctgacattatactttccattacctctaaaatccattcaattaccttgccctgctgaatttaccttaaaaacaacaacaacaacaacaacaacaacaacacccatctgtccacttctctttctaagagacaaaaaaaaaaaaaagagacagacaaagtctcactacgttgcccaggctggcctcgaactcctgggctcaagcagtcctcccactgcagcctctggagtaactgggattataggcatgcctcaccaaacctggtttgtccacttttctgatccctgcttccctagttgggccaccatcacttgggccctggctcagttttctaagttttgcagttttctacctgatctcactgccttcagtcttgcctccattgaattgactgtcctcattgtagctaaaaatcatctttttaaaacacaagactaactatgtcatagctctactgaaatgtcttcagcagctccctaccactcagctgtactgaggccctactttccagccacatagtgacttacggattgccaacaaccatgtgccatggtctctcgattctctctgcccttggcacatgctactccctgtacttagaataccttcttcttggccaggtgcaatggctcacacctgtaatcccagcactttgggaggcagaggcacgcagattacctgaggccaagagtttgggaccagcctggacaacatggcgaaaccctgtctctaccagaaacacaaaaaattagctgtgcatggtggcacatgcctgcagtctcagctacttcatgaggctgaggtgggagaattgctcaagctcaggaggtggaagttgcagtgagctgagattgtgccactgtgctccagcctgggtgacagagtgagaacctgtctcaaaaaaaaaaaaaaaaagaatgccttcttctttcttgcttgcccctgttaatcaccacttgttcgtcagggctcagcttggatgccactgctccagaagggtgactggtttctccagcctggggcaataatatggcttactggagaattttgtttcctctactacagcactatactttctagagacctcattgggctactagaggaaaggcacagtattttattcttcgtgtccccggtgtctagcagaaggtctggcacctggtatcagtctgtctacaaataaaataaggcactgcccttgatatatgagcataaggggcaggtgggaaggtgccaaactccagctcccctactcagttgtcagtgtggttctggaagctctcaggtatggagactgatttgcatcccagccacgtaaagtaaatgatgagtgccaaaggccaggtctccgaaggttcctagaaggaaggcttctgatagttagcaggagtctcaggcccgatggctgctatcaggagagagtcaaaaggcagcttgccagaagaataatgaggacatctaggagatgggtctgaggaggggcaaagaaacctcacagcatccaggaaagtgacttcagagagacactcccatcagatgagcagaaactgcctaatgaactcgtatgtgtgtatgggaggcactgtggtggtggccaggcagagcatccttactccacattgagtccctgccagtttatagacatttacctgttaggtcctccgaggagggtcagtgccatctgactggcacacacacctgtcatctccagtctccgctcaagggtcagcccatgcttctcagccacggacaacagctttttatgcagctcataggaaatacttgggacaaccaggccagagtctgcagttcaaaaggagaagagaaagggaaagtgactacagaaaccaagtccaaaccgggtatactctatccaagattctgcaaatgccaacattttaccatggatcacccctggcccatcctcttcatcttccgggactaaggcacgctctgcagctctgcagagctcaagtagtgactggtgaaccaagtaacaacttgttccaggtcaccacagagtggggacaaacttaagctcccttagcaatttagctttagaccacaaaggccaaatctaccaggatatatttagtgctatcgagaccagcacacagcctgtaacagcaacctatcaggcacatgagaagagaacatgattttcccaaagtgggggaaatgccatcttgggcagcggggcttcctcacaagcaggccccttgtccttcctgagaagtggaacagacactagctaaccctaatggccctctggtccctgctgttctcctcaactgtagggcaggaggacttgttccatctgcttccctcttcctcttccttctctcttctatttaccccttcctttttgattaagaaacttagctagcaaagttgttttctcaaataatttatcattttctccccatctgagttgggtgtaacccagtactcacgaaacagggaagcagtacaagttaagtaagctatggctggctttaaaaaagggtaacttttataaaagttggggagaattagtcactgaaagtacactgtggaaaatacttggtttttcaaggctcaaagccaacatctacagcagctggtgtatgtgaagaagtctatagtattattatatgcaccagtgtcaacataccaggaaagaaacagcaaacccaaaaatttggatctgcaatggacagctcttaccttgacaaccaaggtattgctccctccaagaagccaatgccatcttacaaatgccaaagccactgggctaaccagcagaccctttcccaaagagccccacttggcttcaccggccagtggaccaaccaacgcagattccaatcagcaagccactgtgggactgcacgtcactcactttgtccagctagatcaggtacctttttagatcctgtgtcctcaattatactggactgtcaactgcctgaggtaaggaaattaatcttttacttcttcagccttcgccttctcaacttgttccagctacacttatcaacggagttgagttcttatcaggtcctcagacatataaatgatgcaaacctagtgccatttctggtctggcctaactctaaggtagaagagttagggaataaaagttaataaaagttttcagtacatttatctccttccattgttccagagccttgtctagaaaaatctgttttcttcactggtcctgtcgggagaaatctcttgaggttatctatcaggtccagtcctacctgcatattcctaaagccacagagaatgaggctatagcttcatgttttaacaacaggaaaccaagcacaaagactgaaactataggacccaggtctgtatcctctcagggaaggcagaataacaatgtcatgtaatgatgatgataaaaaaggtctaacgtatcaaataaacactaacactatcctgttggctaactgagcccctctacctgcccaagtcctattcctgggctggggagaggcaacaaacagtgccattaggagcactgagtctctcctcccacctctttctgaaatgtcagtcattggtatctcaggtgccagtgctggaggctgcagactgaccttgcatgtcaacagctgattaaaacagccatttttatggcctgcttcagacacgcacatattatcagaactaattaggctgaacaattttcaaaagtcctaagccacgaacaactcaaacctgtcagacaagtcatgcacctgactacttcaaacaccctctttacctgcagagtcacgcaaggcagagctttcactcgtctatgcatttcttcacctatttatcaggactctttctgttagatttgaaatgggtcagggcagtgagtcttgggcctgctactccacaaatcaagcattctttctaggtctggctcttgtgctacgtgtacaggcaggcagcccctcccctgccccctcattctgagggctctctgggagcaggcagaagcattttctgctagctgtgccctcacagtccttaagagtacaaaacttaatggtacaggagaggagacatcaccccccaccggctggctagatgctgctgctggaagctgtgagtctcttaccacctcctcactgatctttgttgggggaaggggcactgttggtgaatcagcatatttttgcagcctagagaaagacaaagccaagagcctttctgctcagagtctggcagttatggggtctagaactctactctgactgttcctctgaaaggaacgtacaaacaccacaaaatgttccttttaaacatttatacacgtaagtccaacaagttggactggcttatcagaaacagaccaagggaataaaataaattccaaaggaaaggaaccaagaacatagcgtgtaaattgcaaacaacaacactgccactgccaaagcctgaacatgggccaagtctaattatgtttgagttggaaggtagatctttattgttcgggaatcaaggcagtaaaatcagttggtagggtttctttgagcattaatatgtattttacagctgctggtgaaacaagaaagggagagataattataaccagatcgtgacaagcagagaacttcttaggatctgattgaccttagggtatcaaggaagacaacaagtacactcagtacaggccaggaaagaaaactcctccttgcacacctgatttccactgcatgaggctgaggctgtctcttcggaccatgggacgcagtggtccagcagtgcccgtgccggctgcagtctgccccttgtcaggtcatcactttggcactgctcattccagcacacagcatttcaggcctttccctcccttatggacacatatatgcgtccccactccccctgacacagacacccttcagtagtaccatgtccaaggttcctctctccttcagacctgcccagtctttctgttgtgtaacaaagatcccacaacaaagtgttatctcagatctaactcaatcctctcactgattggccctttaattggaaaggctgcatgtgtcccaagtcttatcaataaggagcacagctcatttacaggcatgggatttctccaggactatgacttctgattctcttctgtggcagtcaacaaaactgagtgctgatgtcacactggttcctttagggatataaatccactggtaaatttataccccctgaccagcaatgtacagagtccctggagatctacactaaagctaccacaaactggtagtaatgcaatttagtgtcaagtgttctctgaaggaaggatttgttataagaaacctaactacacattcacgatactctttattatgacccacaagacctgctgtgatctggcctgtctacctcactacctttacctggtacccaacatgtaccccagaccccttggccaccttctggttcctaaattctccaagttccttctggcctcaagagacagttcgcttcacatgctttctccatcccaacactttattctctcttctggggctctattctctcttccaatgctacccctacacagcgggctcctcatctgtcaggtgtcagcacgctgcttacttcccttcattgcattcaatacatctgactccactcttaagtggtagttgaacaatgagaacacatggacacagggaggggaacatcacacaccggggcctgtcagggtgtgggggagggatagcattaggagaaatacctaatgtagatgacgggttgttgggtgcagcaaaccaccatggcacgtgtgtatacctatgtaacaaacctgcacattctgcacatgtatctcagaacttaaagtgtacatatatatatatatatatataaataaatctgactccccacctcttcccttccccacttacaactagaccagccccatgtccacagtggacctcattccttcatactaaagctccactggaacaagctttgaactttaagaggcaaagaactgctcaacaaaaacctactaattatgaagggaaaaattatctttacgaggaagaaatctggtggtcaacaccttaccaagtggtcaaacagccccagtgatgggacaaggggatacaatgtactccctgatgtgacgtactccctgatgtgacgtactccctgatgtgacgccttgagaaagacacagccctaccaaaatcctagaaaacatgtttaacatgaatcagatcaaaaggaaacaaacaatacatcaaaactaagacattctgcaaatcaattggcctagattcttcactaatatcagtatcacaaaggacaacaaaagttgtaggaactgttctagtttaaaggaaacagaagagatatgacagctgaatgtaatgtgcaatggatgattaaaaatacagctataaaggatattactgggataattgggaagttttgcatacggagtatattagatagtatttttgtaataatttaaattttgctgagagcaatcttgtagtgtggttgtgtagagcaatatatatcacactgaatttatgtgctgtggaagtatttagggatgaaatctaatgatgagtacaactaaatctcaaatggttcagaaatatgtgtgtgtgctcgtatgtattttacataaaacaaatatgtcacaatgttaactggtgaatctaaatgaagggtatatggttgttcattatactattctagcaatttttctgtaagtttgaaatttttttcaataaaaaaagttgggggggggggggtgccaggcaggtggctcatgcccggccaaagagtaatcccagcactttgggaagccaagggtgggcagattacttgagctcaggagttcgagatcatcctgggcaacatggtgaaaccctatctctactaaaaatacaaaaaaaaaaaaaaaattagctgtgggtggcagcgcatatctgtggtaccagctactagggaggctgaggtcaggggagcccaggaggcagaggctgcagtgagctgagattgtgccactgcactctatctagcctgggcgatagagagagacctgtctcaaaaaagagttgggaaggaaaaagggaaacaaagttaagtgcttccaaatatgatttaaaaatgtttatagagtaacagtacatcaagcaagtcagtggtgaagtggggaacagccggggaaacagagaaaataaaacgagtagaaatacagagaccgttcccagtctttttgttgttgttgttgttttgttttttttttttttttttgagacagagttcagagtttcactcttgttatccaggctggagtgcaatggtatgatctcggctcactgcaacctccgcctcccgggttcaagtgattctcctgcctcagcctccccagtagctggaattacagacgtgcaccaccacgcccagctaatttttgtattattagtagagacaggatttcaccatattggccaggctgggcttgaactcctgaccccaggtgatccacccgcctcgacctcccaaagtgttgggattacgggcgtgagccactgtgtccggccccccagtcttataatctaactagaaacaaaaaaatacataggtgcaaacttcagaaaataacacaacagccttaaactgtgttatcctgagcacgagtgcaaagtatcaatttcaaatcaggagctacaggtaggagatgtcaggtctcaatttgaactatgccttgaaagacaggcaggactgtagtcacaatgaatagaagagggactccaggtaggagtggagaaccatgaacttctcagaggccagaatgcatgtgacatgtgcagatgaatatgtccctgcctgaagcccagagggtggtatgaaggctcagtgtagagcagtgggcagggccaaggtcagaaggttttaaaagctgagctgttttatgcaggataaagttgacaggggtagaaagtaagaacagaaagaccaaggagaattgatttcaagggacatagggaagctataggatagcataaggaactaaaaggtcatgaaaatttcaaatgaaattttgaaggaaggagagactctggggccagaatgaatactactgaggataaagaaaaatctgttgccaaggctgctacagaacacagtgtctgcatattaaattagaaaaaatgacctccctagtcctttccagacctttttttttttttttttttaagaaaggagtctcgttctgtcgcccaggctggagtgcagtggtgcgatctcggcttactgcaaactccacctcctgggttcaagtgattctcctgcctcagcctcctaagtagctggaactacaggcatgtgccaccacggatagctaatttttatatttttagtagagacagggtttcaacatgttggtcaggctggtctcaaactcctgacctcaagtgatccatctgcctcagcctgattgctaaatttcaagagaatggtatatacatagaaatcaaactcctttctcactctgtctaggcacttgtggctctggaatggcaagagggcacatattagcaaagcagtcacattagcagggaccagtgcatttctggaatgaccaatgggcagtttcataaaaactcaggtgtcaggctttaatgcactaggctccagatcctctagcccttggtttgagcttaaactcttggaaaacatgtaagaagcacaatggttcattactggggtaggagtccagccaagacacctatcttaacagtactgctctaaaacctcatgagatcaccaatgatcataaccaagcccttcaggcctatgacaaccatccacccgattatccaggcccaggaactctgaaggattccaaggtaaagaaagggactgatacattcttccacacctggcactgaaggatctgctagagcctgaggttccccaactcaaccaagtcactggcagggaagtctgcctgctggagacacaaatttagaaactaggctcattagctgtgttcagtgaaaagttgtgacacttcgcagaggagcacaggtttatccagtgcaggtgttctgtccagaacaccacccagaatttatttcctgatgtctcccagaataacatccttgtggcacctgatctaatccatacacataccgttggggaatgaagttggggagggggttatggggagacaaggcaggaccctgcatgggttgggtctatgggtgagaaggcaatgagatgctgaccagctccatggtggtagacacttgattctctcaatgggaagaattatctgcaagagtacaacagctgccaaaggagacctcactacctccaggtaaaattcttcagtggcacttctaaactccaagatttatttcttcctgaattccttttgaacacacatgcaaaaaaatcaaaacagatttcttgactacctatttttgaggagataaaaacactgctggtcttgaaagccttagattacttctagagggactcttggtgacaagaagcagaggaaggcagctacggctcagaggcaggaatggaatgccagctgtgaaagagacaactgctagcctggaattttctgaaagccaaacttgtcctaagagctagatacatccccaccaaggctcaaagacttagccggccagcgtgagaagagtagagtcacaaagccacaggaacaaatcatttgtggcttcaccagctgcctcccttcctagcagaaaccagaactgccttttccaaaagaaatgagtattggtaaaaggtgctggagctcagaccagagcacctcactcaagcttaactggatcctttttaaggaaataaataggaactctagttcgggtcatcctcacacacttcctgttccctaaatctcagcgcacagtgtggaagtggatcatccttcaggcaaagctgcagagatgcctgcaccaagagcaccctactgcctcccatctgggcttttacatacttgaggacagaagagggctgcacagtagaaaacaaatggtggaggttaaagaagtctacccagaaggaaaggctcatgaatagagaatttattacaacagagggaaggaagaattctagtcattttttttaaacgttgagataggatcttgctatgttgcccaggctggtcttgaattcctggcctcaagcaatcccccaacctgtgcctcccgagtagctgggaccacaggcacataccatcacaccctggctaattttttttttttttttttttttgagacagagtctcactctgtcgcccaggctggagtgcagtggcacaatctcagctcactgcaagctccgcctcccaggttcacgccattctcctgcctcagcctcccaagtagctgggactacaggcacctgccaccacgcccggctaattttttttttgttatttttagtagagacggggtttcaccgtgttagcaccctggctaattttttatttttatttttttgtagagatggggtctcattatgttgcttaggccaggctcaagcgagccagcctcctgcctcagcctcccaaagtggtgggattacaggtgtgagccactgcagccaactacacttctgttattagtatatttacatatttggttcagttatactcagaggcccctaaggtgatgaactatgacttacccagagtatttaaaacagtgtctggcacatagtaggtattctataaatgctgatgctttgaaataatcttactgaggtggcctttgcaaattcacatttgaagtcaaatatttactgaataataattacagattgggtattgtgctagctacttttccacataatctcatttaatccacagtattagcccactttatagataaggaaaccagcttagtagcctctctttggctatataacttttaactcctcattaaagctcttaataaccaataactcccacatctccctatccctcattgtagcaactcttgcctttgctttctctgggctcaggcacaaagcattgcaggagggaaaaaaagggggggggggtcacaaaaccatgtaggcttggcccactataaattcgtgcaatctcatgataacttgacttgctgccattcttcctgcctcacaggttcaatacctccaaatcctcctgttcactcaaccctgttttcaatcatcatagcctatcaaattgccctctgttgcttccctcatatctttgtgttcctttccattcaatggtctaaatccctagtatgtaaactacatcatgagcatgactggtcctgctctggtctcttctctcccctctcgttccacctggaatcctaccacaagaccagtcttcctaaaagagatttggatcatgtcattttcctatccaaaagccttcagttgttccctatgactacaggacaaggatagcactggcacacaaggccctctatgctctggtccaaagctatattttagttccttctactccccagcacaaactctctgccctggccaagccagctaatgaccagtctcccacacagccctttactcatactattcacctgcacctgcctagcctacccatgaatatcttcctctttctctctgcctggtgaaatcctgcccatgtttcaaggcttccatcatgaagccttccttgatgcagcctacaggacctctcctgcctctcaacacctagtgcacttaatgtccacactttcactggactctgggcatatatggaatctttccatctcctattacattttcataacttaaaggcaaggactatcttagagtcagttacacataataaacataataaacacagtgttttgactgacccaaactgtcttaaagtatttcctttagaataccatgagtgttaggccaggcgcggtggctcatgcctgtaatcccagcactttggaaggacaaggtgggcagatcacctgagatcaggaattcgagaccagcctggccaatatggtgaaaccccatctctactaaaaatacaaaaatttgccaggtgtggtggtgtgtgcctgtaatcccagctacatgggaggctaaggcaggagaatcacttgaactcagtaggtggaggttgcagtgagctgatactgcactactgcactccagcctgggtgccagagtaagactctgtctcaaaaaataataataaaatttaaaaaaaaattaaaaaaagaatcttatgagtgttgaataaagattcttctctgaagccttaccactttactaagcagtattctttggggagttctcaccactgaacacagagtgctcacacacatctagtgttttatatttaaacttaacacatgcacgtagaatcagtcttcaaagaatttcaaattacaagtctggatccagaaagaccctggccaatccagagtgtgatcactggacaccattatttagcagggcaggcccaagctagagaaatgtctgatgatccgtgactgcgggagacagaagccctgccaaagaacctgaaaggaatttccagagagaaaaaattggggttaaacaaagagctaaatttagttgcttcctgaatgtgttttcccaatcaatagacctaaaacaacactgttccccatcacaacacacacagctggcaaagagtactgccaagaggagtatgagcaattagtgaataatagcttatgtactgttggttgacaccacttagcatgaagtcaatatatagggcaccagcagcaagctgtcagaatcctaaatcccaagccatcaccaaatgggtaataaatatgttgttcttttgctaccatggggattagtacaaaagtacttggtattctaggacatgaatgccacaaggccagactgcgggagctctccaagttacttctgtaaactgctggtccattcctgagagactgcagtactaaagaaaagactacagagatgtccctcaacttacaatgagtgttatcccaataaacccatcataaattgaaaatatctaagttgaaaatgcatttaatacacctaacctaccaaacaaacatcatagttcagcctagcctaccttaaacctgctcagaacacttacactagcctacagttgggcaaaatcatctggcaaaacagtacactgtagaatactggttgtttactctcatgactgcacggctgactgctttgactcctgctgctgcccagcattagagaatatcatacctgcatatcgctagctcaggaaaagatctaaattaataatttcaactacagtttctactgactattgctttcacatcatcctagaatcaaaaaatgataagtctaaccattgtaagttggaggatcatctgtagtctatttgccattaaactgcccttctcttcttatatttttccttttttttttttttgagacagagtctcgctctgtcacccaggctggagtgcagtgctgcgatctccgctcactgcaagctccgcctcccaggttcacgccattctcccgcctcagcctcccaagtagctgggactacaggcgcccaccaccatgcccggctcatttttttgtatttttagtagagacggggtttcaccgtgttagccaggatggtctccatctcctgacctcgtgatccacacgcctcagccccccaaagtgctgggattacaggcatgagccactgcgcctggccttttcctcatttttattcacatttagaagagaaaaggagatgtgatgggtaaggtttttgtgttttttttttgagacagggtctgactctgtcacccaggctggagtacagtggcatgactttggctcattgcagccgcaacctcatgggctcagacgctcctacttcagcctcctgagtagctgggactacaggcacatgccaccgtgcccagctaatgttttctattgtttgtagagacagggtctcactttgttgcccaggctggtcttgaactcctgagttcaagcaatcctcccaccttggcctcccgaagtgctgggattacaggcatgagtcactgcacctggccaatggaaaaccctttaccagctgggcgtggtggctgacgcctgtaatcccagcactttgggaggccaaggcaggcagatcacttgaggccaggagtttgagaccagcctggccaacacggtgaaacctcgtctctactaaacatacaaaaattagccaggcatggtggcaggtgcctgtaatcccagctactcaggaggctgaggcaggagaatcgcttgaacctgggaggtagaggttgcggtgcgctgagagctgagatcacgccactgcactgcagcctggatgacaaaacaagactctgtctccaaaaaaaaaaaaaaaacctttacctctctgggcctcatgtcctcatctgtaaaatgaaaaaatcatactaggtgatcaactaacctaacactaacattttatgcttttagactgtttccctatatattctagtttgccttttttgatccaaacatttggatagcagatccaatggagaaagtgtccccagctctgcactgactgcccctcagtgaaaacctgcttgaggattgtgccttggaactcgaacacagagaaaacccccctgtagaagaagttgctcagtaagataactgcctgcttgctctatttccagcacagacgctgcttggcaaaagggcttcctttccactccttgtcactgttaagaacaaagagaaaaaccagatggcatgaagctgctgggcttctttccccctcattgtcatgaaccagtggagtgcaactggtcactacataccacaagacgccacacccaagtttctggctaaggaccagcacatgtggtttgtggtatgtttattgataggaaaataattttatatgacagaacttttcacttcagtcattaaaaacaaaagaagtgtgaagatcaagttggggagccagagtgtgtagcagaaaaaaatttctacctctgcttttgtccatgttagtaaatattttctcatgctctgttagttctgagaattctccctgattctcactgttattctcactcttagccacttgactccagggcagatcataatcttcccaagttaaaaaaatcctgcagtgtagggctgggcgcggtggctcacacctgtaatcccagcgctttgggaggccaaagcaggtggatcacgaggtcaggagttcaagaccagcctggccaacatagtgaaaccccatctctactaaaaatacaaaaaaattagccaggcatggtggtgtgtacctgtagtcccagctactcaggaggctgaggcaggagaatcgcttgaacccaggaggtggaggttggcagtgagcagagattgcgccattgcactccagcttgggcaacagagtgagacttcgtctcaaaaaaaaaaaaaaaaaatcctgcagtgtaaatagttccagggaaatcacacgctgcataaaccaacagcctcagcagcagcacttggactacagatatagagagctagcagcaggagcagcttcttttacaaagagggcagtaaaaaaggaagcagtcagaggtagatagttggctgatctggaggagtaccagacttaacagatgataactgcctttgaaaggcttaaaacctagcaatttaaattaaacccgattctgagctaggctgtttgcctttacacaggtgttaaaaatcgaaggacttcggcaagttacagtgtcactgtcactgccacttaaggaaaccaccttaataaacaggcatgcctaccagaatctgccagcaaaagactgacacagttcagcagcttgttttttttttagcagtctttcttagcctgacagttggcctatttttttttttcacatggaaagcacatgcaagctactatactcagcgaaaccaaatacaacagagtcctactattatctataaaaaaaaagccatgtctggctttcctccaaatgcaattagctgcgtccacagttctccttatagcagctaccagcattcaagatttatattccttatattccaaacttcaaaccaaaataaaaatattatactcaattccttctctacttactaaaatgattatgacttcccctttagctcttaggatcattcaataacaatggttttcaaaccatattccaagaggcccagttagtaatgtggtttgaggggaagggatgggacacggatgtgatgaattacctctctcacactgctttaatctgttttatatgccataggtttgaagaaaaggttctaatgctaaaaaaagaaacaataatcactgaggtaatagaactagattatcatctacaatgacctacataaggcactacactgttacatgaaattagccaactttcaatgtcctgggctaacaggagataagaacagcatagtaaagaaatgtaatttattaaaactctatttttagccaatgattccaatcatccatcttcaactgtttttttgcaacaacaaataattagtaaaacagagttgaagtctggtgaaatgtatgggcagtaatagagaagccaaagtgaaaatagatctgaatatttgaatctacatagcaggccctttgcctttagttgttactcacagcatactaaataagtggcaggccatatcctaccagatacaggatatacacagacatctacagaaattacccctccaccatggcagaatgctgttattggctgcaatccccaagagacaataataccgggccagccaccaagccacttaaattaattcctagtgtgagattctgactcagaagccaggtctttctgtttcaagcataatagaaaggcaacagcaaccagcaggatgtgggacctgatgcaactcacccgtgcagaactccttgctcacgttgtggggcactatgatccgtcgatagacaatgggctcggactccaagatgttctcatcatggcggtaccgagtgggcctttcatttgggatgccccgggaacgggtaccacttctcctttcataggtatcaatctcctcaaacacagctgccttgtcaaaaagagccaggttcccttcaaaatcaaaatctgtgtctgggatctcctcaatatcatccccgaagcactcgtcatctttattcttcatctggccattctttaaaccacttttcttgggagttgcctgatttgggtgcctgctactagatgaccctggagaaaaaatagggactaaagtcagtgtatccacagaaagcgctcagtgaacgtggaaaatacattagtcttttgtggagagtgttacaggaaccaatgtgaaaatggtaaaggtaactattgcaaactcatattaagtagcacaaacaacaaatctcatgtgcaataataggtttcaaacatcacccaatctgggcacagtggctcacgcctataatcccacattgggaggctgaggcaggaggatcgcttgtgcctaggagttcaaggctgcagtgagtgatgatcacgacactgcaccccagcctgggcaaagagcaagaatctgtctcaaaacacacacacacacacacacacacacacacacacaaacaacaacaaatattacccaagtaacttgttaatgaatatgaaataagcagtactcctggaaatcttaaccagttatccccttcataaggaaactggtaatgacaaaagtttttctgacaacttactattagcaaacaagaggaagagtaagaatatagcatggtggttttgacataatgacagaggcaggaggcagagaaattctagaggcgggtccctggcgaagccccacctttgaagctgaaaaggctgagactgtggcccaaagtgagaacttatatccctgttttcccactagaatgttgtcttttcttaaaccacccatggctctgcccccaccctatcctgtgcctataaagaccccagactcagtcagcagagatgagaaacagctggatgttggagactatggctggatgtcagagagaagtggcttgacttcagagggatagcttgactgtgtaactatggagaagaatttggctggagacagccagacttaaggggaaaattacctacccaccactgactgtccccttttcagctccccttcccacataaataaaaataaaatcacccacatttaccatcctttaattcattcatgtgacctcatttttcctggacactggacaaaagctcagaagccatgagtgcagatacaaaagactgtcacactgatcctttgccctcactggcagagggcagctgcaggcccactgagctgttaacacttaagccatctgtggatggcagagctaaaagagcaccataacacatcctctggggcttcaggagttgtagacaccccacctagatgctgccatatggcctgcacagagttcgctcctgctggtgcccagaagcgctcattctggctcctgcaccggctcacatgtgcactccctcccacaatgggtagaacacagtgggtctgagtgagtggagtttgatcccactggcactgaaacagacagccaggttccagtgcttgtgcactccagttcctgccttgttctctcgcacactcccttctgcaaggagttgagagcagtgcgtggagtaaacggggcacccctgtcatgagtcctgtgaataggtcagggaagggaaatatcctgcttcagtttgagtctgagtgtctggcagttgtttaagagagaaatacccccagagtaaaagaaggcctggtcttatagcctgaagcttgtaggaaaatactattcagctagtccttaaatctatgcttacccagcaagcaatcttctgatttttaatttggtcttaggctagatcccagcagcagggaatccctggtttgctcaaaaaattctacattctgagccaggtatacacctaccactacaaattgctattctgacttacaaacctttctttagacctttcggttaacgtgatctcttttctcagaattttatctcttgtgggtaagcagtttctgaaacaccaaataatgacagggtccatactgaactgatcctgtagaggccacactaatgcacatccacaacagagtagccagccacaccctgtctctgacaccttatttggctactacacatcagtcaacaactactctagcagccaaggcagaaggtctcacagaattctccaaaccacccacccccagagaatcaagctctggtctccatctgactaccctgaaaacgtgaatcaggtgactggtatgccagactgaacctctatcacagtctaaataaatggaatgtacttccttctgaaagactgggctcttcaattactgaaaacactcaagtcacggttagaatgatcccaagcaaagcccctcacatatactaaaccaactatgctgccctaactcttctcattgcaacctccttcaacccaaaggaccaagagtttggagagctaggatctagttctctcaccaaaatattatataatcttataccatcatctaacttctcagggtcttaacttcctgtatatagaatgctcactgtggttatctccagtagagtttctagcattaacaaattaatatcagcaagatcaattacaataattattctgaaaggtatacactatgcaaatacaatttatgcccaagtattcctaatgccttgtactggtgtggaaaaagtggtgatggcagtgaagatgcaatttacgtctctgaaaaaaaaaaaaaaaaaaaaaaaaaaaaaaccaaggccaggcgcgggggctcatgcctgtaatcccagcactttgggaggccgaggcaggcagatcatgaggtcaggagatcgagaccatcctggctaacacggtgaaaccttgtctctactaaaaatacaaaaaattagccaggcatggtggcatgcgcctgtagtcccagctactcaggaggctgaggcaggagaattgcttgaacccaggaggcggaggttgcagtgagctgagatgcaccactgcactccagcctgggtgacagagtgagactctgtccctaaaaaacaaaacaaaaacaaaacactaaggctgaccaaaattatgaaggtaaggcagagtggttgagacaccacagccagctagatgatgaaccactatgaagctagccacagtttgggttaagttctagttccaataatttgatgaagcactctgtgagagcacacttatgccatagctaggtgctaggatgataaaatacaaccaagacatgctgctcaacaaggagagagaagaaatatgttgggcacagtggctcaggcctgtaatcccagcactttgggaggccgaggtgggtgtatcacctgaggtcaggagttcaagaccagcctgatcaacatggtgaaatgccatctctactaaatacaaaaaattagccaggtgtggtggcgcatgcctgtaatcccagctacacgggaggctggggaaagaattgcttgaacccaggaaacggaggttacagtgagccaagattgtgccattccactccagcctgggcaacaagagcaaaacttcgactcaaaaaaataaataaataaaaaatagaaatatatatatatatatatatatataggcaaataatgaaaatatgatgtgattagagttagaaagaagtttatataaagtgccatagaaatatggatgagatgggctgggtacagtggctcatgcccaaatctcagcactttgggaggccaaggtgggcagatcacttgagcccaggagtttgagaccagcttgggcaacatagtgggacccctgtctttataaaaaaataaaaaaccacatgagaacacatcctggctaaaaaataaaataaaagagggctgggagcggtggctcatgcctgtaatcccagcactttgggaggctgaggtgggcggatcatgaggtcaggagatcgagaccatcctggccaacatggtgaaaccccgtctctactaaaaatacaaaaattagctgggcatggtggcgcgcacatgtagtcccagctacttggaaagctgaagcaggagaatcgcttgaacccaggaggcagagattgcagtgagccgagatcacgccactgcactccagcctggtgacagagcgagactctgtctcaaaagaaaaaaaaataaaataaaataaagagaaagaaatatggatgagactactcaggaggctgagatgggaggatcacttgagcccaggaggtcatggctgcagtgagccacagtccacaccacttgcactccggcctgagcaatatatatatgtatatgaccagcctgaccaacatggcaaaaccccgtctctactaaaaatacaaaaactagccaggcatggtggtgtgcacctgtaatcccagctacttgggaggctgaggtaggagaatcgctggaacccaggaggtggaggttgcagtgagctgagatcaagattgcgccactgcactccagccttggggacagagtgagactccgtctccaaaaatatatatatatatatatatgtgtgtgtgtgtgtgtgtatatgaaaatatatgcatatataatgatatttatatatatgaaaatatatacatatattttacatatgtgggtgaaaaagcagagctggatcaggaagacagaatgggtatgaaaatacaaggtcaggataacaccattagcaatatacacagacaagggaagaacaaaagaataaggattatcaacgtactgcctcaatattaaatcaaaacatcctattagaaataggtctcttgcccagtggtcactcttcagtgggtatgtgtttccccaggggtggacagaacgattcaccaggatgtaggaagaagatacggaatattctatttatttttattttaactaaaaacagtagaaattaaactttatgaattttaatgtattgatgaaaaccaggacccttatgaagttccatgccagccaattgctgcccatatttgagatatctgaggaaaatgtgacattccataacaagaagtctatccatgcaagtggttatacatcaattttttaaaattgcagtaaaatatacattacataaaatttaccattttaaccatttttaagtgtacagttcagtggcattaagtgcattcacactatacaaccatgccaatttttaactaaagcatacgaaaatgagtatgtggcttaaaaagatacttgtaaagaaactatatgttaaataacgataatactaatgtaatcataagtaaacaagaaaatggcagaacactttccctattcctcttacaggccttctttagctagaatgaggttgtcaaaaattaattaaatctatgaagatggtctcccaaattataaagtatcaagaaggtcattccaaacatgaatccacattaactattatgaattaacttcaccctaagtatatactctacatcaaaactctgcaaactatagctcatgggccaaatccaacccactgcctgtttctgtaaataaagttttattggcgcacagtcatggtctaggcaaagtgaaaagaacacagaggataatgtctagaaaatgtacacacggccaggggtggtgactcacacctgtaatcccaatactttgggaggccgaggtgggcagattacctgaggtcagaagttcgagaccagcactgggcgtggtggaatacacctgtaatcccagctactcaggaggctgaggcacgagaatcgcttgaacccgggaggtggagcttgcagtgagccaagatcgcgccactgcactccagcctgggcgacagggcgagactctgtctcaaaaaaaaaaaaagaaaaagaaaaagaaaaagaaaaaatgtacacacaatgcaaaaatgaaaaacaattcagtacagcacaatggtcaaataaataattcaaaggtaataggaaaggagtattcctttttaaaaataatgtttgttaacagatgttcataccaaatatgcagaaaattctaaatattcacataatattttgattttcttttagtaaaaaatttgcatccatcttataaagttttgtatcctgctttctcgcttaggagcatcctcgagtttcatgaaaaaattcttcaaatactgtatcttactttttatggccacataaatcatagatcataccatattgatatacagcacatggatcatacctactgattaacttttaagttatttctcatttttgctattacagactcggcccaaacacactatctttgactacccttgctaaaaaaatcactcccatctgaccacttacaacagtgtgcgttaccactgacctagcacttatgctacattacctactttgttctgtagttaatctgtgttcttgctctaacttcccaaggagtttataagccaacagagggcaggaatgatgtcattcatacctgtcacccaacactatgcccagttcagcgtaagtacacaaaactctgctgaattaagaaataaaaacagcaatatatatatatatatattttttttttaaaaagcaaacactagccaatcaaaagttagaagtctaaaaagaggttataaaaaaagggcaacttgagattaactacaagaaaaagcaataaaaatcatgccaactttgttacatgactgaaaaggccaggaagataaagttgttgacaataatataatataaaagagttacgaagcaagggcttcagtggaaaaacttcagtcatgtccaatatgaactgaaaatgaactatcctggaactattacaatgactgatgaaaataagcagttgatcagtgaaggagaagacagggttaaggaagcaaaatgggaaatcactcccattcagataaaacccaaagctcctgaaaccaggtgaccaagaataaagctcagaggaaacaggatacagacactgctaaagaggaacaggtagaggcacaaaaacagttataggagaaaacaggaaagaatctagaatccaaagacccaaatactctgaaggcaggtcagacttgccaaatgacactggtagaaggccagttatcctggaactaaagtttgaaaagcatgagctggcctggcgcagtggctcaacacctgtaatcccagcactgtgggaggccaaggcgggtggatcacctgagctcaggagttcgagaccaacctggccaacatggtgaaaccctgtctctgctaaaaatacaaaaattagccaggtgtggtggcaggcacctgtaatcccagctactccagaggctgaggcaggagaattcgcttgaagccaggaggtggaggttgcagtgagccgagatggcgccactgcactccagcctgggtgacagagcaagactccgtctcaaaaaataaataaataaataaaaaataaaatgtaaagaaaaagaaaaagaaaagcataagttgcttctctaaccactagcccagtatttgttagccctaagcagtgcgctaaccactgaacaccaatatgaatgttcaaaagcacaagctgagcatccctaatccaaacatccaaaatccaaaaatttctgagcgccaacgtgatgttcaaagaaaatgctgattggagcattttggatttctggattagggatgctcaactggtatgtattccagaaatactccaaaatcctttttaaaaaatccaaaatctgaaacacttctggtcccaagcgttttgcgttaagagatacgcaacttttatttgggaggagagagtgcagcatagaaagaaaacttttgttcagtttcaaaaaaaaaaaaaaaaaagctaataaatagtacccacttcatatcatgccacatgatgaggagctattgaaatgcaaagtagaaaagtaaagaaaacaaacatgactagctgtaaagttcgttcacagcatgttgacaaagtgccccactataaagactaacagggtccacagtgggagacgccttaattctgccttaatgatgctgggcactggtcatcattttctggctcaactgtaggactctacaaacataacttacaacaaaacccagagatgttgtatgaagaaggtttcaggtgttttcctgtactcctctaaatgcagagttgattcattcatttgagacatagacactaaggactagctatgttctaaacactgtcaggaaagcagagtgtgaaaaatatttcccaagaggaaatactgacatcacaggtcagtaagagaaagataagagaacataaaataaatgcaaggcaggctaatgtgctcagttgtctcttattcttccctttcctcatactttaatacaaatattaggaagtcctgagtgaacaagctgtctcagtacttggcttactcatcccaaagggcctggctctgcattaaactggcctttggccactgcgagagaaaagcacttcccttggaaaagacaaacagtcttcccagatttctttacctttcaattacaagggccatgcaagtactgcaggctggctgccttcctgtgccgtttttctgccaccctttggcacagaggccctttggccaggacaacttgtaacaaacccattgttgtgtaaccctcagtgccacttatttattggtttttgtcacacacacactgtaagtgggaactttgtcctgcacttatcacactaaagggtacctgaatgttaaactacaaatgttttactgccagattaaacaggcatcatgagaaggtgcctgagaatatatgggaccttcttctcaactctcaaattctaggccctgggttttcaagcctattagatatatgaagcacatccaaggaagtttaaaagtcaagaaaacctcagtagaaccatgaaaacctggcaaaattcacttcctgcctcaggtggtgggatgactgttaaaatgaacagaccgttaaagcccaaccatactgcaacaagataatatcgaccatctttccatttaaaaggttcaattccatccctcatttctctccacctccagtaacaaagagaaaaagggaaatcagcactaaacagaggcactgtcatgcctataggaccacctctctctaaatataaatgagttaaaggccagctatctactttgtttgttttgagatgcagtttcactcttgttgcccaagctggagtgcaatggcacgatctcggctcactgcagcctccacctcccgggttcaagcaattctccctgcctcagcctcccaagtagttgggattacaggcatgcaccaccaggcccagctaattttttgtatttttagtagagacagggtttcgtcatgttggccagtctggtctcgaactcctggcctcaggtgatctgcccacctcagtctcccaaagtgctgggattagagacatcagccatcatgcccagcctcagctatctactttcatgttctacaggcaaaagagccttaacttaactgttaaatttttattcaactgcatgttacaatgactattcaagctcatagactaagatttcagagagggatgcctttcatctgcccctcatggtcaccattttcagctgtgacatgggatttgataaatatgaattatacccatacacagagctgcaccctaaacaaggcttggtttccctctgctccctgggactgatgttatgtctatttgacaaacattctgaatggtcacagaaaaactattctttacatgattctttaaacccactcccacccgaaaagagattaaaatctgcttgtgctaaatcatcagtgttggattagctaactattataaaccaacaaattcctcaactccttattgcaatcctgaaagaacacttaaaagccagaactgaagacagattatatttctttctttcctttttttttttttttttgagacagagttttgctttgttgcccaggctggagggcagtggcacaatctcagctcactgcaacctccgactcccaggttcaggcaattcttgtgcctcagtctcctgagtagctggcattacaggcacccaccaccacacccagctgattttttgtatttgtgtacagacggggtttcaccatgttgcctaggctggtctcaaactcctgagctcaggcaacctgcccgtcccagcctccgaaagtgttaagattacaggcataagccaccacacccggccgacagattatatttctatagcttcatcaatctactagtctcaatatcaatgtacataaactggagaaaattctaaggcagacctttttacttacagggctcaatgagtggaaaaataattataactctaccttctatcagaaacctattctgagccacgtcttattgccattcccaggccacaaacattttccaaactaatctggattctacataagtttcttgaaaaatagtaacattttactgccctatgatctctttacctcatttatgtacagttaacaatctagaaaaaggaaactgacaaaacagcaaaagcagaataaccaaaacctggaagccaccaagatgtcctgcaataggtgaatgggtaaacaaattgatatatccacacaatggaacattatccgtcaattaaagaaatgacctatcaagtcacaaaacgacatgaatgaatcttaaatgcatcttgctaagtgaaagaagccagtctgaaaagggctacatactgtatgattttaattatgtgatattctggaaaaatgcaaaactgcagggatggtataataaaaagatcagtagttgccagggggaagtgggggaagttgaacaggtaaggcacaagagattgtttaggacaatgaaactattctgtttaatactgtaatgacagatacatgatgctatgtatttgtcaaaacccacagaattttacagcacaaagagtgagccttagtgtttgcaaatttttaaaaatcatttaggaggttagaagatcccaggatggaatgcagaatgtgataaaacaaattaattgtattatgaatatatgaaacaagtcaatgaaggaaatgggagacctaaataactctagaaatgaatggagtcagatgaaaggcaaaagaaacagtacgtaagcaccacattctgtttgatagtctcccacaggaatggcgatacaagttaataattctgataccactatacatgtatactggaattgaataattatgtaaagaatgaatgacaataggagacaggtttctcactgttggagtgagaagtaacagacaagcaaaaggagaaggctagaaggatccatgtggtaatggattaaagttggagacatcagtatgaactcatacttagtatagtacaatatacatagttacatatagaaatatttaaatatgtatatatatgctggttaaatatacacacatatattttcttttctgtgaactctgcagagaagtatacacattttcttgctgtcagctataagggtgacacccaggagcaatgagcatccctagtgaagaagaaagaaaggagaaggggggaggagggagggggagagggagggggtggagggaggaggagggaggaggaggaggaggagaagcagcagcagcagcagtagtagtagtagtagtggtagtagtaagcatctttcagtgtgagaaagtacctaagtactaaaaaaaaaaaaaaataaaatccacaatgattggagtatgtcaaagggacatgagatccaagtgaaagattggagactagccaaaactgaaataatttgagtaccaaaataaagtaatattgaattataagccaaagtataaaataaatacccatgagtacatgctgatataaataaatgactgaataaataaacaaatgggggagaagagaggaatctctggcataaaagaattccaagtaatgtctgaagatgctgtgtcctcaaggagaggggacataacttctcactccctgggtgtgggctgcacatagtgatttccttccaaagagtacatatgtaaaggggaagaaagagtcactttacagaggagaaactagatatatcctactttagccaggtgatcaaggtgaacatcaaaagttataaaccatggtgataatatatacacttgacacaaggtgatgaaaatggtactttacctctgttgtcttccacccccaaacatataaccccagtctaatcatgatttaaacatcaagtaccaactgagagacattctacaaaatacctgaccagtattcatcaaaatgtctaggtcatcaaaaacaaggaaggtctgagaaactgtaagagccaagcagagaaatgactaccaaatatgatgtgatatgctggacaggatcctgaaacaagggcatccgggtaaaaactaaggcaatctgaataaaatatggactttgtttaatgataatgcatcaacattggttcaataattataacaagtataccatacaaatgtaagacgttaataacggggaaaaatgtgtagaaaaaaataatatgaattgctaataagggtcatcttcaagtgcacggaagattataaactgcctatttgaacttctaacaaatcaacaatttctgctaaaagaaaaaagattttcagacagggcaacatagtgagaccttgtctctactaaaagtaaaaagactagccaggtatggtggcacacacctgtagtcccagctactcaggaggctgaggtgggaggatcatttgagcctgggagttcaaggctgtagtgagctgtgatcgtatcactgcattccaacctgagtgacaaagcaagaccctgtctcaaaaatgaatgaaagaaagaaagaaagaaagaaagaaagaaagaaaaaggttaaagtctaaatggaaagaatcattttctatccaagcattctacagtttttctaaggatacagaagtcacaactgaatttcagtctcatatttgcaaacatcgtcatttcagatagttgtttcatatgcaccaaaggaaactaccttgaaactgtatattacatacattaaaacatttttttaggccaggtgcagtggctcacgtctgtaatcccagcacttggggaggccgaggcaggcagatcaactgaggtcatgagttcgaaatcagcttgggcaacatggcattatcccatctctactaaaaatacaaaaattagccgggcgcagtggcttatgcctgtaatctcagcactttgggaggccgagagtttgagaccagcctgaccaacatggagccccgtttctactaaaaatacaaaattagccagacgtggtggcacatgcctgtaatcccagctactcgggaggctgaggcaggagaatcttttgaacccaggaggcggaagttgcggtgagccaagatcacgccattgcactccagcctgggcaataagagcgaaactctgtctcaaaaaaaaaaaaaaaaaaattagccgggcatggcagcaagtgcctgtagtaccagcttctagggaggctgaggcaggagaatcacctgaacatgggaggtggaggttgcagtgagccaagatcacaccactgcactccagcccgggcaacagagcaaggctccatctcaaaaaaaaaaaaaaattagttttaatttagttgtttattcacttgaatcaggcatctccaaaacttaaaatgttggcccctgacacaggtgtcacaccacaagctactaatagaattcacccagcacactaaaaccttactacattgccaccaggaccacagtgtgaggagcaacaatggtagcaagaagtatccggaattttatgtaataaactttctgagtggggtctagagagacctagctcactctaaattgtgccttttagaaggtattgccatagcatgactctagcttataattttaaatgagttaatgaatactcatttaaaatttcttttggttgttcattttgagacagtctcacactgtcacccaggctgaagtgcagtggcatgatcttggctaatcacaacctccgcctccctggctcaagccatccttccacctcagcctcctgagtagctgggaccacaggtgcacgctgccacgcccagctaattttttttttttttttttttttttttttgtagggatggggttttgccatgttgctcaggctggtctcgaactcctgggctcaagcgatccacctgccccagcctcctgaagtagtgagattacaggtgtgagccacttgcacccagcctctcacttaaaatttctaatacattctgctaccatctgtgagtacaaaaccatctaagtaaaataagaatagtttggcatttggaagtaattttttaaaacaacattcatattaatttaaggagcataacagattccagtgaatgttatgattcgctattgtaacattattctagtaaatatgttggagaagaacagttctagtgaattaactatggttttggaaggcagctatgctcaccatcataccaccaacacaactatggttttattttatattatttattttatttttgagacagagtctcgctctatcgcccaggctggagtggcacaatatcagctcactgcaacctctgcctcctgggttcaagggattctcctgcctcagcctccaaagtagctgggattacaggcatgcacctccacgtccggataatttttgtatttttagcagagacgaggtttcaacatgttggccaggctggcctcaaacgcctgacctcaggtgatctgcccgcctcagcctcccaaagtgctaggattacaggtgtgagccaccgtgcctggtcacaactatggttttataatcagcaaatggcatttaataatgtgttagtatcaaacaaaactgggcagcaacagagaccaatgcacattcttcttggtgtgtcagtaggaacaaatacagcaaattaaaaattgtctgctagaaaatcaaagatcacagagatgtttggatcagtcccctcctctcttctgaggatgagactcaaatcacaggaagaaaagttactcaagaatcctctggaacagcccaagtgcaggttcaactcaaacactactaccaacatcagtaacaggatttaagtttttttttttttctttttcagaaacagaatctcactattttgcccagactagccttgaactcctgggctcaaacaatcctcctgcctcaacctctcaagtagctgggactatagatgcgtgccaccacgcccagtagttcctggatttaaaacatcactgttagtaaactctgggcagacttttcctgaaggaagtggtaagagagggcaggaagctcacaggcatccctaacagcttatttcctttcccttaacatcttgaggaatgaggcctggaggaagagaaccatgttgtatttctgtgacgctcagccagcatccattttattggaataacaaaggatttgtttaaagagcagcagtgcttatggcttatagccctgaaacaccagattgagaagaaatatcaacttgaccctacttacaggagttgtgccgacgacggaaacttttggactgactcaaggattccatgtgcctgtcgacatagctctttgagcactgttgctgctgcggggaaacggcaacatcctggctcttcacatctgtcctcttagggatattctgaggggcactgctggaagaggctggcttcttgacaaacttgcctgtgccattctgattgatgcccacttggcagccagcaccagaggggcctaattctgtttgatgaaggtctccaaaatgttggttgtctccaggtcctggtatctccagaatttttaactccgtaatgtcacctgccctgaaatacacaaaaaagccaagtctcaaaattataatagtggtaagaatgatgaaactgagatcattagcaaacagctacccctttgcaggactgcattttattgagttatcagaggctaggaaagggggctgtgtgcttaaggacaggggtcagccaccaactatccaactgacacaatgctagcctttaaaaagaggctattggccgggcacggtggctcacgcctgtaatcccagcactttgggaggccgaggcgggcggatcacgaggtcaggagatcgagaccatcccggctaaaacggtgaaaccccgtctctactaaaaatacaaaaaaaaaaaaaattagccgggcatagtggcgggcacctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaagagaggctattgctaacaacaaaactgtattaatcttacattcccacaatgtttaatggcttttgttcattcattcactccctcgctcattcaacaggagtatataaaatacttactatgtggtaagccctgcactatgaactattttgatctggtatatagagatgaaaaccactacgtgcccacaggaactcagtctggtcagtggaaaagacaagtacatattcaatcaaaagtgttaaatggactgggcaccatggctcatgcctataatcccagcattttgggaggccgaggcaggcgaatcacttgaggccaggagttcgagaccagcctggtcaacatggcaaaaccctgtctcaactaaatagaaatgattagtcgggtgtggtggtacgcacctgcaatcctagctacccaggaggctgaggcatgagaatcgtttcaccctgggaggcaaaggttacagtgagcagagatcgcaccactgcactccagcctgggcaacaaagtgagactctgtctcaaaaaaaaaaaatttttttttttaagtgttaaatgttatgacagaggtgtgcataggagactagagagcctaaaagcaaaatatttaagtcagtctggtggagatgaatgcaatacttaagctaaatctggccagggcagggggaatgagtggctaagcaaagaacagcagggagaaaggcatctcaggtaggggctcagagactgaggaaatgtagaaaatatggcccacgtgaggaactgcaagtgttatggtgatactaaagggacggatgttgtggaaggccatcaggaagtaaggttgcagaggtaaccaaggaccacatcatgatcacaatggattttcctggtggctatagggaaggagaagaaaaaagaggcagtggtaccagttagaagaccaagcaagaaataagaggggatgaaccaagcaagcggtaatacaaagggagaagggatcaagagacatttcgaatccatacgattttggcaactaactgaacacgaggattaaagagaaagaagagtttattatgactcctaagtttctaacataggggaaaggtgttattagtcataaataatgggtatgcccttggaaaaacaaatctacaggaaaacataacgagattagctccgaaaatcttgcatttaagatatcttgtgggatgtccaatggaaatgaccagcagacaaggtgtctgtctcataatgggactaaattaaagatttgaggtcttggctggggcatggtggctcacacctgtaatcccagcactttgggaggccgagaagggcagattacaaggtcaggagatcgagaccatcctggctaacacggtgaaaccccgtctctactaaaaatataaaaacaaaattagtcgggcatggtggcgggcacctgcagtcccagctactcgggaggctgaggcaggagaatggcatgaacccgggagatggagtttgcagtgagccaagatcgtgccactgcactccggcctgggtgacagagtgagactccatcaaaaaaaaaaaaaaaaaaaagatttgaggtctcattaacatatagagtacacaagagtttgtctagagaataaaagctgagaaaagaaccaaagatagaaccctgagtaattcaatcttaacaggtgagtagaagaaaaggaacataaaaaacaacaaaaaaagtaaaggaatggaggaatatgtggaatacatgcaaagaaaaaccaaagaggtgacagggaaactaaaggacagtactgtactttaaaagatagggagcattttatttttatttatttttttacagacagggtcttgctctattacccaggctggagtgcagtggtgctatcatagctcactgcagtctccaactcctaggctcaagtgatcttcctgtctgagccccaggagtagctgcgattacaggcacatgccaccacacccagctaatttttaaaatttttcttttgtaaagacgaggtctcactatgttgactagccagttttgaaatcctagcctcaagtgatactgctgccttggcctcccaaagtgctggaattacaggtataagccactgcacccatcagggagcattcaaatgagattgggattgagatactgtcagtgaatttggccattaggttatttgtaaccttggcaaaaactaattcagcaagatgacaaagttagaaaaaaagataatggtagggtacggaggttctagagaatgaagccacaaaagatagagaaagcagattatttggctctgacaaggattatgggttaaagggaagggaaatgacacaacaatacctagtggcaaatgcaagatctaagggagagggttgtttttaataaaggggaggccaaggaatgaatatcggaatgcaaagaggaaataaacagtataggccgggcatggtggttcacacctgaaatcccagcacttcgggaggccacaacgggcagattacttgaggccagtagttcgagaccagcctggccaacacagtgaaaccccatctctactaaaaatacaaaaagcggccatatgccaagagaatactagcaatcagacctaggttcaagctccacagaccaccaggttggattcagaagagtcagtcaggacactcacctgaaggtgacttctggaacaagacacttcactccattatggaaaggccgggtgagagaaatggtctggctgacctgatccacagctgacactcttccctgatagacacccaagctatctccacaattgatggacacaatacttcccagccaatctgtagccatgtttcacacgtgagaccactgtgaagagaaggaactattcagtgtgccttggtgaaaagacaaacttttaattaaattcagcaaatatatcaggctctgtaccaagtgttggttaataaaacatattctatcacattgttaactgaggtaataaatcttaaaaaaattaaaattttttttcaggagtatgaatattaaaaaataatattatttaatacatataaagatcttataattgctttaaagcgcatacattggataaagatatttattacacatcaaatcacacaaactataatctgtttatattgtattttaataaatctgctgtcaaaatgttttcaaagagagtatgttgctgagaaataatatattaaaaaaacaaattactgataatgccactcttgctgatgatgataataataataataattaataataatagtaaattctggatagttgttttttttttttttgagacggagtttcactattgttgcccaggctggagtgcaatggtgcgaggcgggcagatcacgaggtcacgagatcaagaccatcctggctaacacggtgaaaccccgtctctactaaaatatacaaaaaattagccaggcgtggtggcgggtgcctgtagtcccagctacccgggaagctgaggcaggagaatggcgtcaacccaggaggcggaggttgcagtgagccgagatcacaccactgcactccagcctgggcgacagagagagactctgcctcaaaaaaaaaaaaaagaaatttttttaaagccaattgaaggtactatagaacactaaacctaacgactacagaatatatatccttttcaagtctacatagaatgttcacgcatatatgctgggccttaaacaagtatgaataaatttaaaaagactgagatcacataaaatatattctctacccacaacagaattaaatttgaaattgataaaaatagatatttagaatattcccaaatatttggaaattaagcaagacatttccaaataacctatgggtaaaagaagaaatcaaaagggcagtcagaaaatagttctaactcaacgataatgaaaacacaacatcaacttttgtatgacatgcttaatatagtgcgtaaaagggggaatttataactttaagtgcttgttaggaaagaaaggtctaaaatcaattgtctaagcttccatcttaagtattagtaaaaaaagaacagattaacctgatgttaatagaaaggaaatcaagagcagaaaccaatgaaacaagaaacaactaagaaaaataaaacaaaaattagctctttgaaaatattaataaagttggtaaacacctaataaagaaaaaagataaaacacatattattaatatcagaaatgaacaaagagacatcatagacattaaaaaataaccttatgccagcaaatttgacaactagacaaaatggggaacttcttagacaaaagttatcaaaactgacacaagaaattaaaaatctgagtagctgcatgtctattttaaaaactgaatttatcaagagaataagacaagacacaaattaggagaaaatatttgtgaaagacatatttgataaaggtctgttatccataacataccaagaactcttaaaactcaacaataagaaaatgaacaacctgatgaaacaatgagcaagagacccaaaaggatacttcaccaaagaagacatggacacggcaggcaagcatatgaaaagatgctctacatcatatcatcagggaattaatggaaattaaaacaacaataagatgccactacacacctgtcagaatggccgaaatccaaaacactgacaacaccaaatgctgacgaggatgtggagcaacaaaaaccgtcattcattgctgacaggaatgcaaaatgatgcagccactttgagtatgcatttttctttttttttttgagatggagtcttactctgccgcccaggctggagtgcggtggcacaatctcagctcactgcaacctccacctcccgggttcaagcaattctcctgcctcagcctcctgagtagctgggattacaggcatgcaccaccacacctggctaatttttgtatttttagtagagacggggtttcaccatgttggtcaggctagtcttgaactcctgacctcatgatccacccgcctcacctcccaaagtgctgggattacaggcgtgagccaccatgcccagccttttttttttttttttttttggagactgagtctcactctatctttatcgcccaggctagagtgcagtggtacaatctcagctcattgcagcctctgcctcttcaatcaattctcctgcctcagccttccaagtagttgggactacagacacgtgccaccacacccagctaatttttgttgttgttttttttctcagtagaggggtttcaccatgttgcccaggctggtctcgaactcctgacctcaggtgatctgtctgcctcggcctcctaagtgctaggtttataggcatgagccactgtgcctagcttgcatatgcatattaataaggtagtttctcacaaaactaaatataccatctgatccagcaatcactctccttggtatttacccagatgaactgaaaacttacatccaccataaatctgcacgtggatgtttacagcagctttattcaaaattgctcaaattcggaagcaatcaagacatccttcagtaggtgaatggatgaatgaactatggcacacccagacagtggaatactattcagcacaaaaaagaaatgagctatcaagccatgaaaagacatggaggaaactgaaaagcacattactaagtgaaagaagccaatgtgaaaaggatacatacatactatatgattccagctacaaggttttctggaaaaggcaaaactatggagacagtaaaaggagcagtgggtgccagtggttagtggggtgggggtgggaggtgaacaagagaatttttagggcagtgaaactattctgtttgatactataatggtagatatgtgtcacttcaaaacccatagaatgtacaacaccaagagtgaaccctaatgttaactatggactctggatgacaacgaagtgtcagtgtaggttcatcaattgtaacaaacacgaccgtggtgtggaatgttgacagcagagagggcttactgggggacaacagtgagatatatgggaaccctctgtattttcggctcaatttttccctgaaactaaaactgctctaaaaaataaagtctatttaatagaaaaaaccaaattgattatgtaatttaaaaccttcctacaaagaaaaatccaggcctagatggctttactggctttttctttttaactaagtctgaactagacagctttactcgttaattttatccaacattttaggaaaaaaataatgtcaatctcatacaaacttttagaaaacacaggggaatgaggctggatgcaatggctcatgcctgtaatcccagcactttgggagactgaggcaggtggatcacttgagatcagcagtttgtgaccagcctggccaacatggtgaaaccctgcctctactaaaaatacaaaaattagccaggcatggtggcacgtgcctgtaatcccagctactcaagaggctgaggcagaagaatcgcttgaaatggggaggtggaggttgcagtgagctgagatcacaccattgcactacagcttgggcgacagagcgagactccgtctcagaaaaaaaaaaaaaaaaaggctgggcacagtggttcacacctgtaatcccagcactttgggaggctgaggagggtagatcacttgagttcaggagttcaagaccagcctggccaacatggtgaaaccccatctctactaaaaatacaaaaaaaaaaattagccaggtgtggtggtacacacctgtaatcccagctactcgagaggcagaggcaggagaatggcttgaacccaggaggggaggttgcagttagccaagatcgcgccactgcactccagcccaggtgacaaagcaagactctgtctcaaaaataaaaattaaaaaaaagaaagaagcatttcccaatttgttcaatgtagctagtataactctgacgtgaaagcctccccacaaaggctttataagaaaaagatcaacatcctgcacaaatatagaccaaaaatcctcaacaagatattaacaaatcaaatccagcaataaattttaaaagtctaatatatcacatatatttaggtccctactcctagaatgcaaaattggtttgatattttaaaaatcgatcaattttaaatcattttaacagaatgagaaaatcataaacgttatcacatcagtaaatacagaaatattatcttgataccaagacctgacaacaataagacaaaaacaaaactacagaatactatcccccatgaatgtaaacataaaattccttatcaaaatatcacccaacaattcaacaataatgatccaggctcagtggctcacacctgtaatcccagcactttgagaggccaaggtgggaggatagcttgaggccaggagtttgaaaccagcctgggcaacacagtgagaccttatttctaccaaaaaaaaaaaaaaaaaaaaaaaaacaggtgtagtggtgcataccagtaatctcagctacttgggagcctgaggcaggaagggagcttgggcccatgagtcagtggatggagtgagctatgatcacaccactgcactccagcctgggcaacaaagcaagacaccatctctaaaataaaagtaaaaaacaaaacaataaacataaagaattatacaccacacccagccaggtgtggtggctcacgcctgtaatcccagcactttgggaggccaaggtgggcggatcacgaggtcaggagatcaagaccatcttagctaacatggtgaaaccctgtctctactaaaaatacaaaaaattagccaggcgtggtggcgtgctcctgagtcccagctactcgagaggctgaggcaggagaatgatgggaacccaggaggaggaacttgcagtgagccacaatcacaccactgcactccagcctgggtgacagagcgagactccatctcaaaaaaaaaaaaaaaaaaaaaaaagatttatacaccacacccaggtggagtttattccaaggatgcaatgctgactcaagatcagaaagccaatcaatgtaatctaccatattaacaggctaaataagaaaaacacatgttcatagcaactgacacagaaatgcatttgacaaaatcgaacacccattcattctttttttaaaaagcctctcagaaaaatgggaatagagaggaacttcatcaatctggtaaagggatctaaaaagtccctacagctaacattatactaaatggtgaaagactgaatgctttccctataagaacatgaacaaggcaaagatatccactattactcaacacagctctagaagttctcgcaataaagcaagaaacagataaaaaaagtatacagtttgtaaaggaaaaaacaaaactatccccatttgcagatgacataactgtctatgtagaaattccccgtaatctacaaaaagtcttagaacaagtgagttcagcaagattgtgggatacaagataaacatacaaaagccaatcttatttcagtatattagcaatgaacacatgggcaatgaaatttaaaatacaataccatttacaattgctcaaaaaataaagtactaggtgtaaatctaaaaaaaaagggtacaggatttgtatactgaaaactatgcaacactgaggaaaaaatcaaaatgctaaatataacagatataacatgttcatggattaaaagactcgacaaaaagtacataaatcctcctcaaattggtataaaggatcaatgcaattcttatcaaaatcccagcaagatctgtagatatagacaaggttattctaaaatttacaaggaaaggcaaagaaactaaaatagctaaatcaatattttttttgagacggagactcactttgtcgcccaggctggagtgcagtggcgcaatctcggctcactgcaacctccacctcccgggtgcaagcagttttctgcttcagcctcccgagtagctggcattacaggtgcccaccaccacgcctggctaatttttgtatttttagtagagacagggtttcaccatcttcgccaggctggtcttgaactcctgaccccatgatccacccacctcagcctcccaaagtgctggattacaggcgtgagccaccacgcctggctgctaaatcaattttttataagaaagtgggaacaatcagtctacctgatttcaagacttacacaattatgataatcaagactatatagtattggcagagggacaaacatgtaaatcgataaaatagaaggcagaacccagaaacagactcacaaaaatatgcccaactgatttttgacaaagtgcaaaaacaattcaatgcaggcagcatagtttttacaacaaatagcgctggagcaaatgtaaatccatcagcaaaaaaatgaacctcaaactaaggttcacactttatacaaaaatttactcaaaatgtatcatgaacttaaatgtaaaacatcaaactctaaaacttttagaaaaaacataagagaaaccctcaagatctagggctaggcaaagagttcttagacttgacaccaaaagcacaatccataaaaagaaaagctggtcaactagacttcttgaaaattaaaatttttattccacaaaaaacaagtcacagactgggagaaaatacttgcaaaccacctatctgacaaagacaaaggagtagtatctaggaaatatacacctttcaaaatggctaaaatacagtgataacaccaagtgctagtaagaatgtggaaaaaatggatcactcatacattgctagtccaaatattgaatagtacagctactctggaaaacatcctggcaggttattaaaaaaactaaacatgcaataattagccaagtgtggtggcgcacacctgtaatcccagctatttgagtggctaaggcatgagaatcgcttgaacctgggaggcgcaggttgcagtgagccgtgatcccaccactgcactctagcctgagcaacagagactctgtctcaaaaaaagaaaaaacccaaggctgggcacggtggctcacgcctgtaatctcagcactttgagaggccaaggcgggtggatcacaacgtcaggagatcgagaccatcctggctaacacggtgaaaccccgtctctactaaaaatacaaaaaattagccgggcatggtggtgggctcctgtaatcccagctactcgggaggctgaggcaggagaatggcgtgaactgaagaggtggagcttgcagtgagccgagatggggccactgcactccagcctgggcaacagagcaagactccatctcaaaaaaaaaaaaaaaaaaaaccaaaaaactaaacatgcaactacaatatgacccagcagttgcacttctggtcatttatcccagagaaaggaagacctaggttcacacaaaaacctgtacgtgggctgggcgcagtggctcacgcctgtaatcccagcactttgggaggctgaggcaggtggatcacctgaggtcgggagttcgagaccagcctgaccagcatggagaaatcctgtctctactaaaaatacaaaactagctgggagcggtggcgcatgcctgtaatcccagctactcgggaggctgaggcgggagaatcgcttgaacctgggaggcagaggttgtggtgagcccagatcgcaccactgcactccattctgggcaacaagagcgaaactctgtctcagaaaaaaaataaaataaaataccctgtacacaagtgtttatatcacatttactcaaaaaagccacaaactggaaacaactcagataacctcaatgagtgaataaacaaacagtggtacattcataccacagggcaaaaagtaaaaatgccaaccccaagaggttgtgttctgtatgattccatttgtgtaacattcttgaaatgacaaagctatagaaatggagaacagggccgggcacagtggctgatgcctgtaatcccagcactttgggaggctgaggagggtggatcacctgaggtcaggagttcaaaaccagcctggccaacatggcgaagcctcgtctctaccaaaaatacaaaaattagcccggcgtggtggcaagcgcctatagtcccagctactcgggaggctgaggcaggagaatcacttgaacccaggaggcggaggtcgcagtgagctgaggtcaaggtcgtgacagtgtactccagcctgggcaacagagtagcaacatgggggactcttgtagtaatggaaatattttacatcttgaccatatcaatgtcaatatcctagtagtgatactgtattacagttttgcaagatgttaccaacaggggaaactgggtagggcataaggaatctctctgtattatttcttacaatggcatgtgaatctacaactatctcagaagtttaattaaaaaaaaaatcaatgccttgcatcacattaacaaaataagtgatgaaatcatgtataatcatatcaataaatgcagaaagataattggacaaaatttaacaatcattcactatatttaaaaaggggagggaaagctggcatctacaaaacaattacagctaacatgatacttaatggtgaaataggccaggcatggtggctcacacctgtaatctcagcactttcagaggctgaggcaagaagatcacagagctcaggagtttgaggttacagtgagctatgattgtaccactgcactccagcctgggcaacagagccagacactgtctttattttatatattttggttttttgtttctgttttttttttttttttttttggctcactgcagcctcctgggctcctgggctcaggtgatcctcccgcctcagcctcctgagtagctgggactataggtgtatgctaccatggccagctaatattttctgttttgtagagacagggtctcactttgctgcccaagctagtcttgacctcacagctcaattgatcctcccacctcaacttcctgagtagctgggactacaggcccacaccaccacacccagctaatttttgtattttttgtaagacagggttttgccatgttgcccaggtttccaactcctgagttcaagctatctgcctacctcggcctcccaaagtgctaagattacaggcatgggctaccatgcccagctgagactttgtctcaaaaaaaaaaaaaaaaaaaaaggtggggttgaaataaatgctttccccaagtactgaggatgaggcaaggatgtccactctcaccacttgtacttatattcaacaactgtaggtcctagccagtgtaataagacaagaaaaagaaaaaaaaaaacccagaaagttaaataaataataaagttaaataagacagtaaaactgtctttatttgcaatgacataattagctgtttacagtcaatccataaaaagtcctactagaactaataaggaaatttagcaaggtcacaggatatatgctcgatgtagaaaaaacaacaacagcagcaaacaactgaaaatgaaattttaggccaggcatggtggctcatgcctgtaatcccagcactttaggaggccaaggcttcccaaattttacacaagttattcctagaacactttccccagctctatgaatggttagttccatcctgcctttccgacatctggtaaaacatgaccatctcaaaaaagccttccctgtctacccaatctaacgtggctactcatcgttattctccaacaccttaaatcctgttatgatctcaaaatcaatcactatatgaattatcttgtttcttcatattgtgtgtgttggtcaggcatggtggttcatgcctgtaatctcagcattctgggaggctaaggtgggcagatggcttgagtccagaagtttgagaccagcctaggcaacatagggagaccccatctctgcaaaaaaattaaaaaaactagccaggcttggtggcacatgcctgtaatacaagctacagctactcagaatgctgagacaggaggaccacttgagcccggaaggtcaaggctgcaatgagccatgatcaggccactgcaccccagcctagatgacagagtgagaccctgtctcaaaacaaaaagtatatagatagatagatagatagtgtgtgtgtcaccccactagaataggacaaatgacatagtcttgttcagtcaataagagtgcctagagtggaagaagtcaataaatatttaatcaatcgatgaatgaattagaaataataaacgtgacagaagttactcaaaatctagagtacctacatgtttatatctaaatgtcttggctctttttgaaaatggttctaaaaaatacagtatccttgggcatactctatgcaaaatcctatataaggtatgaaacctaacacttccccactcacacgaggaagtcagaaaacagctagcagatgatagcagatgaatataaatacacatgttaagcacaaagtgaaacactggttcagtgtttttacattaaaaaaagaaaccagcacttgaaactgttttcaaatactaatttcagacataaaggagcaaaaaagcatataaagcacccctctggtaaaagagtatgtcctgactgagtgtgggggctcacgtttataattccagcagtttgggatgccaaggcaggtggatcacatgaggtcaggagttcgagaccagcctgaccaacatgatgaaaccccatatctactaaaaatacaaaattggccgggcgcagtggctcacgcctgtaatcccagcactttggaaggctgaggcaggtggatcacaaggtcaggagttcgagaccagcctgaccaacaaggtgaaaccccatctctactaaaaatacaaaaattagccaaatgcggtggcatgttcctgtaatcccagttactcaggaggctgaagcaggagaatcgcttgaacccgggaggcggaggatgcagtgggctgagatcgtgccattgcactccagcctgggcaacgagaacaagactcggtctcaaaaaaaaaaaattagccgggcatggtggtgcatgcctgtaatcccagctacttgggaggctgaggcaggggagtcacttgaaattgggaggcgaaggttgcagtgagctgagatcacaccattgcactccagcctgggcaacaagaacaagactccatctcaaaaaaaattaaataggccagccacggtggctcactcctataatcccagcactttcagaggccgaggcaggtggatcacctgaggagtttgagaccagcctggccaacatggtgaaaccccatctctactaaaaatacaaaaattagccaggtgtggtggtgggtgcctgtaatcccagctatttaggaggctgaggtgggaaaaccacttgaacccaagacgcagaggatacagtgagcagaaattgcgccactgcactccagcctgctaacaagagcaagactttgtctcaaaataaatacataaatgaagggaaaggggcaaaaaagcatatacagcactcctccaggccagccgcaatggctcacgcctataatcccagcactttgggaggccgacgtggacggcatggtggcatgcacctgtaatcccagctactcaggaggctgacaggataactgcttgaacccaagaggcggagcctgcagtgagccgacaccgcaccactgcactccagcctgggcaacagagcaagactccgtctagaaaaaaataaaaaataaataaaaataaagcactcctggctgggtgcagtggctcacagttgtaattccaggagtttgggaagccaaggcaggagcatcacttgagtccaggaattcaagaccaggctgggcaacacagcaagaccctgtctcaaaaaaaaaaacaaaaaacagtatgccccattagaaacactaagtctgaaagagtccagctctagggattaatcaaactctagatagttctctagtgatctaactgagccagtatcataaaactatgcggacagaaccgaagattaaaagaacaatgaattagcaggctcatacaggcttttttttgttacatttattatagaatgaaacagagccttgctctgtcgcccaggctagagtgcagtggcgcaatcttggctcactgcaacttctgcctcccaggttcaatcaggcaattctccttcctcagcctcctgagtagctgggactacaggcgcccgccaccacacccagctaatttttgtatttttagtagagatggggtttcaccatgttggccagactgatctcgaactcctgccttctggtgatctgctcacctcagcctctgcactaggattacaggcatgagccactgtgcctggcccttgggtaaattttcaatgcaacacaatttcaacaataatgatgatggtaaaaaagcacaaaatacacacattttaggcttcttttcccttcctgatcaacctttgcctaatgtcacaaaagcatgagtttcctttcctatcatttataatccatcataattctactcagatgcttagatagatgcagaataaaaagcaccagaaattaaccagatatgaaaaggcttttactgttttatttaacatatatctttaagacactgatgttgtgcattcaagtttatattatggtagtagtaactgaatagaatttttaacactttgaaaatgtggatactcgtttataagtgttcttctatgtagttaatattaatagaaacttttaaaaatataaccactgaatgtgtaacaaacttccctttcctcagaaacttcccttggtaaaatagcattattcaaaactcctcaaacaggtttattctataaagaaaattatgctatttacagaaaacagtaaatctaaaacaagtacagtgcccatcaactgggttcctaatcggactagggaaggggctccatcaattatacagctaacacctccacgtcaaaagaagtacaggagatacaggagctacaaggaaccaatcttgtcttttattttctacttttctatcaaggtataacatatacagtaagtcagtctacatattttaagtgtacacctccctgaaattttacatatcaattcacccatgtgaccaccactcaaaacaagacagactatttccaacacctcaaaaggctccattgtgtcctcctacaggtagttattattctgacatctatcatgaaagattatttgagcctgattttgagcttcacataaacagaatcataaaggttctctttcagagtgtttgtcttcttttgctcaaaagtacatctgtgaggccaggcatggtggctcatgcctgtaatcccagcactttgggaggccacggcgggtggatcacttgaggtcaagagttcaataccaatctagccaacatggcaaaaccctgtctctactaaaaatacaaaaaattagctgggcgtggtggcacatgcctgtaatcccagctactcaggaggctgaggcacaagaatcgcttgaactggggaggcggaggttgcagtgagccaagatcctgctactgcactccagtatgggtgacagagcgagatgctgtctcaaaaaaaaaaaaaaaaaaagtacatttgtgagattcatccccattgttgcatgtatcagaagtttattctttctcatagctgtgctgttttctgtaagcatgcctcaatgtatttatccattctactgctgatacatagttgggttatttctagttctgacttattacaaataatattcttaaactgtatacagtatatttctgcgatggacaaatacatccatttctactgggcatataacacaggaagtcatgttatatttatgactttattaggaaccactgaacagttttccaaagtggttgtaccattttgtattaccatctacatttatacaacccaccatacgtgagttctttctgctcctcatcttgccaaaacttggtactattgttctcttcaacttactcattctggtggggtgcaatggttttggtattttcttaaacatacttcttatttactcttgcttcattgatactgttattctcccaataaattattcctaaaattgtaatgactactgaattcagagatgttgtgaattactattcagtcaagaacttgctaccaaagttcatttagtcttatttgtcttccttctccctccatttcttttttttttttctttttttgagacggagtctcgctctttcgcccaggccggactgcagtggcactatctcagctcactgcaagctccgcctcctgggttcacaccatcctcccgcctcagcctcctgagtagctgggactacaggtgcccgccaccgcgcccggctaattttttgtatttttagtggagatggggtttcaccgtgttagccaggatggtctcgatctcctgacctcatgatccgcccgcctcggcctcccaaagtgctgggattacaggcgtgagccactgcgcccggccctgcctccatttcttaaacacctccaggtaagaatactttaattcatttaccactttgttcttatacaaataaacaagttgccaattacaaatctagctactttggaatatccttcatctcattaatacattactagtgtaagtttgctgacaggatttgatgtacaataaaaaaaaatacatcttccctgtaaagcctattcatgacaataaatccttcaaacaattccacttctaaaaaaaactaatttttctgtgtagtattcaacaatgttaaatatttcaaaaaaatgcaatgtttgtgcagctagctaaccaacacttattttgccaacttgttattaaaatctatcctaacaatctgtgtagctaggaagggagccacagatgtgacataatcaagattttccagattacttttaattatgggactattttgctcaaatgctgaactatcaggatttccagactactgaatgccagataagtaatgggactttatcattattctgataagcctttggataacaaagtcaggtagcgctaaacactcttccatctattatattactaaggcagcgcccaaatgatccataaattacaaataaacaagttgccaattacaaatctagctacctccatctctgtgccacatcagacaactcacagcattcagatccaataaacaacccttggcctgctaaaaacaattataattaacagctgtggatgagtgagtagttatagatttctgaaaaactaggaattgttccacacaacaggaaaggtgtttgtttaatcaaaatattgggaaaggcagagatcttaaaagaaaatatgcaacccagcatgatggctcaggccctacatcccagcactttgggaggctgaggcaggaggatcacttgaggccaggagtttcagaccagcctggacaacatagcaagactgtttccacccccaccccgcctcagaaaaagaaatccagcacaatcccctatctaaatccagtactaaacccatatcttccataaaaggcagcacggtgaaaagagaataaaattctgaaatcacactgggtgtggtggctcacgcctcaggtggctagtgtctgcaatcctagcactgtgggaggccaaggagggctgaccgcttgagcctaggagttcaaagccagcctgggcaacatggcaaaactctgtctctagaaaaaatacaaaaaattagtcagaagtgttgggaggcggaggttgcagtgagccaagattgcaccactgcactccagcctgggtggcagagcaagaccctgtctcaaaaaaaaaaaaaaagaaaaaaatgaaatcagacatcacagcccctggttcacttctgaacttccttactaaccagcactacgacctgggcaaattacctaatctgagtctcaactgcctcatctgtagggaattatgccaattatacacctatctcatagaaccactatatgaattattttaagatactatatggattattttaagatactatatggattattttaagattaaatgagataatccatatagtgtctacaacataaaaaattttagttcaaatgtctccttttgccagaaagaataccgatcacatagggaacttaagttatggcgctgtgagggccacctcacttctcacccaaacaaaattacaaaaatacatgaattccctctacaacatcttggaaatcaagtcctggtctttacactggaatacacatgtccgtagggggtacacaaagatatgcaagcaagggaatcaacttccatgctactctcataaacctgatctgtgtggataactagatgatcaattttaaattttcaggcataaaatttattactttaggatgggtaggaaaactacagccctaaaccagatctggtctgctaccaataaagttttattggaacacaactacacaaaaatacttgcatattatctacggctattttctgggtttttttgggtttttttgagacagtcttgctctgtcgtccaggctggagtgcagtggagcgatctcggctcactgcaacctccacctcccgggttcaagcgattctcctgcctcagcctcccaagtagctgggactacaggcgcccaccaacacgcccggctaattttttttgtattttttagtagaggcggggtttcactgtgttagccaggatggtctcgatctcctgacctcgtgatccgcctgcctcagtctcccaaagtgatgggattacaggcgtgagccaccgcacccggccacatattgtctatggctgttttctcactacagtgagaattaagcagtaatcacagaaaccatgtggcccataaagcctttcatctggcctttgacagaaagttgacttttgctttaggataaaattctgtgggaaaagtggaatggatacaagttcaaaaagaaaaaggaaaaatatgtaatggacaaactcccaaaatgataaaaatgaccaaaactaactcaactaactatattaagaaattgaattagtaaaatcttcccagagagaaaaacccaggcccataggacttcactggtaaattctatgaaacacgtaagaaataataccaatcctacacaaactatttcagaaaacagaggaggaaggaacacttcccaattcattttatgaggtcataattaccctgctactaaggccaaagatgacataaaaaaaaggaaacctcagaccaatatccatcatgaacacagtcacaaaaattaacaaaatgttagcaaattgaatccatctatatgtaaaaagtagtagatacattactaagcagggttcatttcacaaatgcaagatgggtttaacatctgaaaatcaagtaatgtaataagctatgttatgtatttcttacagtctttgtttcaaaagtttagttgtatgtttttacaacatcaaattgatattgtatttaggtaattttatatttatttttaagaagtcaatatttacttgtcagaaattacatcctaaactatttaaaattaaatacttacactatgtaaatctaggatgaaaagtttcaggtgccaacttaaaagtatataagatctaacagattccacagtcttttagacattctcaagaagaaatgttttaagactagtgacccagcctatacctgaaagcctgaaatgacaaggagaaaaataatcattcatgccaaagcaacaccaccatatcttcaaacttttgacttctgcccataaatttactcttagcacatctagatctaaacctaatattccaggtacaagcctaccagtgatgcaacctttctcattctagattttgcattttcctgatacaatatactaatgcaggtcacatcggttcttctcacagccttcttaaccacaccactgattggtgattaaaacatcacatctttttattatagaactcctgtgaggtcacatctccaccctcccctaataggtatagttgattttgtttggacccaagcgcaatttctcacatttatacatgcttccttcatttcattaaacagcactgagcaaattatattgagatcttttcccattctggcaatcaccaaccaaatgactctttctttacttcacaaaggcaccaaatccaataagcaaaccttctagataaggtctcaaatacatgaagtatataaagaaagtgatgaaaccccagtttagatcaccggaattccagctgtaagtagtgtccacaaatcaaacctctccatacatagattttcaaactcatgactccatctaactaccacaatctggcaaattcctccatctcgcccactcagttatagtaagactcagtaagaccaggcgcggtggctcacacctgtaatcccagcactttgggaggctgaggtgagtggatcacctgaggtcgggagttcgagaccagcccggccaacatggtgaaaccccatctctactgaaaatacaaaaattagccaggcgtggtggtgcatgcttgtagtcccaggtacttgggaggctgaggcaggagaatcgcttgaaccaggaggcagaggttacagtgagcagaaattgcaccactgcactccgtccaacctgggcaatggagtgagactccatctcaaaaaaaaaaacaaaaacttcataaatgccttgctaaaattctgacacactatcattatggtcactacactcctttgagccacaatttggatgtcctgtcctgttgttctggctgaatttaggagaactctagtaagcccttctctggataagaaaagaaaaatgatacatcttccattttgtattaattacagaatctcacaaatggcaaggattttaaacattttctaatgttgtttttcttagacagagtcttgctatgttgcccaggctggccttaagcaatcctcccaccactgcactcggccctagtctaatatttttcttttcttttctttttttgagaagtttagttcttgttgcccaggctggagtgcagtagcatatcttggctcactgcaacctctccctcccaggttcaagcgtttctcctgcctcagcctcccaaatagctgggattataggcacccaccaccacccagctaagttttgtatttttagtacatacggggtttcaccacgttgcccagactggtctccaactcctgacctcaggtgatccacccgcctcagcatcccaaagtgctgggattactggcgtgagccacagtgcccggccttaatatttttcaaactatacgtcatgacctattaggggtcagactcaatttagtgagttgcaaccaatatttttttagagtgcatcttctgtagaaagggtaagtaaacttttcattggtgtgtgtgtgtgtgtacacactgagtgtgcaggggcacaataagtcatgatgtataatatatctaactgtgggtcacaggtaaaaaattttgagacacttttctagccccacagccctatgccaaggaggctctaccaagaaattggtaataaacaaaatgtcatgtttttacatcatacagagaaactagctaagaggattttgtgctcagtacacgtaatctgccattcattaaaaaaaaaaaaaaagattaggatccatctgggtgtccagttgaaatactaaactgcttggagacagccatttctgttttggtggggtgaagacctgtatttgagacagcagactgaaatcggtttggtctgtggcgaaggaagagaagaaaaaccattctgggtcgcgagttcctcacctgtaaccacaggagaagactgttggcttggtcagttgattttcaactaatctcccaattgaagagttaggcgaagcaattgctattgggagattaactgaaaattaactgaccaagccaacaaggactatgcctcccacaaaccaaaacactttaaccactcagcaagtcaagtattgatacatacaatcaatatcacacaaagtgtactgaaaagaaccacagacttgcatcaaaggcagaaatgaatccagggataacttcctgggattcgaagatgtgacctggtaggtataaatttctcaggcatcctctttttctaccctccagttcatctccgtcctcaagctatcagtcatggatgtggcactggcgttcttctctgccaccgtatctcattatgcaaagggaaactgaggcacgaagaacagagtgagtgagccaaagaactgcagcagccaccaacaaggctggactaagggcccaagcagctaatgcctcactccccacacaatccccatactatttagaatcctgcagtcctcagccttccacctcaaaccaaactcctggggccgcccgtagtacgtggtcccctgctcatccgatgaagcccccagctcttgcctgcctgcctgcctctataaaggtctacgaggcctggaactctgaagcctaaagcaaccccggcagccccctcccacgaccgtccacaaaccagtagcctcccttcgctcccacctccgcgccgacgggcctggagctcctccgcacaccacaccaagccgaccactcaacaccagaggacccacagaagaattctctccacgcccacccccacagcatcggccttcaccaccgccgccgctgccggaagcgcccccacgtctccacgccaccaccgtgaggtcacttccggcgcgacaccttggaatccagggccgtcaattgaggggcgtggcacccgggaaatttaagaggttggaagaacgtcccttcggccttacagaattgcgcttgggtagtcattttgccctccacgcttacttatgtcctgtggcgtcttggctggaatcggggctctacccacgactccccagcctcgatgcctgggcccccctcttgcaggctcgatgaaaagcacccgcttcccctcctgttaccccagcgccaatcgcagagctggagcggaggactttcagggaggcctggtgacgtgacagcccctccgtgctaaactgcagctgtgggacttaataagtgcgacaaccccctgatggattaaagaaaacaagatattcctgccgtggtcgatcttcaaagcgtatcagcttcagcccttttgggggttaaaatcagccagtccgtgcttgactgctctcccttcccccatactcagtacacaggaaagtgccgctcttctacccctggcattttagagtcttgatttgtggggagacgggaaagcatgcgtttagggccaagaccgtgtaatgaggaatattgcacagccttgaagcctgacacctggtttgggaaccactacttgggcgaatagcatagagtagggtagcagttccaaacctagctctacaaaatcagttgaagaactttgtaaaatctacactttctaggggactgcttcacccttccccctccatcaccagagattccctaggtcagaaggggtccttgtcttttaaaattactgttattaatgaacacttatagagcagtttttggttcagggcaaaactgaacagaaagtacagagttcccatatatcccctgtacacacaggcacatacacaacttgtcccctcatggacatcttgtgctacagtggtacatttggtaacaattgattacccaactttgacacatcattatcacccagagtccatagtttacattagagtttactctcggtgttgcacattctgtgggttttgacatatatgtaatgacatgtatccaccattatggtatcatacacgatagtttcactgccctgaaaatcctctgtcctctgcctatttatccttctcagtcccctaaccactggcaaccactgctccttttactgtctccatagttttgccttttccagaatcccatatagttggaatcatacagtatgcagccttttcacatcggattctttcacttatgcacttaaagttcttccatgtcttttcatggcttgatagctcatttcttttttgtgctgaataataatattccatcgtctggatgtgctgcggtttatccattcacctactgaaagacatcttggtggcctccaagtttgggtaattatgaataaagccgctatacatcatgtgcagatttttgtgtagacatgagttttcaattcatctgggtaaataccaaggagtgcaactgctggattggatggtatatttagttttgggagaaactaccaaactgcctttcaaagtggctgcatcattttgcattcccacagcagtgaatgagggtttctgttgctccacatccttgtcagcgttttgtggtgtcagtattttgccgttcaagtaagtgtgtagtagtatcttattgttttaatatgcaattccctaatgacatatgatattgaacatcttttcatatacttacttgccatgtgtatatcttctttgatgaagtgttcattcaggtattttgcccatttttacattgtgttattttcttgttgtgatttaagagttctgggtatattgtagataacagtcctctatcagatacgtcttttataatattttctcctagtctgtggcttgtcttctcattcttcttttgaagagcagaagttttaaattttaatgaagtccagcttatcaattatatttttcacagattatgctattggtattgccctaaagtcattgccattcccaagatcagttaggttttctcctgtgttgtcttccaggagttttatagtgttccattttacatttaggtctacaatccattctgagttaatttttatgaagggtgcaaggtctttgcctagataattttttttttttttttgagacggagtctcactctgttgcccaggctggagtgcagtggcacgatctcagctcactgcaatgtctgcctcctgggttcaagtgattctcctgtctcagcctcccaagtagctgggattacaggcacccgccaccacacctggctagtttttgtatttttagtagaggcaaggtttcaccatgttggccaggctggtctcgaactcctgatctcaattgatctgcccacctcggcctctcaaagtgctgagattacaggcgtgagccaccgtacccggcctgatacatttttatgtgtgtgaaaattcagttgttccaacataatttgttgaaaaacctatctttgctccattatattgctttaactcctctgtcaaagatcagttgactacgtttatgtgggtctacttctggattgtttattctttcaccaataccacattgtcattattactgtagtttatagtaagtcttgaagttgggtagtatcagtcctccaactttgttctcctttaatagtgagctggctcttctaggtcttttgtatctccatatcaattttacaatcagtttgtcgacatccacaaaaataatatgctgatacttggattgggattgcatcgaatctatagatcaggtttggaagaacagacattttgactatattttctttctatctgtgaacatgaaatatttctcaatttatgtaattcttttatatctttgatcagagttttgtagttttactcatatagctcttgtatatgttttgctgtatagatttataacctgatgactttttttttttttgagacaaagtttcactcttgttgcccaggctggagtgcagtggcacgatctcagctcaccgcaacctctgcctcctgggttcaagtgattctcctgcctcagcctcccgagtacctgggattacaggtatgcaccaccacgcccagctaattttgtatttttagtagagatggggcttctccatgttggtcaggctggtcttgaactcccgacctcaggtgacctgcccgcctcagccccccaaagtgctgggattacaagcgtgagccacccagcctaccttttgtttctctaaatctgctctttctgaagttagtatacctactcctgctttcttttgattagtgttatcaatgatatatccttctccaccactttacttttaatctatgtatgtctttatatttaaaatgtgtttcttgtagacaacatattgttgggtcttgtttttcatccatactgagaacctctgtcttttaattggtgtatttagatgactgatgcttaattaatgatatagttgaattaatgtctactatatttgttactgttttttttttcattttttgttgttgttgtttgttttttgagacaccgtctcgctctgttacccaggctagagtgcagtggcatgatctcagctcaccacaacctccatctcctgagttcaagcgattctcctgcctcagcctcccgagtagctgagattacatgcacatgccaccacaactggctaatttttgtatttttagtagaaatagggtttcaccatattggccagggtggtcttgaactcctgacatcaagtgatccaccagtcttggcctcccaaagtgctaggattataggtgtgagccaccacaccaggccctttttttgtgtgtgtgtgagttggagtttcaccctgtcacccaggctagggtacagtggtatgattgtggctcactgcagccttaaatcctgggctcaagcaatcctcccacttcccaagtggtggtactataggtgcccaccatcacacctggctaagctttttttttttttttttgagatggagtctcgctctgtcacccaggctggagtgcagtggtgccatctctacgaagtgaaaccccgtctcaatgcaagctccgcctcccgggttcatgccattctactgcctcagcctcccgagtagctggaactacaggtgcccgccaccatgcctggctaattttttgtatttttagtagagatggggtttcaccgtgttagccaggatggtctcgatcgcctgacctcgtgatctgcccacctcagcctcccaaagtgctgggattacaggcgtgagccactgcgcccagcctgctaagcttttttatttgtttgtttgttttgtagagacagagtctcactatgttgcccaggctgcttttcaattcttggtgttaagtgatcctcctgcctcagcctccaaaagtattgaaattgcggtgtgagccatggcacctggccttgttactattttctgtttgttacccttattttttatctgtatttgtcttctacacattttctgcctttggggtgtgtgtgtgtgtgtgtgtgtgtgtgtgtgtgtgtgtgtgtttatgtgtgtttgagatggagtcttgctcttgttccccaggctggagtgcagtggtgccatctcagctcactgcaacctctgcctcccaggttcaagcgattctcctgcctcagcctcccaagcagccgggactacaggcatgtgccaccacacctggctaatttttgtatttttagtagagatggggttttgccatgttggccaggctgatctcaaactcctgacctcaggtgatccacccgcttcagcctcctaaattgctgggattacaggcgtgagccaccacacccagccaccttttggggttttaattaagaatttttatgattctcttttctcacctatattaacataccaattattcttttctttttttttttgttttagtggttgcccaagaatttgcaaatatgcaatttacattttcaaataatccaattcaactttcaaataacactatactacctcatgaacagtgcaggtaccttataataacaaaatattcctaattcttccctcttgtccctgctatcattgttgtcattcatgccacttatacataagcatatattattaactttaccagcatttcttagttttcaccttaggtgggacaggatggctaaagaggctaaagttgggtatttttctttccacagcaaggttaggctttaataaaaccccagtaggttaggctcctaccacttcaggccttactcccagagactctgattcgcctagtctggggtacaagccagggatctgtattttaaaaagctcctcagattagctgggtgtgggggctcacacctgtagtcccagctacttgggggactgaggcaggaagatagctttagcctagaaggcggaagttacagtgagctgaaatcatgccactgcactccagcctgggcgacagagtgagaccctgtcttaaaaaaaaaaaaaaaaagagctcctcacagaattcagatgcttatggccagaagcagaagaccacacttttggagctgcaccaagctctttgcttaacattacaagggaaagcctcatatcaccaccattccctcctcaagactctcaataccaccccatgccccattcacgcaaaaaaatctggaggttcattgctccaatgtctaatttggttctttccttccccacctttttccctgggctcttatcactcccacactaatgcatatctagttttacacaagaggatgttttcgcaacagaatctagaacttggggtgtttgttaattatacaacaaattcaaattaaagatcaacatcatacagaattagggacacgtgggtcatgctatgacatattccagatacctgtcttttcaacaatcaccagcaatagtgtgttaacattgaatacaagttgggacaagaaatatacatcatgtgcctggaacatcttgtcatacaagacagcaaataaaccatcacactacaagatttttgtcaagagctcactgtaacctccgcctcccaggttcaagtgattctcccacctcagcctcccaagtagctgggactacaggcacacgccatcacaccctgctaatttttgtattttttcgtagagacaggctttcaccatgttggccaggctggtctcaacctcctgacctcaagcgatccaccatccactgggattacaggcgtgagccacctcgcacggcctgtgtaattctatttatatgacattctggaaagggcaaaactataggaacagaaaacatcagtgtttgcctggggtagaaaatgggagggtatgactgtaaaggatttggcgagagggttggaggagtggtagaactaaatcttgattatatgcatttgcaaaactcatggaaatgtatacctggaagaatagatctggagctcaggaaagaaagatgaggtttggaagtcaattaccaggcaataattaaagtcccaataatgggcactatagtccagggatagcatatagcatgagaagagtcaacagctaaggacagaaccctgaggaacaccgacatttaagggatacgcacaggacgaggtctattcaagggcaactgagaagcagcagctaggaacatagaggaaaatccagcagtgggtgatgccaaagagaccaagaggatctttaagagaagtcaacagtgctaaatattccaaagagctcaaatcagaggaagactgaaaatgtacattagatttagcaactaggaggtccttggtgattttgacagaggttttaaatcggagtaaaggccccagaagtcaaatgccagtggtttgaggagagaacgggaggtaagcaagtggaagcactgagcgcagtggctcacccctataatcccagcattttgggaggccaaggcagatggatcacctgaggtcaggagtttgagactagcctggccaacatggtgaaaccccatatctactaaaaatacaaaaattagctaggcgtggtggcgtgcacctgtagttccagctacttgggaggctgaggcaggagaatcacttgaacctggaaggcagaggttgcagtgaaccgagattatgccactgcactccagcctgggcgacagagcaagactccatctcaaaaaaaaaaaaaaagtaattatctacttcaccccatgtgtatagctgaaagcttagcaagttaatgctgaatctgacattagaactcaggtctcttattacatatatgtaggggaaacatatgttccagtttggatggaatagtccctgttcatgcctgttaccttattgtaattattaataccacctgcttttattctcaaatacattgagaaaaatttgattaaaggtgataactttctatagtcagcctacttatatggcataggctttgaggctggcaagcattcttggttacttaagatcatttttcttttatattatctcaaagatttaagtctcttacattctcaaatgtcactttataaatgaagtaatgcacatacataaaagcaggccccagactataaagtgctaaacaaaggttaggattaaaaagaataataaccttttaggcaacagtttcttaaatgtaacaccaaaagcacaagcaaagcaagaaaaaaataaactgtacttcatcaaaattaaaaacttttgtgcattaagagatatatcaagaaagtgaaaagacaacctacggaatggtagaaaatatttacaaataatatatctgataacggtctggtattcagagtatgtaaagaactttcttttggtcaataaagggtttaaaaaataaaaacaagaaataacaaaaaagaactctcaacaacaaaaagataaacaactcaatcttaaaatgagcaaagtacttaatagacatgtctccaaagaagatacacaaatggccaacaagtacataaaatgacactgaacatcagtagtcattagggaaatgaaaatgaaaaccacaatgaagccaggcactgtggctcatgtctgtaatcccatcacttagggaggatgaggcaggaggatggcttaaagccagaagttcaaggccagcctgggcaacaaagtgagaccctgtctctacaaaaacaaaaaattggcctgtgggccaggtggggtggctcacgcctgtaatcccagcactttcggaggctgaggcaggcggatcacttggggtcaggagttgaagaccagcctggccaacatggtgaaaccccatccctactaaaaatacaaaaatatgctgggcatggtggcgcgtgcctgtattcccagctacttgggaggctgaggcacgagaatcgcttgaacatggaaggcagagattacagtgagccaagatcgtgccactgccctccagcctgggcaacagagcgagactctgtctcaaaaaaaaaaaatttatcctgtgcagtgatgtgcacctataggcccacttacttgggaggctgaggcaggaagatcccttgaacccaagagttcgaggttgcagtgagctatgtttatgccactgcactccagcctgggtgacagagggagacccagtctctaaaatgaaacacagccaaaaaaaaaaaaaaaggcccaaaacaatgagatactacttcacacccattaggatggctataaattttaaaaaggaaaataaatgttggcaaaaatgtggagaaattggaacccttgaatattgctggtggaaatggaaaatgagacagccactacagaaaacagtttgagagttcctcaataagttaaatgtagaattatcatgtgacccagcgattccacttctaagcatacatctaacagaattgaaaacaagtgttcaaataaaaacttacacatgaatgtgtatacaaaatgtggtctcgccatataatgaaattattcagtcatgaaaaggaatgaggctgggcgcagtggctcatgcctgtaatcccagcacttcgagaggctgaggcgggcagattgcctgaggtcaggagttcgagaccagcctggtcaacatggcaaaaccccatctctactaaaaatacaaaaattagccaggcatggtggcacatgcccatagtcccagctactcaggggctgaggcaggagaatcacttgaacccccaaggtggaggttgcagtgagccaagatcgcacaactgcactccagcctgggtgatagagcaagactctgtctcaaaataaaataaaaaaatagaagggaatgaagtactgctacatggtaaaacatggatgaaccttgaaaacattatgctaactcaaagaagccagtcacaaaaggccacatattgtatgattccatttatataagatattcagaataggcaaatctatagagatccctgttcccccttccccttagatcctgggaaccactactttactttctgtctctgtttatccattcatctgttgatggacatttaatgtgttttcatctttgcctatcgtgtacaaaattttctttcaacatgtgctttccattctcttggtatatacctagaagtgaaattgctgggtcatatggtaattctatgtttaactttttgaggaaccgcccagtgttttccacaatggctacatcattttacattcctaccagcaatgcatgaagattcaattttctccatattcagcatttattttcatctttttaaattatagctatccaaagggatgtgaagtggtatctcattgtggttttcatttgcttttttcttttctttttttgagatagagtcttgctctgtcacccagatttcagctcattgcaacctccatctcccaggttcaagtgattctcctgcctcagcctcccaagtagctgggattacaggtgcccaccaccacacccagctaatttttgtatttttagtagagacggggtttcaccatcttggccaggctggtctcgaactccttacctcatgatccacctgccttggcctcccaaagtgctgggattacaggcgtgagccaccgcaccccgccttcattttcttaatgattaatggcaagtatcttttcatgtgctctttggccgtatcttctttggagacatgtttatcaagttctttgctcattttaaattgggttgtttgtcttcttgttattgagttgggtttttgttttgttttttgaaacaaggtcttgctgtgtcccccaggctggagtgcaatggctcgatctcggctcactgcagccttgacctttggggctcaagagatcctcccacctcagcctcccgagtagctgggactacaggcaggtgtcaccatgcctggctaatttttgtagtttttgtagagatggggtttcgttacgttgcccaggttggtcttgaactcctaggctcaagctatctgcctaccttggcctcccaaattgctgggattagaggtgtgagccacttcgccaagcctgttttgccagggaggggggaatgatgatgaaaacgttctggaatcaaatagtgctgatggctgcataacattgtgaatatactaaaaatcatggaattgtacactttcaaatggttaaaagggtggatgttatgttatgtgaattttacttcaataaagaaaaatttaaagaagaatatacttaatgaacaacgaatactcagttctttttttaaaaatgttagttctgcagccaggtgcagtggttcacatctctaatcccagcactttgggagaccgaggcaggaggattgcttgaggccaggagtttgagaccagcctgggcaacaaaacaagaccccatctctacaaaaaaaaaaatttttttaattagccagacatgatgacatgtggtcgcagtcccagctactcgggaggctaagatgagaggattgcttgagcccaggagttcaaggttactgtgagctatgatatggccactgcactatagcttgggcaacagagtaagaccctgtctctaaataataataataatgttatctcattgttagcattattgttgcaattatttttgtttgcaaggccggaaactctcttcatcattcatcaatttttgtcatggaagacaatggtgaaatgggattcttctcatagaaacttgtgtcaccatcaaacttgttgtaatttccccattctattaatcaagaactccccaagtaaatgaatccagatttgctagctggtagctttgtgttttggctgcaatcatctgaaaatagctttccctttcgacctcattttgttgagataagtttaggcatgaaacagtagtcaggtgcagtaagtggggatcctgaatcccagcagatgaggctggatgaggacctgacctcaaggattcttgtttgtttcctccacccatccacaacagcatgcctctctcccttatgccctccctcctgctgcacccttcccacaacatcctgtaatccttgcttcttccttggcctgctttctcatgctccattctctatgtctaaactagagagaattctcttaattaaaactggagcagggatggatattgaacataaagaacgggatggggagggagagtgggctggtgcggtggctcacgcctataatcccagcacttcaggaggccgaagcaggcagatcacttgagctcaggagtttgagaccagcctgggcaacacagcaagaccccatctctacaaaaaatacaaaaattagccaggcatggtggcatgcgcctgtagtcccagctacttgggagactgaggtgggagggttgcttgagaccaggaggtcgaggttgcagtgaaccaaaatcatgccactgcattccaacctgggtgacagagcaagaccctgtctcaaaaaaaaaaaattaaaaattaagaaaaaaaagaacaagggggaatccagaacgatgctagctaatagaggcacgtgtgttgccaatttgaaaagacatctgaggctgggcatggtggctcatacctgtaatcccagcactttgggaggccaaggcaggtggatcacctgaggtcaggagtttgagaccagcctggccaacatggtgaaaacccatctctactaaaaatacaaaaatcagccgtgcatgatagcacgcacctcaggaggctgaggcaaaagaatcgcttgaacccagcaggcgaaggttgcggtgaacggagatcgcgccattgcactccaacctgggcaacaagagcgaaactccatctcaaaaaaaaaagacatctgagaagagaacagacagctgtcactgctgtggcagcagccctgcctcaggtgtgtggcccctcccagctccagccgcttgacctctgctgtctgccctctcccattcccctcctgggatacacatttagagaacaactggctcagcaacaattagccttttcagaaatgccagtgagttgccacttcttactcctgtgctggggcttttaaccgtttcaggagtgccagcttccccatctcctctcagcttcacaggcaagcctgaggggctgcgtgaagacaagtggctcttggttttccttacctggacctgcaagccaactattaaagtattcaggagagatgatcttgctgtgcaggcacagaactggaccagacacaagcccagatggtggaggagagggggtgggttggggaagcttccagggtcatcatgggaaatagcacagaacatgggctcccttctagattccgtgtattcctggggacctagaagccaggtgtcctccccaagcatcacaagggttagaccactctgcagggtatttaggagtccagggcacttctgtgtgttacccacaacccagatggatgaaaattgcaaggtgtatacttatttgctgccttgttctctgagggacccgtctgcctccactaccacacacttcagtcttacatcctgaaatatctgacatctgacattccccctgcaagagaagtacagagaaaagtggaaagtgaatgaattattttgcatgctgggtaaaagcatttaaacaaatggtgattaaacccaaaaatgtttcacaagacctgtttcacaatttttctgcatttataataaagtagatcaagtcttcttatgactcagtcttcataagactcagtcttcacagatcccaccaggagatgctctggaaaagtttcgacatggagattgacatctttattcattcctaatccagttcttgaaaagagtaaacagagatatgaacaagagacaaatacatttatccagggaggcaaaacagtattctcaaagtcacccaatcaaccaagacagtttctagtgaagacctgattcatcaacaaatcttttcttcttctccttctccttctttttccttctttcttttttaagacagggttttgctctgttgcccaggtgggagtgctgtcatgatcatggcttattgcagacttgacctcccaagctcaagcgatcttcctgcctcttttttttttttttttttgtattttttggtagagataatctcaccatgttgcccaaggagtctcactatgttgcccaggctggtctcaaactcctgggctcaagcagttctcctgcctcagcctcccaaagtgctgagattacaagcattagccatcacacccagcaatcaacaagtctttatgtaatgcccaaaatgtgctcaatcccagtgctaggagctgggatggaggcaacaaagaaattgacctgccccatttaagtgtcatgtatggttcaaaaattgtatgaaccatacatattcaaaccatacatggttcaaaaattaaatttaaaaaaaaactgacgtgccctgaagaagcttatggctcatccagggaaaccaaattaacacagggtatcaattgtccattgctttgtaacaactaacccaaaatttagtggcttaaaataacaaccatgtactgagctcactagtctgtggtttaggtgggtatactgctgattggggtgggactggctgatcttggctggactcactcaaggaagttggctagagtctggctggtctatggtggcctcaaccagggcaattcctctctgtttcatatggtcttttatcttccagcaggctccctgggtttgttgttgtggtcgtggcaggattccaagagaaggtaaaggtcgatgaggtctcttaagacctggcctcaaaactagcatgccatcacctccaatgcattggactgatcaaggcaagtcaccaggccagcccagattcaaggagggggaaaacagaccatacattttcacaggaggatatgtaaagtcactttgtaaagggaataaatacaggaaggaaataaaattgggccacaatgacacaggaagtaacaagaaaaaccagcaagtggctaaaggccactctgtgctgggaagaagttgaccaggtcccagggctagaacccaggccaggcttcttgtcataagtcagggtagcaaaccactcatactgctcccagtccctctgggaaatagttaacatttgttgtaggccgacagccagtgtcagtttcaagaaggcttttaaaggtgggtggtgctggaggtggttcccaggcttggaatgggagatccagcatctcctttggaactctctgtgtccttcgctccttaaacaagctagataggcactcctgggccccccattttccagatgaaattggggccctgtatggaagctgccaaaccgtttttgagtcactgaggaaacccttagatactctctcctctgtggagacctacagacttcctggattaaccatagcagcctatgcagcctgatctcacattgactcttcttcttcctgtcatcctttggctatgatttggctaggaatggatacagatttattctgatggagcaggcttttgtttactctccaaaaccttcaaggagttttgtgtgtgtgtgtgttttgccccaaaattacatttgttatctgtaggagggttggtttgtaaggaacttaccctgccataagccacataattcaaaataactgttaattttttccccgaattaaatctgctgtaaaaattctatggtatgagaggcatcataccatagaatgaacagagtactggactttaaaacagaatacctgattgtaaaaattccatataatcttggaattgagaagacctccttaattgtcgttcaaaaatccaaaaaccataacagaaaagattaagaaattctactacataaaaaaaacctatccatattaaaagccaccatattcaaaaagtcaaaatacaaacagggaaaaatattttcacatcacagacaaatatctaatctgaatatataaagagtcccaagtaataaataggaaaaagaccaataactgaaaagaaaaaaatggacagaggctgggcacagtggctcatgcctgtaatctcagcactttgggaggctgaggcgggtggattacctggggtcaggagtttgagaccagcctggccaacaaggcaaaaccccatctctactaaaaatacaaaaattagccaggcatggtggcgtgcacctgtagtcccagctacttaggaggctgaggcaggagaattgcttgaacccaggagacagatgttgaagtgagccaagatggcgccactgcactccagcctaggaggcagagcaagactgcctcaaaaaaaaaaaaaaggacaaagaatatgaacagacttcaagaaaagaaactacaaatggttcttaactatgtgaaaagatattaaaagataaaagcaaagaccaggcgcagtggctcatgcctgtaatcctagcactttgggaggccgaggcaggtggatcacttgagctcaggaggtagagaccagcctggccaaaatggcaaaaccctgcctctactaaaaatacaaaaaaattagctgggtgtggtggcgggtgcctgcaatcccagctactcgggaggttgaggcaggagaatctcttgaactgggaggaggaggttgcagtgagccgagatcatgccactgcgctccaacctgggcaacagaccaagactccatctcaaaaaaagaaaaaaaattaaataactggtgatcaactggatacagagtaggactaaatacaactgtgaaaatctagggacgtgaatcagaattttgaggtctcatcttagataaaaaaaggaaaattgtaaaaaggacaaacaggccattgcttctgataatgagtgtcaaggacataatattaggaaccatgtttattgaaatcatataaacatgaaggacaatgctgagaaatattattcttttattacaagaccctaaaaaactgctgtttaaaatcataccagggaaaaagaggaattaatttggaggaatcacacttcccgatttcaacacttactacaaagttacagtaatcaaaatagtgtggtcttggcataaggacaattgagagtccagaaataaactcatacatccatatccaattgatttttgacaaggacgccaaaaccattcagtggggaaagaatgatctcttcaataaatggtgcttggtaaaatgtaaaagaatgagtttggaccgttactttacaccatatacaaaagttaactaaaaattgatcaaagacctacatataagagctaaaatcaggatgggcgtggtagctcatgccatctataggttcagcagtctgtaaacaaaaaatggcatagtacttgggagactaaaactctgtctaccaaaaagaaagggggaaaatgataacattgtattgtaagatttataatgactctgcctccaagaaaaaaaaaaataggccaggcgtggtggctcacgcctgtaatctcagcactttgggaggctgaggcgggtggatcatgaggtctggagttcaagaccagtctggccaagatggtgaaactccatctctactaaaaatacaaaaattagccaggcgtggtggtgggcacctgtaatcccagctactccagaggctgaggcaggagaattgcttgaacctgggaggcagaggttgcagcgagctgagatcgcgccactgcgctcgagcctgggtgacagagcaagactccctctcagaaaaaaaaaaaaaatatatatatattatatatatgtgtatatatataatatatattatatatgtgtgtatatatataatatatattatatatatgtgtatatatataatatatattatatatatgtgtatatatataatatatattatatatatgtgtatatatataatatatattatatatatgtgtatatatataatatatattatatatatgtgtatatatgtgtgtatataaaatatatacattatatatgtgtatatataatgtatatattatatgtgtgtatatataatatatattatatgtgtgtatatataatgtatattctgtgtgtatatataatgtatattctgtgtgtatatataatgtatattctatgtgtgtatatataatgtatattctatgtgtgtatatataatgtatattctatgtgtgtgtatataatatatattatgtgtgtgtatataatatattatatacgtgtgtatataatatattatatacgtgtgtatataatatatattatatacgtgtgtatataatatatattatatacgtgtgtatataatatatatattatacgtgtatatataatatatattatatatgtgtatatataatatatattatatatgtgtatataatatatataatatatgtgtatgtatatattatatatgtgtatgtatataatatatattatatatgtgtatgtatataatatatattatatatgtgtatgtatataatatatattatatatgtgtatgtatataatatatattatatatgtgtatgtatataatatatattatatatgtgtatgtatataatatatattatatatgtgtatgtatataatatatattatatatgtgtatgtatataatatatattatatatgtgtatgtatataatatatattatatatgtgtatgtatataatatatacatatgtgtgtatatattacatatatatgtgtatatattacatatataatatatgtgtatatataatgtatattatatatgtgtatatataatgtatattatatatgtgtatatataatgtatattatatatgtgtatatataatgtatattatatatgtgtaaatattatgtatattatatatgtgtatatattatatatgtgtatatatgtgtatatattatatatgtgtatatataatatatataatatatgtgtatatataatatatataatatatgtgtatatataatatatataatatatgtgtatatattatatatattatatatgtgtatatattatatatattatatatgtgtatatattatatatattatatatgtgtatatattatatatgtgtatatataatatatattatatatgtgtatatataatatatattatatatgtgtatatataatatatattatatatgtgtatatataatatatattatatatgtgtatatataatatatattatatatgtgtatatataatatatattatatatgtgtatatatatattatatatagagagagagatagagagagagagaaagcaatgagaagtcaatggaaatatttgaagcttgctattgtccttgacacatactatcccagcagcagaactagaagactatcagtgaagagcatacgacaggacagagctgagtactcaagaattgagggtcccttgcagttgtcactatgtggggctttcattttggtgaaacttccaaactgttaataagataaggagcccaactgaaagatgctgaacatattaaatttgctgagcagcagatacctgcattagtttggaaatacagtctttccccaaaatgtttcagctgttcatatatatattatatataatatacacacacacacacacccctccatatacattatatatatatatatatatatatatatatatatatatatatatgcactgggtatgcacagaggattctgaatggctctaacagcgggtgtgatggttaattttatgtgtaaacttgactgggccacaagatgcccaaatagctggttaaacactatttctggctgtgtctgtgagggtgtttccagaagaaattagcatttgaattggtggactgagtaaaggaggtggccctccccaatgtgggtgggcatctgttgagaacctgaatagaacaaaaggcagaagaaggttgagtgaactctgcctgaccctttgaatttggacatggttcttctgtccatggtgctctcgttcttgggccttcagacctggaatggaatctaaaccatcaactcttcagctctcaggcctttgaaacacaccactggtttttttgggtctccagcttgcagatgacaaattatggactgtctcagcctccataatctcatgagctcttatatacatataaagagatattacatgagctctttatatacatataaagagatattatatattatatacagattattatatataaagatatatatcatatataatatatgaagatatattatgtaaaagatatatagtatatataatatatcgatatataatatatataatatattatacataaagatatatatttataaatggaaaaagaatatgaacatatatattatataaagatatgttacatattatattatatattatacattatatattatatataaagatatataatatataaaatatatattaaatataatacatataaatatatattaaatataatacatataaagatatataatatataatacatataaagatatatattatatataatacatataaagatgttatatataatacatctaaagatatatattatatattacatataaagatatgttatatataatacctataaagatatatattatatatataaagagatttattttgaggtattggctcatgagagccaattatatatgtattatatataatcagtcttttcaaaaccctcttgtcgagataccccatggttccccactgcaatgagtaataaatccaacttgtttaactacaggtgttttcctggtggcccttgactggagggcattgacaatatatattaattatatttctcaaaagcaaaaagcaatacaagctatttatatgtttttcttcgtttttataaagcaaacatttttgtaaccacactgggtcaaggaatagaactttatcagctatcccagaggccctccacatgtcccatttcaattatcacccactccctctcccaaaaagtaaccactccccaaactcttgtagtaatcatttccctgttctttacagtttcatcactaagtgtgtatccctggacactatagtttattgttgctcatttcttaaaatttgggttcaagcaatttgatgtctttttatagtttcttttcatctacaagttttccctccatccctttcttttccttatagattttctgttgaagaacccaggccttttgacccacagtcttccaaagtctgaattttactgactgcacattcatgttgcaattcacgtccctacatcctctgtatttattgcatattggctgctggttccggaggcttggtcagcctctgatgcaatccctttgacaacactataggtgctgttgtgttctttcatcaggagtcacatgatgtctgattttctctccttttatgatgtcagcagttgttaggcacaatgtttagatctattaatttattggtgactacaaaataatgacactaattctataatttctttttcacataataattgaattttttttttttcgagacggagtttcgatctttgttgtccaggttggagtgcagtggcgtgatctcggctcactgcaacctctgcctcccgggttcaagtgattctcctgtctcagcttcctgagtagctggcattacaggcgcccgccaccacgcctggctaatttttgtatttttagtagagacggtttcaccatgttggccaggctggtctcgaactcctgtcctcaggtgatctcggcctcccaaagtgctgggattacaggcatgagccactgtgcccagctggagtatttttaagagatacttctttctaatctatttggttctttttaggtatagttcatataggacaggtagaataaattcttgatttttttttgagacagattcttgctatattgtccaggctggagtgcagtggtgtgatctcagcttactgtaaccgccacttcctgggttcaagcgattctcgtgcctcggcctcctgagtagctggtattacaggcgtgtgccaccacacccagctaatttttgtatttttggtagagacggggtttccccttgttgcccaggctggtctcaaactcctggcctcaagtgatccacccacctcagcctcccaaaatgctgggattacaggcgtgagccactgcgccaggccttttttctaccatttaagccattttgaactgcataagtcactggtttttagtatattcacaaagctgttcaaccatcaccactatctaattctagaatatttccatcacccctaagtaaactctgcatctcccaattctccctgccccacattccctggcaacctctcatctactttctgtccctataaatttacctattctgaacttttcatacacatggagtcatacaatacacggccttttgtgtctggcttctttcacgtagcatgctttcatggcttgtttatgtatatagcataaatgcaagttatagtttaagtagaaaatataaatcactacaagaatgattgagcaccaaatttctcatccccccggccgccgctgcacaaagcaggttgccgcagctgacttcagcttggttgttccttgcagtagcctgaagctcctggtgagcgggagccacggtgcatgaacagcaactgctggccactacgcaatgcttcaggaagaaagctggtctggggtggggtagggaggtcacatcccaaggtgtgtctcccttcagctcctggctatgtgggttcagcctctgccatacttggcatcaccaccactctgccatctcagatggacaggggctttcagcattgagatgtgggttctaatgtgattgtagaacccacgccagggcatgaagagtgagcagcagattacaactgctgagctgagaacccctctccccacaaaactgtgaccagagcctacccacttggacttcagcatctaatgctatcagtcccaaatgaaagactgtctctcatccttcaaggaaggcttggctcagatagtctcaagacctggagccgggcgtggtggctcacgcctgtaatcccagcactttgggaggccgaggtgggcggatcaggaggtcaggagatcgagaccatcctggctaacatggtgaaaccccatctctactaaaaatacaaaaaaattagccgggtgtggtggcaggcgcctgtagtcccggctacttgggaggctgaggcaggagaatggtgtgaacgccggaggcagagcttgcagtgagccgagatcgcgccactgcactccagcctgggcgacacagtgagactccgtctcaaaaaaaaaaagacctggaaatctcgcggtgcccactccccaacccagcctctggaccccacctcccgtatgcatctgtctggtagagttctgaccacaatgaattgaatgatgtgtttatgtgtcagttccctcaaccattttgggaggttcttgaaagcagggactgtactatattcacttgatacccttattgcctaattcggagaatacgcttcatcaatttgtgataagttagagagggcgtaagtcagcacagtgattaggagtcttgtctcatgcctgtaatcccagcactttgggaggctgaggcaggtggatcacttgagctcaggagtttgagaccagcctgggcaacatggtgaaaccccatctctacaaaaaaaaaaaaaaaaaaaaaaaaaagctgtggtggcgtgtgcctgcggccccaactactcagaggctgaggtgggagaatcgtgtgagcccaggaggtggaggttacagtgaaacaaaatggtaccagtgcactccagcctggatgacctggggaccctgtctcaaaaaatagagtcttgtccctcaaacagactgcttaagtgcagcggctacacctcttcactgctacctcctcttcttcctccctacagtaaaacccaacacagaatggggttcagggtgagtatttagacgagtgatgaatcatttatgattcaaaaaatctccacctataggatttctgaacaatatctttatttagctcaggtagttgttcttacacatttttggatacctgggttagaattttccctattacattaaatcaatggttcttaagctcttatgcaagcatgcaagctcaatgcaggctagaatagaaggattgttgtgtacaaacattaaaaatagacattttattacaagagtgtagagaagggagaccaatagaaggtaattgaaatacccccccctcactccagccctagtcctggtgcctggatatgtgcactccctgtgcgctctgatccccgcagacacaagtccccagcccctccaggacagcaataagggtcttacaaggccagaaggcagccctgtttgttcctgcctgcaggaagggcagaggaatgtgatgttcccaggaactgtgtcctagacccatagggtcagattgctcagcctagttcaagcagtgagactacctctgtgccagtatcctgggctgtctcttcccttcactcttggcagctcccaattgtcaaagattggacagggtcctggtttggctagttctaacttgctgaagccagtcagcaccctcacagagccagctaggtactgggcccaggggcttccagagagttcttcagagcttctcagaggcctaaggacctcctaaccctagcaggcctcctggctcaagcacaacttgggaaggctccatcagcatctatgtggccctgttttacctgttgtctctggagggtgtgcagaggcaagtccagggtaggggcaggcaggatcccttaggcttgcccacagcccagatagcaaaactgcagccagatcagtgtctatgagtttcaggctgaaccttagaccacataggccagcctgctggtctggctgcccaaccagaccaggtagacagagtctaggcctcagggctctcaagcacctaagagcgcagctgcatttggaagtgctcacagcaggcatgcttcatggttagcccatagatgggggtcatgtccaccttcacgcccagtggcacgctgaattccacccgttgcagcaggatagccaggaagagaaagacctcccagcgggcaatggtctcaccgatacacttccgcttgcccatgccaaagataatcaccttctcacttaacaccttgtcgatagcaccatcaggggtgagaaaccgttcaggtaggaactcagatgggttgacccatagcttcctgtaaccagagggagacagctgaagtggcagttcagggctcagaagtgtcaagtgagtggagctccagccccaaaggatagaggacaggcaagcagcccatggacaggaggatcaatgcaatgattgtattaatcatatataagagcttaagagggtggacccagcctttcctctgcatctctgaacttactggtcatggttgatctgccactggtttacaaagacacaacgccccttggggatgtaaaagcctttcaaacttgtgtctcttgttgtgctagggagaaaggaagctcagtcaggctcagggcaacaggcaaatctccctgtctcccatgccgtgtccctcccactaaccctaatcaggtatgtggtccggagtaagatcagtaacagacagcagtggctccatggggccttacctgtgggggatggtgaaggggacgaaggaagagtgtcggaaggtctccaggatgaaggcctccatatagggcagatgggatctgtcagagagccggggccgccgtgacctgccaatcactgtgtctgcagaacacagggacaagatggatgcaggggctgcctagacctggccagacccctggcactgacccctttgaagggagccactacctacctagctcctcttggatctttctctgtaccctggggttcatcaccaaatacatgaggctccaggagatagcagttgtgactgtgtcaaaccctggacagggtagaacagaagaagttaggcaggcagcagcaggtcagggcacttgagcacaggaaggacacaatggggtaaccataccagctccaaagaggtccaagacgatgttaatgatcttctcatctgacagctggacattggcgttctcatccagctgcttctcctgacagtgctcaatcaggctgtctgtgatgtcccggatgtggcccttaggtagggaaagtccacaggtgagcaagatctcaaacccagagctacctctccatccaggtctggtccttcactattcctagcacatttgttctggaggtgatgccccctgaggctgttgtcccagcttctctctgcctctgcaaggctctctcctactaccttagaatgctgctagccccaactcatgggacatttgacacacagcgtcttgtactgttatcatctggatgtgctctttatcttctttctattatgaggccaggagatgaactctttaactcttcctggctccctcagcaactgccccagggtcctgcatgtaatgactcttcagtggctattgctgtctgtggaagcatggaagggttagtcaagataaagttctatttccctgccaaggaagaagactattccacaactggcttcaagatcccaggttgaagccttcctgagaacttgccaagccccatgcagttcctcttacctttgacctcccaggccctgatgccatctgcttcccaccacccacctgcctttccccagactgtaccttctcaaaggttttgtagtgctccttgaccatcttctgcatgaagctgtagaacttctcattcaggtccttgaaggcattcagggaagggttgggtaggtagcgaagaatagggatgaagtcagctgggtttccagagccaaccacctccccgaaattattattcaggttgactaggctaagcagttcttggtggttgtggtcatagcgccggccaaagcaaatggcacagatgacattggtcactgataccaccacatacctgtaggggttaaagtgcccaggccctgccatcagctcctgcaacgtgcttatcaggacctcagcctccttgctcacatgctcttccaggtagcaggaggttgaggaggctgggtcagaggcaatggagaaacttttcaggccattctgggccaggcgccggcgggcagcccacactggtccagagtctgggctgaaggacatgctctgaccattactgatgagggtgaaggtgtagaggtcgggccggcccttgaaatcatcgccctgccgcaccagggcctgccggatggtgtccaggccgctcagcaccaccacgggtgtggagccaattcggatctgcagcacgtccccatactgctggctcatccttgacagtgccaggtgcgggttctttcccagggtcagcatgtgcccaatcagaggccagccccatggccctggtggattcttcaggcctttggggacctgaggtcttgaggccctgattacccagaataccagacagaagatgacagaggccagaagaaactccgtggccgacatggagattgggaaaagcatgatcagtgtagggatcttggaggtggctgctgagagaaggtgcaggaagaaaaaaagtcaagccgtcagattgggggatgagaaaagccaatatctagagtgtcagggaaaggggaaacctttccaccagaactgcttactgggcatgaagaagagggtgaggtggggagaagttgttgaactaccactgtgggctaagaatttcacagtccttcttcattcagccctggccacaaatctatgaagtagcctgcaatgaggctcagagaaggtaagtaacttgcccaaggtcacacagccagaaagtgttggatgcagactcccaagccaagttgcctaattccagaacgctttctcttaactgctgtaccaatctaaactgacatcttccaatgtcaatctgtgatttccacatagtaccagtactgttatttacttcacattttcctaaaatcaactttaaatctacctacatatcatcataaacaatatctatgtgaaagtacaagtttgatttttcccctaacacattaaaataaacacataatcaaggtgtatcaccccgagtcctacccaccacacttaggaaaatcatgttctcaggggaattagggatcatctgatcctttagcctcatttaacatttgggggaagcagcgctgacttgtccaaagtcccccagcaatcagtgacagagccaggactcagactccttagggacacttccctggaaatttccagctgctgtcacatgtacctccttttgaagagtggtcagatcaatgaaggaattttcccagaaccctcagttctctgctgctcaatcccaggatgcaggaaatcccaccagaccccaggacagactgaggaagagataggggacaggatggccacttcccaaaccacattgctttcagccccagctctctgagttcaactgatccacagtttaaaggcagctggagaccagctagattgagctctttagtcagagaaatccaggccagggtttttttttggctcaattctcaatgaatgaacagtttggacctcccccttttgcaggttaccagagagcagagaataaatggaaggttcccactaggctgtaagaaaaccccagactggaatcagggaaatcaggaatggatctaaactgaaaggaaactgaggcaatactttctctgtaagcttgacctaaaaagggtgtttaaattcataaaccactctctccaacatatcaggcatctctgcctgttaccctggactagaggtcagtagacccaacattctagtcaaagtgatcttggactgcacattttacttttctggggtccaatttcaacatctgagagagggtaagacaagatctctcagttcagagtacccagctggatccagagggaagagaaaacccagatctgctgtggggaacctgacagtcttaccagttaggctccccacaggagaacctcacaagacagggagatggatggttcctaccacaagtattatagtggagggaggcttcctggaggggctaaatatcaaagcacactagatccctgagtcaacaggggacagtgccaggctttggtgtgctatggtgtccccttctgcacagtgggtatcccaaggacctgcagcctttgtaagatggtaggaggccaagggagatgtgactggtgagtttttagggactggtatttccagctccctgcagttggcaatctgtcaccctgattgtctcccagcaaaggacaaagaagatggtcaatgagataggaaaggcctgggactcctgcacagatctgcctctattgtcccagctgtctaggacatctcagcactgacaagccacccttaggagggtaaaatctgccaggggtagcttcttaggctagggcagggtacagctggtaagaacccagcccaccccctccatccaccctgtccacccaaggagaagcccctgtcatcagaaagcctgagggaggggctgcacatattccagcctgccaggtggccttgatggggaagccccagggtaggcagggagacactcactaggggatggagctggagcctgggtcctgaagtcctgaatgagatgccatctgtatctagaggtctggtaccagctgtgggaccatgggcaagtcctcctcttcccctggcctcagtttccccactagggggctagactgcctggtcactaaaaacactctgagcctccctttttggaggtgctagacaggtagctacctaagaagtcctggaggcaccaaaatgttccttttattgggagagaaagggcaagccagaagtcccccagcaactcacctgaggtactgagctgagctgggaagggtggactcttggagcctgggatcacaaggatcagggaaggttccaaggaactgtcaccttcagggtgagggtgaaggcactgccacctttataggcgggcttgtacgtgtggccacgcctccttccctggagcgagctgagatggagggagaagcagcctgaaccgggctggtctctctgggattggagagaaaggtggcggagggcggcgggggtggggggtcgggtgggcaagaacccactatgggacacatctcggtgcctgtacatagaggggtgagggctgggaacacctggaagtcccaattccaaggcgtcccaagggcagtgcagaacccagccgaggagggggcttgagggagaagtcccaggacagcccgaagagagggtacgggaagctccatcctggggcgcggggactcctcttcgtcatttttgcacccactggaacgctgggcgtgcagatgcctccccagcgctacagcctaccaggactcggcaggcgggggcggggctgccccgtggtgacctccttcccggggttactgagtcccggctcgcgtgagaagcgctgcgaccccagccctgaggtcacgggggccggaaggccagaggcgccgcggggctggacctgtcccccagagcccgggcgactagctgaggttcgcgcctcttgattgaaggatcggaatggatggcgaaggggcaggctcgctgagcgctcactagcggctcctcgcagcctctaggatcgccttagtgctgattgcaacgcgcggtccctccagccaggacccaccggcccttgagggtccctcttggctcccggggtggctagtgctttgattggcagagcacagaaatccggcggcggggggccacggaaagactcgggcccagggaccacggagggggcacctggcgcggagcccccaccctacccccggctagcttgcgtgcgccggcgacatccctctagggggcagaggtcaggcggcccgtccccgccccacctggcccggaggcgcggtgcccaggcgttgcgtgagaaggaccggaggcccgcgcagccacccagccgacccattccccggcccggcgcgggggctcgcagtcacgcgaggggggagggagtcggggcggggctcttaaagggccagcctcgcgcgcggcgtggggttggggtggagggagaggaactgtcgaagggtggcgggtgcgcgattgaataaggggatgcggtgcaaagggtctaggtctgcgtgtggcttctgcctgcgaggagaggcagcctgcatgtgtccgcattttcggtccacgcctgtggcacgacacgaagccccagtgccatttggcatggcctagctgcctgcctccgacgctgtcccgccctccggaaccttcctgttacagggtttccaggaaaaaaaaagttgtatttgcgtgcctagctcaacctggccccagctaacatcgttacgcgccatccccgacgtgctccccaacccggtggcaccaccatccgtcgctggtccaggccagaaaataatcccctcacctcccattccggtcatatgcggcctcgtgcattgcacaaatatttaccaagcaactactatgtgccaggagctgttcggaggcgctggcgattgacagagaagggaacacagctgacagcactcctaatctcgtggagtttacattctgatggaaggagacaagtaatatgccccaaatctagagaatgtgagagggtaaaaagtgcggttgaaaaaaattaaacagaaaaggcgtacggattatgtgagggcagattgcaattcaaaacaagggggtcagggaaggccttgcggagagaggcaggagtgtggagtcaagaatcaatgtgcatagatatctggataaaaagtgtacctgggcaggtgcggtggctcacgcctgtaatcccaggactttggaaggccgagtcgggaggatcgcctgaggtcaggagttcaagaccagcctggccaatatggcaaaaccccatctctatcaaaaatacaaaaattagccgggcatggtgttgctcacctgtaatcccagatactggggcggtgaggggggtttggggggagtggagtcaggcaggagaattgcttgaacctgggaggcagatgttgcagtgagctgagatcacgccactgcactccagcctgggtgacagagcgagactccatctcaaataaaagactgcaactggcagagggaataagcaaaatcaaagcctcccgccaccccccaccacagtggttcttgaaggaccgagcagtaccagggatgtgcagaggtcatgtgactggggagttctcctggcatgtagtccagggggatgggatgcccatgaggcacagcgccctgccgcatgtgcagggagcaccccattgagagacatgagacttcctctgtgcgagatagagacatggctggggtgtaagagaagcaaggtcactcgggctactgtgctaagaataggaggcacatttctctgcttggcatctgctttggcatctgtccagctccactgccacaactcatccagggcccatcattgctccctggagcacttagcctccacctaggttcccatttgccttttgctccgtccaattacttctccatcctgtggcacccagagtggtcctgtcaaaaatgcaaaatctcattccatcaccaccttgcttaaatttctttggtagctcccaccactctgaaggcaggaataagaatctttagcagctctccctctccctctccctctccctctccctccctctccctgtcccctctttccacggtctccctctgatgccgagccaaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaacagggagtgatccgccagcctcggcctcccgaggtgccgggattgcagacggattctggttcactcagtgctcaatggtgcccaggctggagcgcagtggcgtgatctcggctcgctacaacctccacctcccacccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgccccaccgccatcccatctaggaagtgaggagcgtctctgcccggcagcccatcgtctgagatgtggggagcgcctttgccctgctgccccgtctgggatgtgaggagcgcctctacccagccgcgaccccgtctgggaggtgaggagcgtctctgcccggccgccccgtctgagaatcaaggagaccctccgcctggcaaccgccccgtctgagaagtgaggagcccctccgcccggcagccaccccgtctgggaagtgaggagcgtctccgcccggcagccaccccgtccgggagggaggtgggggtcagcccccgccaggccagccgccccgtccgggagggaggtgggggggtcagccccccgcccggccagccgccctgtccgggagggaggtgggggggtcagccccccgcccggccagccgcctcgtccgggaggtgaggggcgcctctgcccggccgcccctactgggaagtgaggagcccctctgcccggccaccaccccatctgggaggtgtacccaacagctcattgagaacgggccatgatgacaatggcggttttgtggaatagaaagaggggaaaagcggggaaaagattgagaaatcggatggttgccgtgtctgtgtagaaagaggtagacatgggagactcttcattttgttctgtactaagaaaaattcttctgccttgtgatcctgttgatctgtgaccttacccccaaccctgtgccctctgaaacatgtgctgtgtccactcagggttaaagggattaagggcagtgcaagttgtgctttgttaaacagatgcttgaaggcagcatgctcgttaagagtcatcaccactccctaatctcaagtacccagggacacaaacactgcggaaggccgcagggtcctctgcctaggaaaaccagagaccttttttcacttgtttatctgctgaccttccctccactattgtcctatgaccctgccaaatacccctctgcgagaaacacccaagaatgatcaataaaaaaaaaaaaaaaaataaggacatgcttgaagcctcctcaaaccacgagcaataaatccatcctgcactcttgaaaaaaaaaaaaaaagtatctttagcagaacctaccaggcctgcctgcctctagttctagtgtcccctaccttgagtctcagataaaacatcacttcctctgggatgccttcctggattctccccccagaaaattatgtttctcctggtcgctgtttccagcacttctccacggtaattcttaggacactggatacttgctatagccccgacccaacctgccacttctttccgtatgctctaacaaggaaaaccaacctgcaggaaattgatctgataagccaagtccaggcaagatattaataactggtaaaggaattagacacagctatactatacacaggccaaatggcaagagagatgttgaatccaaagtgctcatgctataatggtggaatttaggcaacagaacaggcaggagacaagggaggtattgctgggctttctcagcacccttccaattattctactctctgcatctttgattcagtctgaggagcttcatggtacccaagagaggtctgtccttcaatcctagttggagctagagccacagagaacgagcctgtgtggaagccatggcaaggaagtggaaagcaaggcactcctagatcctccaacatgctctgcagcacaacctcttcttcagcttcccagggtccccaccaatgccccagcgctggagaatcatggcagcctggtcaccagggctggaagaccaactagtgctagggctcccaaccagggacccttctcttgatagaaagtgcgttgctttgcttgcattatctaagaggctcttgactcctcaaaaactcattagctaataaaaccaattcgtctctcacttcttaggtggagagatgggtgccagaaaagaaaaggcccaagtacgcatggcaaatcaaagcagagcctagaactccagcttcttgcttctaggccagggcccgtctcaccataacttatcatcccagactatgagtgaagccccagggggccaaaggtagacagactcagcccctgggccagggcccctcacctctccacacccctggactggtgcactggggttacaagagatgttgcacttctcatcaccaagccgtatcttggctaacagttcacaataacaggaagggggcccacactgagcactgggcagagaaggagggagtcaggcaggaggttagaggaccttggcctggagctgaacactcattcctgggtcaaagtttgcatgcctttgcgtgagaagctctttggctaggattccctagtgatcaataccaggagcaggggcagaagtgctggggaggggaaagggctctgggctggagagatcgagacagctgagaggccttagcccagcaaaatcatcagcctagggctttcagtgagccctgctgaaggctgtgggcaaaggggactggaagacaagcaagatccacagcaaacccctgccccatggtagagatgggagtcataccctagacaagtcctgtgatgagtctggagatgctgcaggagctgtgaggaggctggggcaggaggggtgttaaagggatgctccccggagagtggagaactagagaaggcccctggagtctaaggagcataggaagggcattcctagcatggggaagagacacaatgtgaacaacagatagtagtgggaggtcggggtgaggcagtttgggtggatgtggagaactgggacttgtctcccaatgtgtcctctccccacccagtcatccccttctcctactgagatctgagcctgagcatcttcccttcctctcctgcctgtgcccagagagccagatagattgagtttgcaggatacagggctcagatggggcagctcttggctccctggctcttggctgctatagttaggatgacagtattttcccaggacagtctaagcctgttgtcatggaagaattgttaaaagtgccctctttcactctcaaaagatcctggcttagatgataataagttatatagtcaccccagtgatggtgggcatgggtgggttttgggggcccagcatctgttctcccttcttttggcaataccacatcaattgtcctttcgggatcacctcacccctactctcagcccatagggttactgtagctgacccaccccaggccaagccaatgagaaccctatgggagtttcccaacaccccctgccttctgttgctcgccagagtgcagtggtgcgatcttggctcactgcaaactccacctcctgggttcaagcaattcttctgactcagcctcccaggtagctgggattacaggcgcctgctaccacacccagctaattttttttttttttttttgtatttttagtagagacggggtttcaccaagttggccaggctggtcttgaactcctgacctcaggtgatcccccctgccttggcctccctgggattataggcgtgagccaccacacctggccccctatgggagttttgatgaaatcattggaaaagagaggttctccttctgtcagaggtggctacactggctagaaagtaagtctgaagctgccagtagtcattttttaaggaagccggccttagaatgatacctactcaaggaaaagcagatctgggagatgaggggaggaagcgggggggaaattgaagacattaagcctctagatccagttattcctgaagtcaatgaagttcacccatagaaggtccctgttaaaaaaccaatatcaccatcacctcccccttctcttcctgtctccctctttttccttcttcttcacccctgcctcattctcttcctcctcttccctctcctcctcctcctcttctttcttttctagtatgaggtgggtttgggggacttacaactgcaagaacacaaacctgccagccaggaagccttacctggcagagctctctgagtgactaaagcctggtacttgcaggccccaagaagacctacccaggttgaacagagtcctaagaggttacttctatctagcagcttcccactggtctgcttctgtacctaaatggccaccatccgaaccactgtgggaggcaaattgtatctccagaagaccccatgatggtgtcaagttgttggctggacagttcctgtgagagaagccatgtgcgtgacattgttgatcagttgagtctgcgccgtgtcactgtgcagttcctcctgcactcccagcagtctgggagcagagctcaccaccatggaggctggaggctccttggctccaagcaaatagccaacaagggaaaggaggagaaaacggaacccagagagggttgctatggaaaggctatagacaggagctgtggccttcagtagagggtcacagctagtgctcaaagacccgcagagaaacagcctacatgttccaacctcgctccattcgtgctctctgtcctgctggtgacttccatgaatggaacctaactggaagccaggatgcaaagagtccatgaatgcagcctgcataagttagccctctaggacagtgggcagagaagggtggaaagtgagtctggagagacaagtggaaagcatctagtgctctaccccagggcctttgcacttgctcctcccttcaccagcaaacttttttttaaagcttgcttgcatttatcttttcccccttccccaatttttatttgtttatttttcatacaaatatatggggtacaagtgcaattttgttacatgcatagattgcaaagtggtcaggccaggacttttaaggtacccaaaagcattgtacaattacccattaagtaatttctcatcatccacctcctttaccagaaaactcttctttcccaaaatcctcatgtcttacttcctcaaatatcactttctcagtatgccttctcctatagttttgtttttgtttttttgagacagtctcaccgggtttgcagtggcatgatctcagctcactgcaacctctgcctcctgggttcaagcaattctcctgcctcagcctcccgagtagctgggattacaggtgcccaccaccatgctcagctaatttttgtatttttagtagagacgggatttcaccatgttggccagccttgtctcgaactcctgacctcaggtgatccaccctcctcggcctcccaaagtgctgggattacaggtgtgagtcaccacgcccagactctcatatagtttggatgtttgtctcctccaaatctcacgttgaaatgtaatccccaatgttggaggtgggggctggtgggaggtgattgggtcatggggtcggatcctcataaatggtttagcaccatccccttggtgctaagtgagttctcaccctaagttcatgtgagatccgattatttaaaagtatgtggcacctccccctacccttgttcctgctttctcttgcacccgctttgccttctgggatgattgtaaggttcctgaggcccgcaccggaagcagatgctgcatccatgctggtactgcctccagaaccatgagccaattacacctcttttctttatcaattacccagtctcaggtattccttaccttccttggccatcccacctaaaactgttaccctgactcatagtttctatccttctctctacttaattttatagcacttagagactccaaacatactgtatattttgcgtatttatgttgcagataggctatatccctcaactaaaatgtaagctccaacagagcaggcactttgatctcttgtgatcaatgcttcacgaatagcatctagcacatagcagatgctaaatagatagttgttaaataattgaatttaagcgtggcaggcccccaagtgggaaaatacacgagatttgaagtggcagaggccttgtgtgagagtctggttcctggtaggcagggcaccaagtccaagacagtcagctgaatggatcccctcagctcagatgcttttttaatgcctgctagatgggcgttaatcattttgctcccaggagataggtgatcaggtacactcctgccttaagaagttcatcttggtctggcctagcttagcatcctgccttgtgccagcttcactctatccaagaccaacatctgggctgggtctcactgccaaccacatggccatgatcctcagactttcccaacctcctccaattttaaagtctccaggttcctcccaacaggatggcttctctctacacaccccagatacaccacagtaatcaggggagatcaggctctgcagctgctctcagcaggattgggacaaaaatcctccatgttttggtgggtggggaagggctatgaagatccagcctccgggatgctgcccagagaaagctggggagcaggtggcccagagcttctggactgaccctagatggagggcagtggagatgaaaggagatcttctttttcctttctcttctgcctttaataacatcaaatatgattaatttaggtccatattatagatgagaatttgactaattcttctcaggttagcagtttattattgcacaaatgtttcccaagccaatgaattatgaaataagccttgcaggggaatgtttgagctactgaagggcatgttcggcatgatcagaggaacactctgtttccaagttagtaatgcctctttacatataaacactgatgtttgttgataatgaacattcatgtcctcaatcaaagcagagcctctggggacacttctctatcagccaagtgctcctagaagtgttccgccctggttagaatgtgcgccccaattttcatgtgttggaaacataatcccaaaattcatatgttgattaaaggtagtgagggctttgggaagtaattaagattagataaggtcatcaaggtggtactcccatgatgagactggaggctttataagaagaggaagagagacctgagctgacaccacactcttgccctcttaccatgtaatgtccccctctgtgttttggtgttttggcttgttttgtttgtttgtttgtttgtttttgagattgagcctcactctgtcactcaggctggagtgcaatggtgtgatctcggctcactacaaccaccacctcccaggttcaagtgattctcttgcctcagcctcccaaatagctgggattacaggcatgcaccaccacacccggctaatttttgcatttattcagtagagacggggatttcaccatattggccaggctggtctggaactcctgatctcaagtaatccacctacctcaacctcccaaagtgctgggattacaggtgtgagccaccacgcctgacctagtcagtggtatcctgttatagcaaccgagaacagactgagacatacatgctcccatggtctttgccaaggaggtagcctattcagatccactggggtgtccagccagtgagggccactcagccaacttacgaatccttttccaactcaactgctccatcacttgtagacacccaatagcccttcctcccaatcttgatttttcctccttagcactcaccgctcttgttttgtctaggaaccctccatcttcctttctagaactatgtgctttaggggaagctgaccccagccccagcctcacagagtgggtcttggctgatctgaaccagtcattgttgccctggctgtcttgctggtgatttaattaaacatagatctgtgacatgattctggccaatgatatgggaaaaaatctgctgggacaacttttaggagaagctttcttcactcttcaaagagacacatgagaatgaaactagacccctgtctctcaccatatacataaatcaaaaccaaaatggattaaaggcttcaatctaagaccacaaactatgaaattactaaaaggaagcattgggaaaactctccaggactggacaaaaattcctcttttctttttttctttcttttttttttttttttttttttttgtagaggcacagtctcaactatgctacccaggctggtctcaaacttctgggctcaagctatcctcctgcctaggtctcacaaagtgctggaaatcataggcatgagccaccttgcctggcccggacaaagatgtcttgagtgatatcttacaagtacaggctgaagcaaaaatggacaaatgagatctcatcaagttaaaaggcttctgcacagcaaaggaaacaatcaacaaagtgaagagacaatccacagaatgggagaaaatatttgcaaactacccatctgacatgggattaataactggaatatataaggagctcaaacaactcaacaggaaaaagtctaataatctggcttttaaatttaatctggcaaaagatctgaatagacatttctcaaaagaagaaatacaaatggcaagcaagtatatgaaaaggtgcttaacatcattgatcagagaaatgcaaatcaaaactacaatgagatatcctctcaccagttaagatggcttttgtccaaaagacaggcaatgacaaatgctggagaggatgtggaggaaaggggaccttcgtacactgttgaaaatgtaaatcagtgtaaacactacaaagaacagtttggaggttcctcaataaactaaaaatagagctaccatacgatccagcaatcccactgttacgtatacacccaaagaaaggaaatcagtatgtcaaagagatatttgcactcccatgttgactgcggcattgttcacaaaagttaagatttggaagcaacctaagtgtccaccaacagatgaataggtaaagaaaatatagtgcatatacacaatggagtgctattcagctgtaaaaagaatgagatccggccgggcgcagtggctcacgccagtaatcccagcactttggaaggcgtaggagggcggatcatgaggtcaggagatagagaccatcctggctaacacggtgaaaccccgtctctactaaaaatacagaatattagccgggcatggtggcgggcacctgtagtcccagctactcaggaggctgaggcagaagaatggcgtgaacccgggaggcggagcttgcagtgagccgagaccacaccactgcactccagcctgggcgacagagcgagactccgtctcaaaaaaaaaaaaaaaaaaccaatgagatcctgtcatttgcagcaacacggatggaactggaggtcattatgttgagtcaaataagccaggcacggggagacaaacttcacatgttctcacttatttgagagctgaaaattaaaacagttgaactcatggagataggagaatgatggttactagaggctgggaagggtagtgggagcagggagggagtagggatgattaatgggtacaaaatatagttagaaagaatgaataagatctagtatttgatggcacaacaagatggctacagtcaatgtattagtccgttttcactgttgataaagacatagccgagactgggcaatttacaaaagaaagaggtttaatggacttacagttccgcgtgggtggggaggcctcacaatcatggcagaagatgaaaggcacatctcacatggtggcagacaagagaagacagcttgtgcagggaaattcccctttttaaaaccaccagatctcatgagacttattcactatcacgagaacagcacaggaaacacctgcccccatgattcaattacctcccactgggtccctcccacagcatgtgggaattcaagatgagatttaagtggggacacagccaaaccatattagtcaatgaaaatttattgtacattattaaataactgaaagaatagatgtctgtaacacaaaggaaggataaatgtttgagatgatggatacctcatttaacccgatgtggttattacacattgtatgcctgtatcaaaatatttaatgtgccccataaacatatacacctactatgtacccacaaaaattaaaaattaaaattaggctggacacggtggctcacgcctgtaatcccagcactttgggaggcccaggtggggttatcacttgaggtcaggaggtcaagaccagcctggccaacatagtgaaaccttgtctctactaaaaagacaaaagttaaccaggagtggtggcatgcacctgtaatcccagctacttgggaagctgagacatgagagtcacttgaacccaggaggcagaggttacagtgagccaagatcgtactactgcactccagcctgggtgacagtgagacttcatcttcaaaaaataataataataataggctgggtgctattgctcacgcctgtagtcccagcactttgggaggctgaggcgggcagatcacgaggtcaggagatcaagaccatcctggctaacacagtgaaaccctgtctctactaaaaatacaaaaaaattagccgggcatggtggcaggcatctgtagtcccagctacttgggaggctgaggcaggagaatggcatgaacccaggaggcagagcttgcagtgagccgagatcgcgccactgcactccagcctgggcgacagagtgagactccatctcaaaaataataataataataataataaaataaattaaattaaataattgcaaggtgtggggagtttttctgaaagggggataagtggcaagagatacactctagtctctctggcctttgtcaggtgtggatgatgtgatggccagagctaccgcagccatcttgtgaccacaagggagccagcgtggggggaagctgcattcaaagattagcagtgcaaaaatgcagaaagatcctgcatttttcaggatcctggtaataaacagaggatccactcaaactggattattagaagaattcaataagggggctatttacaaaagtgcaggcagagcatagagaaactaacccaggatagtgtagtaccaatggactagtaacggaggggagccctcaccaccttgggcctgaaggagcaaggggcaggaacccagagagacactataaggagaggagagctgcctagcaggtgtcttcacagacagggtctggaggggaacaaccccaaactcattcttctcctacccgcccatcttatgccagtgccttccattggctgaacccaacaagaagccagtgggcggggagcccatggacaatatgcagaggtcatcctcccagaacacagagactcgcagagtgatctagaggacaaaggattttcagcactacccgggcctgcaattatctttttcatctgtttgcctgcatattggcggtctcctccctgaaggcaggaactgccttactgctgtaagtttcctcctagaacagcggatggctgcacaacttacgctcaaagaatatggttgagcacccactatgcagcaggcactgtactagaaatcaaatgaagccgggtgtggtggctcacgactatgatcccagcaatttgggaggcttaggcaggaggattgcttgagcccaggagtttaagactagcctgggcaacatgatgagaccctggatctacaagaattttttaaaattagccaggcatggtggtgtgtgcctgtggtcccagctatgcaagagactgaaggggaggattgcttgagcccgggaggtcgaggctgcagtgagccatgatggtgccactatacgccagcctgggcaacagagcaagactctccaaaaaaaaaaaatcaaatgaataaaacatagcgtgcctcagttgttcacaagctggagagggagagtaaaaccaaagcaatatggcatcttggtgtcataccaggagagagacatgcccaaggaaggaggctctgaccagagtagggcctggaggaggtgggcctggtaccaagtgttgaaggacttgttttaatggagaggtgaggatgctttgtcattaatgcatcataatattgcagtatgagtaagtatctctaacccaaaagcaatgcatttccttgagggtgtttgttgaatggggaagaagtggttggaaggaaggttgggtgttccaaacagagggaacatcatgtgtgcatgcagaaagacagaaaactagagaaattgtccccactggctggtgggaaaattgtgtgaggaggaagggatgggaaatgaggtgagagaagagtaggaactggctcacatgttgagctgaggagttcaagctttattctgaatgcctgaagaaattgataagggattttgattagagatctgacatgctcagatttgcaacttcagagacttcacttgagtggcagcgtggagtgtgtggattggaaggatgagggagcaggaagccttagagctttgtgtggctacttaaatttaaaattaggccaggcgcagtggctcacacctgtaatcccaacactttggaagaccaagatgggcttgttgcttgagcccaagagttcgagaccagcctgggcaacatggtgaaactccatctctacaaaaaaatacaaaaaattagctggatgtggtggcatgcatctgtattcccagctatttgggaggctgagatgggagaatcacctgagcccatgaggtcaaggttgcagtgagccaaggctgtgccactgtactccagcctgagcaacagagtgagacccttttttaaaaacaaaacgaaaaaactagtattcacctcacagggtggctataaagctaaaacaaggatggttcgtgttaaccatgtagcacagagcttggggcatagtaggtgctcaataaatcttaatgcattattccttgcaatttccataaaaccaatgcaggaaatgcccccaagcagagtcttcctaaagttcttgggcaggtgagcattcttacttgtgaacactaattgattcaataaatgtttttctgaataggtgttcctcagtaactgtggggaattggttccaggacctccccactagccatggataccaaaatctatggatgccaaagtccctgatatacaatggcataaaatttgcatataatctttgcatagtatttgcatataatctatactttaaatcatctccagattacttgtagtatctaatacaacataagtgctatatacagagttgttggccgggcgcagtggctcatgcctgtaatcccagcactttgggacaccaaggcaggaagatcacctgaggtcgggagtttaagaccagcctgagcaacatggagaaaccccatctttactaaaaatacaaaattagccgggcatggtggcgcatgcctgtaatcccagctactagggagactgaggtaggagaattgcttgaacccgggaggcggaggttgcagtgagccaagactgtgccattgcactccagccttggaaacaagagcaagactccatctcaaaaaaaaaaaaaaaaaagatttgttagttatactatattatttagggaataatggcaagaaaagtaagtttgtacatgttcagtaccgatgcaaccatccatcttttttccgaatattttccatctgtggttggttgaatccatggaacctacagatacgagggccaactgtgtggctgcatgccagcccctgcgttggagactagagataggaagaaaggcagaagctgccttgaccttcaaggagctcaaagtccagaggggcaacggtgttacggatgctgctaaggagggcagtatggaggctgtgggaacttaactgcgggggagctgagactcagacagtgtggtgacagctgagcagggtataaaatgatgagccaaagtggccggggaatgcagggtggggagaaggtttcaagcaaagggatcagctttggagaaagacagtaaaggtgggggcaagggtgacatggggggcaacagagccagagagtgaacagaaactgctgctgaagcctttgggtgctaagcaaaagagttggttttatcctgaaatctctggggaatattgaagcacttttaaaagggaagtagtcaacatacctccagagtggctcaaatgaaaaagatcaaaaatatccagtggtggccaggtgtggtggctcatgcctataatcccagcactttgggaggctgaagtaggtggatcatctgaggtcaggagttcaagaccagcctggccaacatggtgaaactctgtccctcctaaagatacaaaaattagctgggcatggtggtgggtgcctgtaatcccagctactcggaaggctgaggcaggagaatcatttgaacttgggaggcggaggctgcagtgagcagagattgtgccactgcactccagactgggtgacagagcgagactccatcagaaagaaagagagagagagagagaaagaaagaaagaaagaaagaaagaaagaaagaaagaaagaaagaaagaaagaaagaaaaaaagaaggaaagaaagaaagaaagagggagggagggaggaagggagggaaggagggaaggaaggaaggaaggaaggaaggaaggaaggaaggaaggaaggaaggaagaaagaaagaaaatatccagtggtggtgaggatgagaagcagctggagcctcatacacaccgggtgggggtataaactggttcaactgcttaggaaagttggagtttttgtttgtttgtttgtttgtttgtttgtgagacagggtctcactctgtcacccaggttggagtgcagtggcactatctcggctcactgcaacctcctccgcctcccgaattcaaacgattcttgtgtgtcaacctctcgagtagctgggactacaggtgcacaccaccacacccagctaatttttgtatttttagtagagacaacgttttgccatgtttgcctggctggtctcaaactcctgagctcaagcgatctgcctgccttggcctcccaaagtgctgggattacaggtgtgaaccattgcacccagccaggaaagttgtttggtagaatatattactgctggacattcacctatcctatgaactagcaattccagcctgagcagcaaacatgcattcaaaagcaggttcgagaatgctcctggatgggcacggtggctcacgccggtaatcccagcactttgggaggccaaggaggacagatcacctgagttgggagtttgagaccagcctgaccaacatggagaaaccccatctctactaaaaatacaaaattagctgggcatggtagcctgtaatctcagctactcaggaggcttaggcaagagaatcgcttgaaccgggaaggcagatgtggtgagccgagatcacgccatcgcactccagcctgggcaacaagagctaaactctgtctcaaaagaaaaaaaaaagatgctcctgacagcagggctcatcttagcccaacagaggaagcaaccgaagtatcaatcaacagttgaatgaatgaataaggtgttgggtattcatattataatggaataccgtgcagcaatgagaatgaactataactatgcccaacatcatgaatgagtctcataaaaaaagaatgttaagtaacagaaaccagaaaccagacacaagattatataccgcccactgaaatgtatacttaaaatggttaaaatggtaaattaaaattttttttaaaatagagatggggtctcactatgttgcccaggctggtcttgaactcctgggcttaagcgatcctcccacctcagcctcccaagtgctagggttacaggtgtgagccaccatgcctggccctatagtgttaaatgttatgttatgtatattatttcaccacaaccaaaaaagtgtaggtgggggaccatagaactgtacaacacaaagtgcatcttaatttaaactatggtcgtcggttaataataatgtatcagaggctgggcgtggtggctcacacctgtaatctcaacactttgggaggccgaggtgggcagatcacctgaggtcaggagtttgagaccaacctggccaacacagtgaaaccccgtctatactaaaaatacaaaaattagccgagcatggtggtgtgtgcctgtaatcctagctactcaggaggctgaggcaccagaatcgcttgaatctgggaggaagaggttgcagtgagctgagattgtaccaccgcacttcagcctgggcaacagaacaaaactttgtctctctttattttattttattattttttttgagacgagtcttgctctatggcgcaggctggagtgcagtggcgcgatcttggctcactgcaacctccacctctggggttcaaaggattctcctgcctcagcctcctgagtagctgggactacaggcatgcgccaccatggtcggctaatttttttgtatttttagtagagatggggttttatcatgttggccaggctggtccagaactcctgacctcaagtgatccgcccacatcagcctcccaaagtgctgagattacagatgtgagcctccacaccaggcctgagactctgtctcaaaacaacaacaacaacaaccagaatgtatcaatattcatccacgaattgtaacaaatatattacaccactgcaagatgttaataataggggaaactgcagagtgggggtggtaaatggccacttttacctccctcatcatactttccactcaatttttctgtgaaccaaagactgctctaaaaaaatctattagctttttaaaattccttggctcccctccaaaaagtgtacatatgacatgatctcatttatgtaaaatacaacaagcaaaacaaatccatgcaatagatgttggggtcatgggtacccttgagaaaggaacacaacgggacttcttggatgcttatgatgtctcttgattagagctggttatatgtgtgtttgttaagtttgcaaaaattcatcaagctacacatgatcgagctatacatgacatatgcacttttccatttatttatttatttttgagacagaatcttgctctgtcacccaggctggagtgcagtggtgcgatcttggctcaccgcaacctccgcctctcggattcaagcaattgtcatgccccagcttcccgagtagctggaattacaggtgtgcaccatcacgcccagctaatttttttttgtatttttagtagagatgaggtttcactatgttggccaggctggtcttgaactcctggcctcactcaagtgatcctcccacctcggcctcccaaagtgctagaattacaggtgtgagtcaccggtcccagctgacatatgcacttttctatattgtatcctgtaatttaatttttttaagttttaagaaaacattaaaaataaaaagataaatagtctgtcatacaggagaatttcaaatagtttatggagataatcccccctcaaggagaaggagcgtaatcccccactccttcggtgtgggctgtgcatagtgacttccttccaaaaggtacagtatggaaaggtgggaaaggagtaactttacagtgaagagacctgacacgcactaccttagccaggtgatcaaggtcaacatccacatctgtaagtcacattgataggatgtaaccctgatatgatgtgacgagaatggcacctaacctccaaggtcttcccaccaacaaaccataaccccaggcttaccatgagaagaaaaacatcaggcacattccaatagtgggcatcctacaaaatgtccaaccagtactcctgaaaattgtcaaggtcatcaaaaacaaggatatcctgagaaactgtcacagccaagaggaatccaaagagacgtgatgactaaatgtcatgtgatatccaatgggtcctggaacaggaaaaggacattaggtaaaacgcaaggaaatctaagtaaaccatgaactttagttaattagagagacagacagacagagagaaagaaagagtccattttctataaaaccgagcctaacctcaaaccttgacctttttcattgagtcatctgaacccaatggagatatagacaggaaacaactttcctcttctcccattcatggccttcaaacatgctctgtttctctattggattccccatccatctgccttggcatcttcacaggttgatcccacagttttctcattttcaggaataaaagcccactccagtctaaatcaaaacttccctctcacatccatgccgggcacagtggctcacacctgtaatcccagcagtttgggaggccaaggcagaaggattgcttgggcccagaagttcaagaccaacctgggcaacatggcaagacctcctctctacaaaaaaatgtttaaaaataaaaaaattagccaggcatggtgcacacacctgtgattgtggtcccagctactcaggaggctgaggcaagaggattgtttgagctcaggaggtcgaggctgcagtgagccatgattgtggcacatgaaccccaacctgggtgacagagcaagactctgtatctaaaaaaaaaaaaaaaagatagcaaacttccttttcacatccaatttaaggcttgtcctcctcctcctcttagatctgactgagatctgggtccatattaaagactcctttagtacaacaaacaccatatatcctcacgtaagtccatgaatatctgacatttctcatatctactttctctcgatttattgatagataggtatacattgttttaattttatgggtacatagtaggtgtatatatgtatggggtacatgaaatgttttgatacaggcatgcaatatgaaataagcattcatggagaatggagtatccatcccctcaagcaaggataaacctttgagttacaaacaatccaattacactctttaaaggtgtacattttttttttttttgagacggagtctcactctgtcgcccaggctggagtggagtggcacgatcttggctcactgcagcctccacctcccaagttcaagccattctcctgcctcagcctcccgagtagctgggatcacaggcacatgccaccatgcctggctaatttttgtatttttagtagagacggagtttcaccaggttggccaggctggtcttgaacacctgatctcaggtgatccgcccatctcggcctctcaaagtgctgggattacaggtgcgagccatcgcgcctggcctagaggtgtacattttttaacagaaccattcaaaaggaggttgtggggatcatgacacttccatgctacagcattaatctcctaagaataaggatacactcccacataccatgacactctgttcacacctaaaaaaatttacatttattccagaatatcatctaatctccagtccgtgcttacatgtccccaattgtccccaaaacatcttttatagatttttttaaaattttgtttaaatgccatatccaatcgatatggcaatcaaatgcaaatccatattgcatttggttatgtctcttagtctttttgcataaggggggcctctctttaggatgcaaaatctttatcatctcttcttttccacttggggacttgggctgaaaatcaggagtggctggaacacgcccatttactgtttggttttgcaggttgttggagggtactacagaagaacatccctctggagaggggccgtgagcctggttggcctagactgagtgccctggcagagctcttcctcatgtgtgcagtgggaaagaagcccagatcagtccaaaggcctaacccccactcccagaccctaccctactcttcagagaaataggctccctaccctgaaccctaaagacagctgtaccttcatccccagggacccagcaccccttctggcctatccccaaagagtcaccctgggtcttaggtagtaggtggagctgagggataatggcccaaggccaagagttgatccttccaactttgttcagtgatccagctttcatatcaggtgatcaggacaaccaggccaatctgatagggggcggtgtttataaaaaggccactcacctagagccagaagctccacaccagccattacaaccctgccaatctcaagcacctgcctctacaggtacctttcttgggaccaatttacaatctctgggatccccaactatagaacctggaagctagtggggacagaaagacggggagcctgggctaggtgtaggggtcctgagttccgggctttgctacccagctcttgacttctgtttcccgattttaaatgagcagtttggactaagccatttttaaggagagcgatggggagggcttcccccttagcacaagggcagccctggccctggctgaagcccaaccccaacctccaagactgtgagaggatggggactcatccctggaggaggtgcccctcctggtattgataaagaatgccctggggagggggcatcacaggctatttgaaccagccctgggaccttggccacctcagtgtcactgggtagggggaactcctggtcccttgggtatatggaaggtatcagcagaaagccagcactggcagggactctttggtacaatacccagcatgcatgctgtgccaggggctgacaagggtgctgtccttggcttccccattttggagtggtcacttgcctctactccagccccagaagtggaaactgagatgatgtgtggaggagagagccagcgttcatgttgggaatcttgaggctcctttccagctctcagattctgtgatgctcaaagggtgagctctgtgggcccaggacgcatggtagatggagcttagtctttctggtatccagctgggagccaagcacagaacacgcatcagtgtttatcaaatgactgaggaaatgaatgaatgaatgtctccatctcaaccctcagcctggtccctccttttttccctgcagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaaggtgagcccggggtgcaggtggcaaggggcaccttgcagggcctgggtgcagcccctccctcccagctccagcatgcccacacagctgctgtgttgccaaggcctaggaaggctctggacacctcagaccagctgtgtgacctggagccgactcttccccttctctgggcctcagtttcctcatccttgaagcccccttctcagggctcctcaaagcccccaagaaaaaagccctggaaatggggccctagcagagtcctgcaatgtggggggcctatgagtgagaaagctttcattctgcagaaacctaaaccccaacagaggctaatccccagctctggtgtcacgttgcttccctgtgttcacactaaccttttccttctttgaaattggacccctggtgttattgggaggaagggtcaatggggcataaaatgacactttaagccatacccagggctgctaccagctcctgctgcaagctgcaaccccctgcctagagaccaagttgggaggataggggggtacccagccaccaggtacaggccaggggagtggagcaacgttcagcctttgaccttggaagtgccagaggtgcccctaagcttgtgccccctcagaacagtgtccgggacatcacgggtgccctgttcaagcacagcaagaaggggcctagagccagcggcaacctcatcccacaggagaagattgtcaaccttgtcaatgacatctttggagcaggtaggaaccagaaccttgcccctccatccaacaatgcctgctgttcacccacagccttgcccagcccctcagtccatgaaataacccaccaaccctacaccagatggtacaacatactgagatctggcttgggatcagggtttgagcctgggctatgccaccaattcccagtggagaaacagcaaagtccttctcctcccctaggcttcagtttccccatctgaacaataaggtgttctctggcctgtaagtctaggcccctataattccagcagctaattctgaaacctgtatctcaagtttatgttgaagagacccagcctctgtcttcaggaaactcacaggctagggccagagaaagctaatgctggatacatacatagcagatacttgggaaatgatggtttccttgtttctgtcttccttctttcctcaccttacactacacggttcaggatttgacacagtcaccacagccatctcctggagcctcatgtaccttgtgaccaagcctgagatacagaggaagatccagaaggagctgggtacatgggggcccccaaccctatagccaggagaagccttgagacccaggttgtttgttcagtctacaaacacctgttatgtgcctgctgtgtgcaagccctgggcacacagtagtgcctgcccttgcctagaagatgtgggaggttagtggggtcgcagacttgtgaatagacagtcttacataagagtgacatggggtataagaggggataattcatggggcagttagggcagcccctgagctctgcttgtcctctgtgttctacagacactgtgattggcagggagcggcggccccggctctctgacagaccccagctgccctacttggaggccttcatcctggagaccttccgacactcctccttcttgcccttcaccatcccccacaggtgaggcctgccggttctgccctcccacctctaaagtgcttgccatgttttctcttcctggcttctcagccctggccctggctcagcatctccttcccgacctcgttccccacagatcccggcctcagtctgcccccatccagtccaaacataatctaacccccagctctcaggagaaagttccacttgtgatctcagcgctcattcccctctgttcatattccctccctcccagtgccctctgtgccagtcaggtcggcctcaccctcacaagcatgaccctattggcctccaatcttgctaacgctgaaccttctgcctggaataccttctagcctcttctctgaccaccagaatcctacccttgctcaaagtcaatgccgacacgagcttcctctccccagaagccttttgactcatccagctggcacagcttcattcctgatgtcttataggacttacagccatcagcccttgatcatgccctggaattttaacaatgtcaagagagttagtgagcatttacttctacccaaacgttgttctagttattcctgcagtaagaggcctgaatccccagccaggctagaaattccccggggctgccccaggctgcctgctgcttttttttttttttttttttttttcatagaaaatagaaaaacatttatctgaaattgcctgcttcttggctccagagaacagccaagtgcgcagccaggcgcaaagagaagtttagtaaatacttgctgaagttaaagaacaggacgcaaggaagagggaggatgtttctacctcttccctgttcctcccctcccctcccagtgtagggatggagatggcggtgggcaggctgtctggatggggtggaggtaggagcaacacatgccccagctttccagccctgagcctcacagtgccctcttccctcctcagcacaacaagggacacaacgctgaatggcttctacatccccaagaaatgctgtgtcttcgtaaaccagtggcaggtcaaccatgacccgtgagtacatacccctcacgaaaaaatgtgtgcaggttcagcagtcaggaaggctgtttgtccctgctaggaactgtttatataatgaaaggaggggacctcaattgctatagtctgctctaagtgacgatatttacaaaagtttcacaaactttagtgcacaggaatcaactaggatggccaggcgcagtggctcaagcctataatcccagcagtttgggaggccgaggcaggcagatcacttgaggtcaggagtttgagaccagcctgggcaacatggtgaaaccctatctctactaaaaatacaaaacaaaaattagccggacatggtggtgcgcctataatcccagctactccagaggctgaggcaggagaattgcttgaactctggaggtagaggctgcagtgagccgagatcgctccactgcactccagcctgggtgacggagtgagactctgcctcaaaaaaaaaaaaaaaaaatcaaccaagacgtttgttacaggtgatggttcccccaggattctactgtggtatctaaggtggggtacctcaggcgattctgatgtgaatggctcagagacctctctttggaaagccccactttagtgtataggtagggggaccatatatataatttaccatccacactgggacatttgagtgtgaaaatgctatcaatgtttatgctagtcatcattactccaaaacaataaacataagccaggacatactgttgaggccccttaggaggcatattttgagtaggatgaagaaacgtatgtctttctttcttcctttcactttaatttttaaatagagacaaggtcttcctatgtggtccaggctggttttgaactcctgggttcaagggatcttcctgcctcagcctcccaaagtgctagggttacgggtgtaagccaccaaacccagcctgtttttcttcttttaatttcttttagataaagcattatttaaagtaaattaatattaaaaggcactatctttaaggctggtcattttagagagagctttgtaaaagaaataagcatcaggccaggtgtggtgactcatgcctgtaaccccagcactttgggagtccgaggaaggtggatcgcttgagctcatgagtctgagaccagtgaaaccccgtctctgcaaaaaaaaaaaaaaaaaaaaatacaaaaattagccggatatggtgcctgtagtcccagctacacgggaggctcaggtgggtggttggcttgagctggggaggcagagagagtgcagtgagctgagatcgcaccactgtactccagcctgggtgataggagccggagggtgtctcaaaaaaaaaaaaagaaagaaaagaaaaagaaataagcatcaaagttcagtttggttccttcccacctacccttcattgctttcaaagtgccctcacacttgtgttctcaacagaagtctccctcccccaggcacctcctcccagggcctctccagccctgaggtcccatctcctctgttcctcttgcagagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaactgaagaagacaccaccattctgaggccagggagcgagtgggggccagccacggggactcagcccttgtttctcttcctttctttttttaaaaaatagcagctttagccaagtgcagggcctgtaatcccagcattttaggaggccaaggttggaggatcatttgagcccaggaattggaaagcagcctggccaacatagtgggaccctgtctctacaaaaaaaaaatttgccaagagcctgagtgacagagcaagaccccatctcaaaaaaaaaaacaaacaaacaaaaaaaaaaccatatatatacatatatatatagcagctttatggagatataattcttatgccatataattcaccttctttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgttttttttttttttgagacagagtcttcctctgtctcctaagctggagtgcagtggcatcatctcagctcactgcaacctctgcctcccaggttcaagtgcttctccagcctcagcctcccaagtagctgagactacaggcacacaccaccacgcctggctaatttttgtatttttagtagagacgggtttcaccatgttggctagactagtctcaaactcctgacctcaagtgatctgcccgcctcgacctctctcaaagtgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaatggaattacacaatgagtggtcttttgtgactggcttctttcacttagcacaatgttttcaaggcttatgtgtgttgtggtgtgcgtcagtaagctcttggtgcttgagtcctgagactgggtctaggtctgtgctctcttaagtcgttgataggcacctccttcactcctctcctctcctttcatgttgtttgacccaagttttttaacaattgaagggaacaaggagaaagggatccagtctcaggggccaaacccagttgggtggatggggatccctcctgtcccattctcaaaaggcagaacacgtgacttctcacaaggccttgatttcttcattcacagcccgggaggggataagcttcccagaagtgcttaggttatttgaaaaaggcccaggtctcatcaaaggacactatcaagaaattgaaaggaggccaagcacagaggctcacgcctgtaatcccagcactttggaacgccaaggcaggcggatcacttgaggtcaggagtttgagaccagcctggacaacatagtgaaacctcatctctactaaatatacaaaaactagctgaatgtagtggctagcctcagctgctcaggagactgtaatctcagctgatcaggaggctgtaatcccagctactcaggaggctgaggcatgagaatcacttgaactcaggaggcaggggttgcagtgagctgagaccctgctgttgcactccagcctgggctacagagtgagactctgtctcaaaaaaaaaaaaaaaattgaaaagacaacccacagaatgagagaaaatatttgcaaaacatatagctgttgaagcatttatatatagaatatataaagaactcctggccgggcacgatgcctcacccctgtaattccagcacttcgggaggccaaggcaggtggatcatctgaggtcaggagtttgagaccagcctggccaacatggtgaaatcctgtctctactaaaaatacaaaaattagccaggcatggtggcgggcgactgtaatcccagctactcaggaggctgaggctggaaaatcgcttgaacccagggacagagtttgcagtctcactctgtcgcccaggctggagtgcagtggcaccatcttggcttactgcagcctcaacctcccaggctcaatcgatcctcccaccttgggacaacatatgcaggccaccatgcctggctgatttttctaatttttgtagagatggggttttaccatgttgcccaaactggtctcgaactcctgatctcaagtgatccacctgcttcagcctcccaaagtgctggaattacaggcatgagccactgcgccaagccaaaaaaatttttaagagtaaaacctggccaggcacagtggctcacgcctgtaatcctggccctttgggaggccaaggcgggtggatcacttgaggtcaggagttcgagaccagcctggccaacatggtgaaacctcgtctctactaaaaatacaaaaattattcgggagtggtggcacacacctgtaatcccagctacttgggaggctgaggcaggagaatcaaatgaacccaggagatggaggttgcagtgagctgagattgcgccactccactccagcctgggcaacagagggagactctgtctcaaaaaaaaaaaaaggtcgggggcggtggctcacacctgtaatcccagcactttgagagaccgaggtgggtggatcacaaggtcaggagttcaagaccagcttggccaatatggtgaaaccccatctctactaaaaatacaaaaaattagccaggcgtggtggcaggcacctgtaatcccagctactcgggaagctgaggcagagaattgcttgaacctgggaggcggaggttgcagtgagccgagatcacgccactgcactctagcctggcaacagagtgagactccagcttagaaaaaaaaacccatctctactaaaaccacaaaaattagccaggcatggtggcaggtgcctgtattcccagctattctggaggctgaggcaggagaatcgcttgaacaccggaggcagagtttgcagtgagccgagatcacgccattgcactccagcctgggcgacaagagcgaaactttgtcccaaaacaaaaagcaaaacaaaacaaaaaaaacctcccggcaagccgcaagcaggcattgccatactttgccaatctaagaatcagcagggcccagctccctgaggtaatttcaggaccgatctgaggtggctcgatggtcaccatacagccactgccccatctggctcactgtggtctggagatggcttgagcttctcatgcacacctggccaatctttaactggttggcctagagctcccctctggccagagccaaggtaggaggaattggagacttcgccccgctgcttgccattcctgcctcccacagcaggtacgaggcaggtgggaccagcctgttctatcttttcctggtaggccctggacacgcatcatctcaggctattctcacaacaaccacaggagatgggtactgttataccaactttagagatgagaagcctgaggctcaggaagcatgaggagggcatgtgtggtggagagattcaggactgcaccatttgccctataccacctccagggtctcttccctacctgtgtctctccctgagtcaggattgtgggactggaacaggaagcttggaaacactacatgatcaaggaacggcatggagagttagaaagagctcttggccagagggctaggagtcctgcactcaggttccaagtgtgggtgaccttgggccagtcccacccctcacaggcctcgaccccatcttcagccttctgtgaggtcttctccagcaccattagcctgaagttcaggccactagcaatgacccctgctctgccagcctcttgcttaataaggctgtgggcaaatccagtgagtgcctggcaaatttcgaagtgcagtgtacccggtgaggggtgatttttggcaaagatggtggaatgaaagatggtagaatggtgggaaaaaccttgagctgggaatcccacctctgcctggtagggaaaattaagagacttctctagacctccccacctgttcagttcagatccccaactccctttatgtcaagcatctaccaccaaccagataccagatctttcgtttatatcttagtacaggtctttcttgtttgtttgttttttgttgttttaaagagatgagggtctccctctgtccctcaggctggagtacactggcgaatcatagctcactgcggcctcaaactcctggggttcaagcaatatcctcctgcctcagtctctcagtctcctgccaccgtgccgagctagttcagcttcttttttttttttttgagatggagtcttgctctgtggcccaggctggagtgcagtggcgcaatcttggctcactgcaagctccacctcctgggttcatgccattctcctgcctcagcctcctcagtagctgggattacaggcgcccaccaccatgcccgcctaatttttttgtattttttagtagagacggggtttcaccggggacggtctcgatctcctgacctcgtgatccgcccgcctcccaaagtgctgggattacaggcgtgagccaccgcgcccagcctagtttcagcttcttgagagaggggtttgattggctcagctcatctttttcagccaggctacacaggtcagagaccacagtcagtcagtggttgggtccccttggagcaatgtttaccctggtaaatagccacaggcaacagagtgagggtcacagggtctaagctacctcagcaagggatccctgcacacaagtcctggaagaaacaatggcacagcggaaagctagcggaacacacaaaagcctccatttgtcacttttctgctctgcccacctctcctcacacccacactacaaagaaaattatctttgctctcatcttttcccgtgactcccaggttgagacctcctaacaacaaattagaaatagctttaacacacaccccattgcaaaccagcttacactgctctaactaaggttggaacactgggtcaggtggtcttgcctggctcttttttccctaagggtgacctccctcccaggattccactcagtccctatgcaaatgaactcagtcactggggtctccctcacccagatctgcccagataaatctcagcctctctctctcttttttttttttaggtggagtcttgctctgtcgcccaggctggagtgcagtggtgcgatctcggctcactgaaacctccgcctcctggattcaagaaattctcctgcctcagcctcccaagtagctgggacgacaggcatgtgccaccatgcccagccaatttttttttttttgagatggagtcgcgctctgtcgcccaggctggagtgcagtggtgcgatctcagctcactgcaagctctgcctcctgggttcacaccattctcctgcgtcagcctcctgagtagctgggactacaggcgcccgccaccacacctggctaattttttgtatttttagtagagacgggatttcaccgtgttagccaggatggtctcgatctcctgacctcgtgatccgcctgcctcggcctcccaaagtgctgggattacaggcgtgagccaccgtgcccggccaatttttgtatttttattagagtatgggattttaccatgttgtccaggctggtctcgaactcctgatctcaggtgatccacccacctcggtctccccaagtgctgcaattataggcatgagccaccatgcccagccaaatctcagtcttaaagtaacttgccccccaaggaaggattttccagttgacaaaggaatctgaggagggtgcagactctctgaaagaatggtagtgagtataccatctgggtgggggaaccaagcagaggctgactagaccagggtttatgcagttcagcgtcagtccatgagcttgccctatatcttatccctatcactggctcctgtccctgagaggggactgccaccagaggtagccataccctgagccaagctccccattctttagtgatccccctcaaaattagttctgagaccctgcattctgtccacccctctgccatgacataacaccaggttcactagagtcctctggagtacagctgcgatggagcctctcaggcagtgcaatggggcggaggggggcacttttgggcaaggagcctgcccgatgcccatcaccctgcactaataagggaagcagactctgctctgcattgagggacctgcactctccctgtgggccctgcagcccagcgggtttttctgggtttaagataacatagtggcataggtgatactcaataggttcccccaggccttcacctctgtatttacccctccaccccaggccagtattaagataattacagggcttgggaaagggaaaagagatgagaccagaggctggctcacagatccagaagaaaatcccagctcacccactaaccttgggcctgtgacataaactttctgagtctagactttctcatctcgcaactggggatgataatcttatcttacaggttgggtgggaggtttaatgagataatgtgtgtaaagtgccaaattacaggtcagggtacaacacacacacacacacacacacacacacacacacacacacacacaccagaaatcctgagaaaggtggactcagggcaagatggacccccgacacacgtgtggcatgtgcagctgtgcacacaccaggcccacacgtgagccagcatttccccaaaccctgcgctctctcactggggtcttgccagggcctgggctcagcccacttccttccactgctccccccacccagaagctggggagggctgggggtggtagcgtgccagggaacaatgggcccccaaccccttcccgcccattgcgtgagaaggagctgccggaaggaaactcacctcccagtgggacaggccgccgcccccctgacgtctgccccagggaagtctggagacccccatgctgctcaaggggcgggcctctgtgcactccaggcctgccacccttgggacatcctgttttcaccacctggactggcttcccccgccccctctttcagagaagatggtcccagaccctctctctggggctgggctgggttccccacaagagtctagggccctgttctcattcatctctgtgtcccccgtgtgtagcctgttccggagtcgtctcgaggaatgctggccaactgcatgagaggctgagggaaaggagccagactaggggtgatcagggacccagcagctgagccagaaaacatgagagagagaagggcccagctcagagtggccaaaacgcctgtgctgcagataggggtgtggtcccagaaatgcctctggagagcacagggcatgctgttgagggctgggggatgctctccccccaaatttttggaacactcagctcagtttcatttgtgtagtgacacttcccttacaggcccgcattcctctctctctctcatacacaatcacactcattccaggggtctcagcagctccaccatcagatgggggctcttaaaggcaggggtcagggaggaggccaggagcagatgaggagctgttcttgcaccgtgcctatccacacttagcaggatagctcagagggtccccaccaggctggctgctgaccagaaactctggacatcaatttccccagctagaaaatatgaagagttggggggcctggctgaaactgaccctgccctgggccttgctgacctggggtggcccagctgaaagtgccagtgggccggcaggggctgggagcaggcgtgggcacgcattttgaaccctagtctcgggtgtgtcgataaggcaacaacagacgtgagtgccagctctcagcgggtgcatgcgcatgggcagatgtggcctggagtggtcaggtggatgcctgtgcgtgagttctccaggtgtcagttcaggtggctcagcacgccagccaggtatgtgcgtgtttgtagccaggcatgtgtttacaggtgtgcctctatctcctgtgccctcagggccaagggagccgctggctcgcgtgtctgagagtccttcttgccgtgagaatcatggaatctcaaagtccccagattagtgcttcctccaaggtgggggctggagtggggtggctggctgggtaatcaggcaggtttgggaagcatgcttctgctcctgctggcgggccatggttacatctgagggctgggagacctggactggtaactctacctccttggacagcagtagtggggggcgggaagctgaggccctgcccagagttttgggggtccacagtgataaaacaagtagctgagcacagttgggcaaatttcagcaaccatcgcacaccagacaggctgcgctctgggtcagtgcctccaccacaaactcggctcactgcaagctctgcctcccaggttcacgccattctcctgcctcagcctcccgagtagctgggactacaggcgcccgccaccacgcccggctaatatttttgtatttttagtagagatggggtttcaccgcgttagccaggatggtctcgatctcctgacctcgtgttctgcccgccttggcctcccaaagtgctgggattacaggcgtgagccaccgcacctggcaattttttgtattttttagtagagacggggtttcaccgtgtttgccaggatggtcttgatctcctgacctggtgatccgcccgccttggcctcccaaagtgctgggattacaggtgtgagccaccacacctggcaaggaattgatttttttaaagtagtatgagagtggagaaagcctttctaagtttgacacaggtccagaagcggcaaaagaaaagactgattccactgcataaaaatcaatcatttctgcattccaaagaatcataaccaagttggaagacacacaaggaacataagccggttggcttccagttctccccttcagtccccctccatcccgtgctctgtgaggggaagctgacctgtggggcttctatccacagactccctggccctctggctcctagacgggttcatagaatggaggctctcacaggagatggggatgtgtcctctgaggcaatcctctccatgcagctctttcccccagtagcattcttcaggcactaccctctcagggcccccaccgttccctgcctaaccccgtgtaataatctctgtattaatccttcctcgaattaaactgtttcctgctggggaccctgaatgatgcacagattaaaggttaatttctttaatatatagagttcctattaaaaaaaaaaaatccaggccgggcgcagtggctcatgcctgtaatcccagcactttgggaggccaaggcgggcggatcacgaggtcaggagttcgagaccagcctggccaatatggtgaaacccccgtctctactaaacatacaaaagttagccgggcgtggtggcacgtgcctgtaatcccaactactcagggggttgaggcaggagaattgcttgaaccagggaggcggaggttgcagtgagctgagatcgcgccactgcactccaggctgggtgacagagcaagactccatgtcaaaaaacaaaaagcaaaaaaaaaaaaaaaaacaacaatccagtaaaaaatagatgaaaaacatgaactgttaacagacacaaatatattttaaaatataaagagatgcttggctgcacctacaatcggcaaactacaattttttttgagacgaagtctcattctgtcgcccaggctggagagcagtggcacaatctcggcccactgtagcctccacctgccaggttcaagcgatcctcccacctcagcctcccaagtagctgggattacaagtatgcatcaccatgcctggctaatatttgtatttttagtagagacagggtttcatcatgttggccaggctggtctccaactcctgacctcaagtgatccacccatcttggcctcccaaagtgctgggattacaggtgtgagccaccatgcctggcatcagtgaactataacttaaaactacaaatataattttttaccaattacattgggaaagatgtatggtgttagcaagggtgctgaaaagttggcattcatatttatcattggtggaagtgaattttagttgaaaagtaaagctttaaacattatgctaagtgaaataagccagttacaaaaacacaaataccgtatggttccacttttgtgaaatacctagaatagtcaaaaccctacagatagacagaacagtggttgcctggggctggggagaagggggaatggggagttagtgtttaatgggtagggtttcaggtttacaagatggaaagggctctggagatggacagtggtgatggctgcacaacattatgagtgcatttaataccactaaactgtgtacttaaaaatggttaagatggaggctgggcacgttggctcacttctgtaattccagcactttgggagtctgaggtgggtggatcacttcaggtcaggagttcaggaccagcctggccaacatggtgaaaaccccatctctactaaaaatataaaaattagccgggcatggtggcgggtgcctgtaaccccagctactcgggaggctgaggtgggaggattgcttgagcctgggaggtagaggttgcagtgagttgagatggctccactgcactccagcctgggcaacagaacgagagcccattaaaaaaaaaaaaaaaaggttggctgggcacagtggctcacacctgtaatctcagcactttggggggctgaggcaggaggatcatctgaggtcaagagttcaagaccagcctggccaacatggtgaaactctgtctctattaaaactacaaaaattagctgggcattgggaggcagaggttgcagtaagcccagatcatgccactgcgctccagcctgggcaacagagcgagactccatctcaaaaaaaaaaaaaatagccaggtatgccgggcgcggtggctcacgcctgtaatcccagcactttgggaggctgaggcgggtggatcacctgaggtcaggagttcgagaccagcctcaacatggagaaaccccgtctctactaaaagcacaaaattagccagacatagtggtgaatgcctgtaatctcagctactcgggaggctgaggcaggagaattgtttgaacccaggaggcggaggctgcagtgagccaagattgtgccattgcactccagcccaggcgaaggagcgagactccatctgaaaaaagaaaagaaaagaaaagaggagggtgggcgcggtgggtcacgcctgtaatcccagcactttgggaggctgaggcgggcggatcacaaggtcaggagttcgagaccagcctggccaatatggtgaaactctgtctctactaaaaatacaaaaattatccgggagtggtggcggatgcctgtagtcccagctactcgggaagctgagacaggagaatcgcttgaacccgggaggcggaggttatagtgagccaagatcgagatcggaccactgcactccagcctgggagatagagcgatactttgcttcaaaaaataaaaaatcaaaaaaaaaaaaaagaggaaaaagagttctaggcagagggaccaacctgtgcaaaggtcctgaggcaggaaaggggttactgtgtgcttgaaggcaaattatcacccctcttaggaaaggcatagcctcacctgtgaaataacccaaatttagagatggagagacagaggttcagagagggaagatggcttcttcaggaaagcagaagagccagaactgaaacctagatctttttggctctatgaactcagaggtatttcaggtatgcatttggggaccttttgcaagattgtaaagaccaggacgggaaggaaagggccaccctccgggggcttttcttttcctgggaagaaggtcttctttccaggaaggtggtgtacgggcaaggctgaaaacccagccttcattctgccaggccagtcccctcctagtccctgctgccccagggctgcagaatcctatcctggctcctgccaggctcccctgcagctgggcaaacaggcagtgggtgggactcggtataatttcctccttgcccgcctggggtctgctaggctctggctgagctctctggcctctgccctgcacccccaacttggagcccaaagggggtcatgggtctttctgccctgtgtccccagggatgcacccgatgagtttgagaaggggctgccttctcacccagagagaggtgaggccatcccctcacccagagaggggctccaggccccactccaagggagagtcagaacttcccggtgcctacaggcgcactgtgctaaaccagtgtgagcatcctgcgctgataatgctacatgcataagctgcggatgcacaggggctcagactcaggggactgtggggagtcctggcagccacatatacatcgggctcacccctgtagcaccccatctagaaaagcccatccagagccagaaggggcttctggggatggttcctggaagggctgggttctgctgttctctgagtgaccaatccacccattctttccagaaatggtcctatcccatctccttcccctccagccgctctcggttccctgccctcatccacccaggatgtcactgggcctgctgcgagtggctgcccggggaaaaggccaggagctctgcaatgagcctgtaatcccagcactttgggaggctgaagtgggtagatacgcactacacacaagccagcaccaggttcctcccacccaggggatgacagaggagctccagctcaccaccgtgcctcaagtcccctgcttaactgtcctatgtgagctcagggccgccctctgggggcttttcttttatttatttatttatttatttatttatttatttatttatactttaagttttagggtacatgtgcacaatgtgcggggctcccttcctcccagcagccatgctgtcacgtgctccttgccccggagaggcaggaatctgtcccgaaatgtcgagctgaaacgcttcctggacgcttgctacaaccgtggtcttcaaattctactaaatttttccagtggcaggattcactgttgaaaggaaagcttcccaccttgcctgttcctcctaaccccaaaaaagtcgggcttgtgatctatggggagaagaatagcccccgccccacacccatctgatgcccaattcttcccaatccatcagcccccagccctgtcctcatgtcaggatctgcccgcgtcactctccccagccaagaactggagccgaaaatgcagtgtaggctgccccctcgtgggcagttagagaaacacatgtttctcatagctgctagcctttacccactgtcttggggaccccaccccaaataaaaaggcaacctaaggaataagcgactttgttttgcaaatacaacttcaagacaagtctcaagtcagtcctatgcagaaattctagagaagccactaagagtggccagaggacagccccccacttcctctcattccccagcctggtcctcatagacccacctggagtagaaattcctcgtgcaggccaggcgtgctggctcacacctataatcccagcactttgggaggctgaggcgagctgatcacatgaggtcaggagttcgaggccagcctggccaacagggtaaaaccccgtctctactaaaactacaaaaaaaaaaaaaaaaaatagccaggtatggtggcaggcacctttaatcccagctactcagtaggctgaggcaggagaatcgcttgaacccaggaggcagaggttgcagtgagccaagatcacgccactacactccaggcagggtgacagagcaagactccatctcaaaaaaacaaaacaaaacaaaaaaaacaccaattcctcatctaactccctgccaggagttcaacttctgttctcatacttttaagaacagagagctcactaccctcaaggctgattcattatattttctgtgctggggcactgggaacactgatggtgcagatccatttgtaacctcctgggactctcacattgctcacttagctggagcaacaggtgagaaaacgagggttgcaggtgtgccaaaggcacagggatgagagcggccagttcttcacggacctacacctccacctgcctcttctcagggatcttatattcaaagggattaaattccaggatcttggagatggctgcagtccagctgcccccttgcttctgctttcacttgagaatcagccgaagttccccgagcacctgctccatgccaggtccctcctggcactttgtcccacttagtccttaaagctcgctgtgatagcgatgtgctaatgcccactgggcagatggggacagaggcgcaggaggtcacttgcccaggatgacacctctagtcatttgcggagttggatctggcctcaagcttgctggtggctcttggagcccatgcagaagtgactggggcaacacatgacactccaacttggcattcccctcaaagggcctggaccaagccaaaagctgcggagaaggctcagggcagactgtgaagtcaggagtttgaccccagcctgctatgtcatgctcctccttcctggccctgcctccacctgtgccctatctctgcctcccacctcaaggtccaggactgttgcaaccagaccctcctaccccaaccatgtccagcaggagatggtccctgcaccagaagcttctgaaggtctacatggagggctggcaggcagaaggcaaacatctcccccaacttgcagcccttcactgccgagcaaacctaggacctggggcctggggtctctgcagctgccatctggtgacctcctcatggggcaggaaaaagagttcaggctctggggtggttctgtaaatcaccctctgtgggtctcccttgccctacagttaagatctagatgctactgttttccttgaaggaagatgatcaaatgagagcaaatgtgcaaacacccagcacacagtaggtgttcaacaaagtgtgccttcctacctgtcctcactttgctcttattactcaggaaaatctgaggatgtcagcaacactgaggccaatccaggatccccaggggccagcgtggtggtggccttcaaatcagggagcagcccacggtagggggccctgtggggtcccagcagccatatgctgatctggctcacccaccccccagcacctcctctagaaaagttattccacagccaaatggggccccttccagctccctgccctcatccacccaggacctgccctgtgatgctcgcaatcgggaacagtcagctctggctccagccctaggtaagcctgggacatggtcctcccaggagccaaacggctcatctttcccagagcagacatgcgcctgctctccaggcgtgcctctgagcctgcccgacagggcagtgtgaccttgcctgcctctctgtcgctctctcattccttccccttgagctctgtgttgtggccaccaggaggcgctgttccccctcagacccgagtagaccaacagcccagcgccaccagagaccagactggattctagattttctctttttttttgagatggagtctcgctctgtcgcccaggctggagtgcagtggcataatctccgctcactgcaacctccacctcctgggttcaagcgattttcctgcctcagtctctgagtagctgggactacaggcgtgcactatcacgcctggctaattttttgtatttttagtagagacagggtttcaccacgttggccaggctggtcttaaactcctgagctcaagtgatccgcccacctcggcctcccaaagtgctgggattacaggcgtgagccaccaagccaggcctgaattctagattctgaaagaggcaggaggcgagtaatcacccagagtgcaagggaagacaatggcctttgtctaattgctgtgaatctggcacttcaaacgcaagacctgacctcatcttcccacccgccatgatgggggtggggtcagggggcaccagtcaggcttctaagtcacaaacaacagagactgacctccagctaacattagcagaaaataaatgccccgctcacaaagacagagaaccaagctgggaatagggcagtcacccagggaaagtaagggctccagtgcggctggaacagggcactgccagcaaacatcatctccctgggccccagtcacacatcctggccctagccggcctgactcatcccaagctttggtcctgtctccccaacatctatcctcactcattcagcaaagcggggggtggaggtgggtgtcagcacccgcgccaggccccacgcaaggggctggctcccagcagcccacctggtgggcctcctcagtgagctgccaaacacactgctggctggtcacttggtggagacaggcattgagagctggctacaccaccagctgcagaggacttggagtcgctgagggctgcaggctgcaggaggcaacctggctgcggggtgagggtgggaatctttaggggataagaactggccccaggctgggcgcggtggctcactcctgtaatcccaacactttgggaggccaacacagacagatcatgaggtcaagagatcgagacgatcccggccaacatggtgaaaccccgtctctactaaaaatacaaaaattagctgggcgtggtggcatgcacctgtagtcccagctactcgggaggatgaggtaggaggattgcttgagcccaggaggcagaggttgcagtgagctgatatcgcaccactgtactccagcctgggtgacagagcaagaccctgtctcagaaaaaaaaaaaaaggatcggccctgggttcggtggctcacaccgtaatcccagcactttgggagggcgaggcaggtggatcacttgaggtcaggatttctcaagaccagcccggccaacatggtgaaaccccatctctactgaaaatacaaaaattagccaggcatagtggcacacgcctgtagtcccagctactcaggaggctaaggcaggagaatcacttgaacctgggagatggagcttgcagggagccaagatcgctctactacactccagcctgggcgacaaagtgagactctgtctcaaaataaaagaaaaaaaagaaaagaaggaactgaccctggctggagggagaggtgactgggacctcccggggctacctcaatgtcaggagagcactcctggagacccaaagcttccagttagggattcaagaagatagactggggcgcgggcaatagggatgcaggcaaggagcttctccttggaacgggagccctgagacccccgggggaaaatctggtcactcacgtattcattcagcacacatttatggctacaggctctgtgccttcccatggagagacagaagaaagggagccagtccctgtcctcacggagctcacctcacccaaacacacactctctagaaggaaattctgggggtcttacgggccaaaaggaaggggcatttccctccaggtcctctggagtcccctgacaaagggccctccaggcctcatccctgactcactggggcttccaaagtctcctccggctcagggagtatctatccctggccccagcccccagcccagttccaccccacccccaatcaggcaaggaggtctttcaaaagctcctctgatctctgacagggacaatgttggcacacaggtttcttcacaggtgtaacacctgggcgggggcatttgcatgggttttgcaaaagctgggcctgaggctcaccagtgcccagttgctctctcttcccagccctcgcagagcagacctcctgctccttctcacctgccccaccttgggccaggtctctaacctttgcactgcagagaaccccagggcctcttttcctgctttcgcccaaagagttcccaggaggaaagccagaacagtgccaactgcggcttccagtcagcaaggcagagcctggggactattgggttcagcacaaaagtgacccctgacagcattgagggagatatgtcagcctgctgtgagcccaggactccaggtgggaaccaggtagctctggctctgcccaattccagctgctccagtgcctggaaggtagtaaacacgccctcaatatttagtgaatggatgaatgagggttttcaattcatcagccattgcgaaactgtaggcctaggaacagacaaaaggcctggccctacccttggaaagcccgactgaacccagcaggggagagccagaactacaaagcctgtttcaggagtgagagaaaaaatattcatctaactgccgtggtgtgaaagtctgccttgtgtcaaagaaccctgctaagcaagcaactttacatcatctcggtttagcataagtcccctgtgacatgggtcctctcagtcccactttagagatgaggaaactgaggctcagaaaggttcagtgacttttgcttaaggtcacaaggctgggatggggtgcagccaggactccaacctggaagactttgtaataaattgagcaagaatgatgtggtggcatcccgggtcccttttcccccagctgggatctggtgactgtgtcctccttaaatccctctttagttttcttatctgcaaatagaagtaataataatatctacattgtaaagagattgggaggatcaaatgaaacttaagacatgtagaatagccaggcaggcccctgtagtcccagctactctgagaggctgaggcagaaggattgcttgagcctagaagctccaaaaccatcctaggcacatagggagaccctttctcaaaaaaaaagtaaacagcagggtgcggtggctcacacctgtaatcccagcactttgggaggccaaggcaggtggatcacttgagctcaggagctccagaccagcctggccaagatggcgaaaccctgtctctactaaaaatacaaaaattagctgggtgtgatggcacgcatgtgcctgtggtcccagctacttgctgggaggctgaggtgggagaatcacttgaacccagggtggggggaggggggtggcagtggaggttgcaggagatgagatcgcaccactgcactacagcctgggcaacagagcaagactctgtctcaaaaacaaacaaacaaaaagacacgtaaaatgcttagaatgatgctagcacatgcaacacctacattagcattgcctattattattattattaattgaaattcatatcacttattcattcaacaaacgtttgagtaccaggattcagcctccagcagccgatcaggacacaaatacgaagtgggtagtcagtgctataatactaagaagtgggccagtgagggacaatagcagaggggaggcttccagccttgggatgtgggaagaggtcatcaaagcttcccgaggacagccagtcaattctccaaccagaagcagaagtaatatttttaacatgcaaatctgatcagctgaggctgtggtgaaccctcaaatagcatgggggcggggccccgatgccctaaggatgaagtccaaagactcccctattccacaggggatcctacaggctctggccatttgcgcctctgcttccaaggctctgaccccatcccatcctggcctgttttccttttgcccaaagctcaatcccttccagttccagggcctctgctcctgttgccccctctgccaggcccccaggcaccacctctcctcctgcagggtctgagtgctcaggtgaggagaggtctctgctccgcactcacactgcacttgcacaatcctctgggaacttgcctcgccttgttgaacacctctgcccccacaagacagaacattccaagaagatagggacccaggaggagggaatcgtgtgcgtgggggaggcgctgggacagcctgcagggatcccaggcaccttggcgaactcttgtcatagacttggctctggatctgccctctctagggagatatcaaaccaggaagcccaggacccaaaacctttgcgatcaggggtctgccagttaacccctgagtgctggctgcctcaggccccgagggtggggtcctccagttcccagtggcctctcagttgggtcaccaccacaccactcaagccaccaagccaacaaatcaagacttctaccatcatcgcgacgggaaacaaaaactaacttctcaggaaatcctcttggagcaaactggtgcagtggagagagctgaccttggtctgacatgaaaagcggttgtgcatagtaagtgctcaataaatattagctgctattatcaatgataataataaagtacctggcacatagtaggtgttcagtaaatgatagttctctggtcccagggggacagaaattagaggcagtcagcagcccctccccaccttactcccaaggtcctccacttgtacacagggattcagacctatggatcaccaaatccaaacccttcagttgctaggtagggaaacaggcctagaggagaaggactggcccaaagtaagaagcagtgtcggccggacgcggtggctcacacctgtaatcccaatactttgggaggccaaggcgggcggatcacaagttcaggagttcaagaccagcctggccaatatggtaaaaccccatctctactaaaaatacaaaaattagccgggtgtggtggtggcgcctgtaatcccagctactcgggaggctgaggcaggagaattgcttggacctgggaggcagaggttgcagtgagccgagatcacaccatgcactccagactgggcgacaaagcgagactccatctcaaaaaaaaaaaaaaaagaagcagtgtctgtccctagaacctgggtctcctgggccaatgcctcatcctcataataaactttccagccttaggagggaggttttcagtgcctagattcaggcagacatgtttcctccaaaggacagctttggaaggatgggagctcaggccttctcaggagggcgagaggggttattgggaaggccaaggtttatctctgcaggaggaagtctcagctgcttgacttgatggaatccccaagagcctgctctcccgcaggtcaggcaggaaggggcagaggtcacaggggaggcctgtcctggcccctggttccctgagtctttgctatctgtgggcctcagctggcactcagccaacaggcccctggcattaagatgacaagggctactgtggcctcttggcttctccctgtttctccctagagacactcagccccagcactggccggatctccctggccaccttccctgaaggcccctttccccctactttcatgtctcaacccatccccacagctcagtgagaccctgcaccctgcaccctgcaccttggattcatgccaggcctgagtgacccacggcccatgccttttctgcttggtcccattgcctcacgggtgcccccaagttctgcttcctgtctgtgccaccgttaagcctctttcctagtgatgactcccgcgacagcctctttccggaggaggcgcattccttaagggcctggtggggatggtgatgacagggccaaaggacagctcccaaagctggaaagccagccactgcggggggcctggaggtgctgtcagcaagggaagctgcccggcccctcttgctagcagccaactcagcctgagcacctgctctgcaggaaatagaaggggactttgctggaaatctgcctttaatcttggcttcctgttttctgccctgggggactgcccagacggtctgagtttcaagctatttcacaccagcttctctaaactgtcatctctgtgcaaagaggctgggggaggggaggaggctgggtggagagaggagcggcccttcccttcccaggggaccccataagggtataaatgcacatacatgtgcataagctctggactgctggaggccaacccaactttgcatggagctatcccatttggcacttgtatcatcaaaatgcagccagaagcttctctctggttccccacatccaggggtgggtctccaacctctcctctcttctccattcccctggggcaggcccaacagccaggcaagagtggcccagcctcagagagctagtgttcagttcccaacactgccttgactccacatttcacaggcatcccaagctcattttgtccaaaaccaaactcctgagtgttcccccagcctggcactctccccaggttctcccatctcgcaccatctccccaggtgctccagccacacctgaggactgaggagtcatgcctgatttctcctgtggcctcactccccacaaacaacccctcacggagagctgccctgggacttgcctttgtccattcacttccctatcccgctgcttccaccagggctagacccgtcagccctggtccaggccatgcaacagcctcctcactagggctttgacctttgaccttaactttttttttttttttttctggagtcagggtctcactctgttgcacaggctgaagttcagtggctcactgcagcctccatcttcccaccctaagtgatcctcccacctcagcctggctgagatgggaagattgctagctaccagcacacaccaccatgcctagctaattagaaattttttttttgtagagacagggtcttgctctgttgcccaggctggtctcaaactcctggcctcaagtgatcctcttgcctcagcttcccaaagtgctgggatcacaggcgagagccacagggcccagccgaccttcactctttatcatatcactaccctgcttataaacatctttcaatggctccccattgctcatatgataaaacctaaactcctgtaataaaaatctctggcccacaacaccctatagaatctgtcccttcctcaaacaccactctcccctgcttgccggtctcatcaccttggccttctggctgtcccttgagccactgaggctttctgtgcctcagggtctttcactatcttcctccccacctgcaataccctcccccactcctccaacactggcctggggcgtggtggctatcgcccgtaatcccagcactttgggaggccaaggtgggtggattatttgaggtcaggagtttgagcccagcctggccaacatggtgaaaaccatcgctactaaaaacacaaaaattagctgaacatggtggcacacacctatagtaccagctacgtgggaggctgagacagaagaatggttgaatgccagagcgggaggttgtggtgagccgagatcatgccactgcactccagcctgggcaacagaacaagactccgtctcaaaacaaacaaacaaaaaacaaaacaaaacaaaacaaaaacttactaagacagttgtagataaaggcagatttattagaaaaagtaggaaaatacattgcaagaaggcagaagagaagctgactgccaggaaacaaaaggttgttggagattttatagaattagtgttatgctatctgttgaggaggtttttgtgcagtatcaaacgccaagggtacagtgagctaacttgccaagggtacagtgagctaacttgcaggagtctggtgatagtcgggcacaggaagattgtgaattatttgcacaggagagctatatgtcctagacatgaagaaaggcagactcacagcttatctaatttctctttttgctttcccttgctcccaccgaccagattccctttccctaattagcacttcccacctagcacttagtaggtgctcaataagcatttgtttttttgttttgttttgttttgttttgtttttttgagacagagtctcgctctattgcccaagctggagtgccgtggcgtgatctcggctcactgcaagctccgcctcctgggttcacaccattcttctgcttcagcctccccagtagctgggactacaggcacccgccaccacgcccagctaattttttgtatttttagtagagacagggtttcaccatgttagccaggatggtctcgatctcctgaccttgtgatctgcctgcttcggcctcccaaagtgctgggattataggtgtgagccacggcgcccagcccaataattccaccagaggacaggtctgtgggagtggggccctttatcgatttgtttatggttttatccccagtgcctggagtacaggaagattaaaaaatttatttcactttgctgagaagaggtggagccaggattcaaatgctggtctatttgactccaaagttcacagctgggccacagcacacccaggggaaaaagtcaagtgcatttggggataaagaaaggttggtgacaaaactggaacagggattagagtattttccccaaatccccagtcttttctttcccattctgctagctgattcagccaggggaggggagatgtcaatttctccctcccagaaggctttgcagagctgctgaagtgctttcttgtaggctgagaggcggccccccatccggccccatattatcattccatcttgacctcagaggaaagaaagggaaaccagctctgctgagcaccctttccactccctcacccccaggccgttatcttgctgaatctgcactatctatcatgagagaagtatattttgagcctgatcttacaaaagaggaaacagctcagagaccttaggtaactagccctaagtcacacagctagtaagtggacgggttgaaatttaacttggagacttgaaccccaaattcatcttttttctgttacaccacacctatctctgaaacttactggctgtctcctcaaaggacatccctctccaaagggctggctccagctgggaaaccggcctaagggtgccctgggtcagagggccgacctgtggttttgggggcaactcctcctggcatccgaggctctttaaaacaatctgcagccacactgtctcccagctccgtctcccacagggctgtttgccctcttctcgctccctcgggcctcttcatgcttattttgtgttccaagactttgtcagcatgccccacttcctcccccccaaccccaagagtgcctcttccctctgtccacccaagcctgacccttgcttcagggtctagtccctagaaagtcccccacctttacctcctccctacgctggagtctctggtctcgccctcatcactgtatccccattctgttccccggtctcaccctcatcactgcatccccattctgttcccccgccaccctgcactctcccacccctgtcatgcctgagcacgctgtcctctcctgtggctcagagcaggtcatctccctgcttttcgttaacagtgatgtaacagcccttgcttaacggagggctcctcacgtgccagctactgcatactaagcactttaaacgtattaactcatttcctcccctccccacaaaaacttaagaagtcggtgccattatatatcacctattttaccaaatggggaaactaaagcacagagaggttaagtaacttgcccaaggtcacagagctgctgacaacttctttattgcctccaggctgaacataaactccaagaaagtcccatgaggctctttggatctcttttgcccctgttgtttgcaggaacccatctcccaccactctcccccacccacactgcaagcggcagccgcctgagctatatttagatcccagaagccaccaagctccctccgcactccccgcccttgtgcatgctgttccctctgcctggtcccggctctgtgaggtgtgaggtctccccgttagccctagttttctttctgcctcctgggaaccgtgtccaccacctctccactttgatcaattatttccttgccgttgtctgtcggcctgtcagcctacccccacccgaccgagaacgccttgacggtagtgaaatggtcttgccaatagactccagagcaggctccgccacgatgtcagcgccaggaaatgttggtgaatgaatgaatgaaggctttctgctgcgaatcaggcccactctccacaaacagacctgaggagaggggcccaggcccggcccccagcgcttctgcagcgggaaagctgcgtccagagaaggctgggaggttgctcccaggccggctgaggagagaccctcggagccttcaacgcagccaggcggcaagtgggggcagggcgtgggcgcggacacaccccccgcagtgcccccggcgcccggcagggggcgccgccccgccggcccacgccccgccgcgcgccgggcaggccccctcgcgcaggcgcgctgccgcgggcggaggatccgggccgcgcttcctctcgccaggcctgcgagcttcctcccagcggagccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagaggtgagtgcctggccgtcccggagtgtcccctggagggaagagggtggaggtcgcgcgtctagtctctgttgctgccactgtcgcgtccactcccattcccctcttctcccacttctcccttctctcctttactcccttgcacgggttcgaattctcccaggagccactgtcagaacccaaattggaagggagtgcatgagggaggtactgccctgcagctccacggactcgtcttctcgggtcatcccgagtccccccctctgtggagctcagagtaggaggtggctggagtctggaggaagaggatccgtatgggccaggtccctagagagagtgctggactcccctgcccttccctgtacagggcctccccgcaggtgccctggcttgcttggttctgacccctccctcattaccccaccatgaccctgcgggctgcaagcaagcccagggcccagccacctcgggtgagcagttagaagcccaggtcctaggactgagcctgtcacccttggcctctcagaagaccaggcctaagccaagggatctttgggtgggaaactgggcaggccttctgcccggggggaggtaacggagcattagcaccatgcccccaccttctggcaccctgggcagcccattctcctaggctctttgtggcccagaccaggtgtcaggaaggggtgtgtccagccagcagattttttggagcttaactaccagttcacttccccgcccattttgtacacccgggaaccgaggctcaaagggagaagttgctaccccaggcctctagtggagttaggctggctgtcctttcatccccagctatacagggctggatggctgtgggtggaaggaaaccaggcaggcaccttcacccactggggacacaggcccccagcccggccccagagggaccttgttggttgagcacgtgcttccctgcagagggctggagggagtgaaagggcttccggctccagctgtggctgggtcagctagcaggagatgtggggaatgtgtggtgtatggccatctgtgtggtgtggcaggaaggtccggtcctggccccggctctgagttgaaacaacctggtggtcagtcctgacccagcactcgccacacctatggcccagctggcacaggagcagccaagttcaggatataaatggggtcacatgggaaccgtggaagctctgtctccactggcagcaggctacagactggggacatgggagcattgtgagagtggggacacccagggggcctgtttcaagctcctagtaccctggcggttccagtgtctttcttggttgtggccacagcaggaacagggcaaggacagcaggggtgaggttgaggcctggcaggatcctctggcccaggagagcaggcattgccctggtgggtgctgagcagtgtctgggctcccttggagctgctggcagttttgtcctgctgggtccctgctcacgatttagggtttttttgttttttcacttttttttctggctgtcctgacatgcacagtggaggggacccagatgtcctgggcctgtgagactcccctcacatggccccacacccagccctaacttcctttccagcctgagggactggggctggagcctgacatggttagctccctcccaccccagtcagcctttttaatttttattttattttattttatttttttaccaactgtgagctgtgaaggtgtgatccagggtcccagggcctttgaagaaaggagtctggcttctggctggcacgtgtgcagggatgtgcttttcattggtgagcttggtgccctccaccctctcagaagcagctgctcttctctctgcattgggtcaggggcaaggaaaaagcagaaaatgttcccattcaccaccgcaggggggccagaccccaaaaggctgagccacacagagtggccctcggcaagggttggaaatttcggggacagaatgcagcttcctccaaacaagtataggtaggggttgagacccaggatccacagtgtgacatggctgccccccaaagggggcagacccacctgggtgcggttctgggctccatcttttgaaggattttaaaaccttgacaggtcatcttcaaagagccagggatgttgactgagtctgggaaagagaaagtagggacagattctcatatgtctgagggactgtcccaaatgagaaaggcatcccatggcagaaattgtcccagacacgtgggccagagctagggagcaggtgggtcccagggaagtgaatctgagctcattatagggaaaccatgaatgtactcattttcttgatttagaaaataacaaaacagcgctacaggaaatttagaaaatgaaacaaaaatcacccactatttcttcagcaggcagtgactgtgttagcattttggagttcactgccagtcttttccccatccttttccttcattgtcgttgtcactggagtgtgtgtgccgtgacaccttttttcatttaatactgcgtctgtgggcattttctcatggtgctacgcggtctaagtaacgttgcttctaaaaagctacagaacattctaggctggcctgctgcagcgccatcacccatacactggagcgtgtgcatttttcccctctgttgctgttgtggttgtcgttactatgagtcccaaaagcagccagggtgttggagggcacaagcaacttggcacccaactgaatgtgggttccaggcccagacatgccacttaggcccagggtagagggaccttagacaggtcactgacctgctgagcctcgttgatataaataacaggatggtaacacctacttcagaggaaggtgtaaggacagtgtcaactaactaaccaagggactctaaagtgcctggcacagccctttcttcactccctctgtgagtaggattggcattgttgaaggagtgcccactgctggctgcctcaacctgtggggaaggtgcctgagccacgggccaatgttgactgaccactcacctggcaaagaggtggtctccgcctgaggagcccctgtgaaaccccctggccctgaggttctagaatactatggccagtgcccttgcctgccttcccttctccccattaccatatgattggctggcctaggacatggggctggccctgggaagatgggctgctggttagggtccgggacctgactccacccattccccttccggtctcccagcatcagagctaaatagacaaggcctcttctctctctctctctctcttttttttttttgtgtgtgtgtgtgtgtgtgtgtgtgtgtgagatggagttttgctcttgttgcccagtctggagtgcaatggcgcgatcttggctcaccacaacctccggctcccggtttaagcgattctcctgcctcagccttccaagttgggattagaggcatgtgccatcacgcctggctaattttgtatttttagtagcgatggggtttctccgtgttggtcaggctggtctcaaactcctgacctcaggtgatccacccacctcggcctcctgaagtgctgggattataggcgtgagccactgcgcctcttctgtaagagcctggctgcctcctgcctcccagctctggctaggtcagcccagcttggcattttcccagaggaaatagaggcctgcttagcctgagacttagacaaggaacccaggcatcctgagccccagcccaagaacagccatgccagcctcatcttcgcaccctgttccagtagccaaggaagggaaagaagctgggagattaagggtagggggattctggagcctcccagagcttcccaggagggagttggacacatcgggaaactcatgttagcctccccctcctcagcaggtgttccccaggtctaacctgagtgtgtatcactgtgacacacctgcttcctcttgttctacttttgtggagaccagggtaactgggagtgccctcctacagccaccccgtgggcagtagcaggacaccagtctcctcctggcaaccctgggcctaagagactgtagccccagatgaccctagggtggcccaggactaacctaaggaaggggtcctcccccaggtggcccattcagtgcagaggtcccttgggcacacgacttcagactccagctgccaaactttggcctgtggagtatctcctcctccctggtcttagtgtaagggaagtgggcatgacaactgccctcctgtcccacagcttgggatgggatgaggtcacagggtggggtccgccccaagatgctggcctggcctggctcagatgagagccctttgggtgtttctcagtttcccccgcccttggttggggacaggatgggtggaggagcaggccacccccaacgcccggcagggagcactgcctcccttccccctctcctctgggtcccttcatccaagggctggaaatagaatccgctaagtaatgattaaagtcaaattcagacctaaaaataaagagctggtgaaggaagagctggtgctccctgcatggctgaggggagaagtgagcagggagaggctggctttgggtggctgagcccctgctcctcgggatcagaagtactccaccagttgggggggtgctcttttatctgccatgatgtggcccattaagtgtagacggcaccactcagggcagactggcaggacccattagaaaaaaaatcccatttttcccatggggaaactgaggcccagaaaggagaagtggtttgtcaagcgactatttgagagctcccctcagcaggcccccagggactggagggccctgtgcagcccagcctgccctttctgcctgctcagtttctcttcctggttttgaggtgctaagatgaagtcagcttctcatcacacactagctgtgcacacaccctccaaccgcagcttccctccacccctccttctgtggtctgggcccagagtcgaaggaacaagtagaagagaggctgcttggtgcccccctggctgtcctgatcatggcatggttgtaagcctcgtgggcaggcgaaaacctgggcatcatctgccccccttggaccctggctgctgcttctcagcccagcctgacacctggtcctcatgcagactcgcgcatctatctatctgcagcttgtgctgtccgtgctgcagggagacaggagggaaggatgaagagcaaaccctgagagcgcctctgctggcgggtagaggagacgaggagtcagtgaggggaggcctgtggttctcacttcctggcagagctggtaggagctctgaagctggggctctgcgtgggctggggcagcctggagggcctcctggaggggaaggtcctgtgaaagttgagaagtgtttgaagaagaagcgtggtaggaggagaggtccttgtttgaagcttctgccctctctagggctgctggctcttttctgtgtgtccctcgacaggctcttggcctctctgagaggctggggtatgcagacaagcaagaagtgggcacagaagtacctctgcttcccagagcagaacagccaagctctgggcagacctcccctcggtgccccccacctgtccattttcagggtgtcgtctgtcctgcacaaggaaaggtgggaagaaaggtcccctaaccaaggttcagacaactctgagctcaagtacccacacagctagttcctcctctgtcagagatcaccagtccttgccctatggggtgtttgaaggattaagtaactaatgcagtgccccaaacccggttgggtcagtcagctgtaattcccgtgttctcattctgcagcccatcctgctggaggagtgtactggtaacacccccatctcccttaagtagtagcaagtctgtcctttgtgttgatccccacagctttaccttctgagctgtgtgttctgcagatcctggttctgaagtggggagaccagaaatctgggggccgaagttttagacagcttatgggcctccagccgtcagtctccccacctagaatgtggccaggagacttccgggtgagggacaagaacatgactttgaagggtccattgaaggctagtgctgagaggctatatgcaaatgcaggcaaatgaagatgcaaagaccacatcctgtgctaagggggtgggggagcagaggcctgggttagggccctggggaggcccagagtccccattgcccagcgcacataggtaattaggctcctgagcggtaattagaaacctttctgggccaggaatggcagcctcaagccgcagcggtgcctggggagtaggctccccattagcctgctctaaccccagcccccacctctcccaaaccactagacgggatttccggtcccactgaaccattgggggcaggggaaaaaaagccagtgtgttgctataatttggtatttatccattaaatccgcccttctccttaggtcagggtgctgacgggagccccgggatgggggtagggcagcgtgccctggagccagagcaggcattcttctgttccttcgtaaccgccccgggaggtgtaggcatctccaagaccctggcgcccaattctgctgctgctcaccctgagacacctgtgcagtgggggtgctgagggaccaccagcgcaggctgcgggggtcagtggaagccctcgggcacccttccttgcctgatgtgtggtggggaatgtcacagtgcctcagcctggtgtcctctgcagaaccagaggtggagctgattttattgctgccaaacttgcccaactgctggtgggtgccccgccctcctcaggtgcactgccctttggaggggcgggcccaaatctgaaacttaattctgcctgtatctgtactatgacctgtaggccctgctcggaggttccctgggcccccatcctgaaccttcttcagtcttcattaactcgctctgtaccacagtttgcagtcttaatcctggtttacttcaaggcgcccctctctcagtcactttcccctaaaatccttctagctcctgctcccctcacccatcttcctggaagccttcccgggtggcccctgtctcacaatctattgaggcactgaacataccaggccatggctgaccatccagtaaccaggaggacaggagccgggtctgcattttgtggtggttcccagcatccagccctggcttgtgcacagaggagaggtgtgtgagtggtgaccttgggtccccaaaggcaggacctcttgagtcctttccttctccacccggatatcctggcctaccaagcatggctctgggcacacaggaaggcttctaaaacactggctcaaagaatgagaaggcaaggtggaccttgctgttgcctgttttgcctccagtggctgtccccatcccccagagcatccagctaggtcctgtggcagcaccagaatctccgggggccagggccctgagttcccccaggtcttttgtgcacttcccttttcagtgggtatttttagctgggcgtaaacagttactgaaggctcccacgccccattaggcagcagagttttggcaagggggaagggcaagggagccccttgacctcccctggccctcagcacgtgcctggccttgggggtctacagctgcttccagggtaggaaaagggcagcctgggagtttctgggctcccagttctttctccccactccttgtcagcctgggctcacaagaaaggctgcctgaggctgcagccactgacctcagcgcttgggcacaatgccagcctgttcccgggaccccagcacaagggctgctgggagccgggtttagggcaggaagtcagagtgaagcactggtcctgccacatcccaagccccttgtcccctagccctgcgggaatggggtgacagctgctgtccctttggggttaactatagtcctattggttatgagacctcggtgtggtacagccagcctggcgtcccctttttttcattcgttcattcattcattcattcagcactcatttactgagcagccgctttgggcccagcccatgcagacgtgagtcagaccctcactttccccctgcagagctcccagtccaccctaaaccacaggccacaaccagtgaggttctcactggagcacggggatgtgtgagaggccttggaggcctcggcagccaacacagctggggacccaaggaattctccagagagaggtgatttacaaaaagtttcttatttccagttttaagggggaaggtaatagatgcatgtggctttaaaaaaataataataatttttttaaaagcccaaaaggacaaaatagcaaatgaacagtaaaaagtaagtttctcttgaacttgatctcactttcccttctcatcctagaggcaacctctgttaccagtttcctctgtctttccaaagataatcgaggcatatttgagtttagggaggtgttgcattaatacctctttaaaaacacaacttgtagtattccatagagaacctgcacctggctttttttttcacagccttttattttgagtatttgaaacctaccaaaaagttgaagtaatagtataatgaatattcatatatccttcatgcagatttgccagttcttaacattttgccacatttactctatctcttcttttatctacatagacatatgtgtgtatgtattttttgctgatttgagtgttagttgtaggcattgcatctttcaccctaagaactttagcgtgtatctcttatataatcacaatgtcatgatcacacttaagaaaattgacattaattccatattatctactatgtccatttcccctctccccaagtgatttttatagctgtccccccgaccaccccttgatatagaattcaattcaagatcatttattgaatcttgtcatgtttctctagtgtcctgttcaatctagaacattctccagccctttttttgttttgctcttttatgacattgacatgaagagtccgggccagttgttctggatttgtctgattgcttctccctggttggagtcaggtggaacagctctggcaggaacgcccccccgggcaatgcagagtcctcctccaggaggcacttagtgtccatgcgtcaccttgctggtgatgcttcactggatcacttggttccggggttgtccgcacgtctccctgtagtgcaggtgctccttcctgtttccaattagcctgtgggatgggacttggaagctgtgtctgttctgctcccctggcaactttttcttcaatgacttgagctggtgttttgccattttccatactctatcatggggagtgttcagtatcggcatctagagatctcccctggccccatcacagctagagctatgctgtcccctttcagggacatcttgtaatttatccacccagcccccaactgatggacataaaggctgtctccccatcatctcctgctactacagacagcactgcagggactgtcctgctgtgtttttttaaggcatgggtactccagaagcagttgctcagctgcacccccaaggttgagtggaagtccctcggtaaaggaggaggagagagtgtgaagggaatggcaaggcggggagggagacagggcacaggtgtcctggcaacagcagatgggaaacaggtctggctaaggtaccagaagccaacaagtcccagaaaggtcaagtgactttcccaaggtcacacagcaagttgatggcagagctgggtacaggactcagagcatctgacacccaggacgatgttcctgcactgttccatagagtagcccgactcttaagtttaaataaccccaggaaggaccccctctctgtgcctgacccccgctgggttgtagaggcctaagtttgcagtagctcctcccagccactctggctgtcagcctctgacctgcagtgggagggtctcaccttctggagatgttttaaggaggggaccccggcctaggcactagctgggaagccactgagccatcttgtctgcggccactgacgtcagtgcttgggcacaatgccagcctgttcccgggaccccagcacaagggctactgggagccgggtttggggcaggaagtcagcgtgaagcactggtcctgccacatcccaagccccttgtcccctagctctgtgggggtggggtgacagctgctatcgctttggggttaactatagtccctttggggttaactatagtcccattggttatgggacctcagtgtgatgtagccaggctggattcccccttttgtttgttcatttattcattcattcaggggtctcatgaccccaccagggaggagccgtccaagagagttagcagctcccacttgcaagatgtctgtggcaaggcaggcactgttctggtgctgagagctcaactccagtcctcacagcagcccccagagccaaggagtatcaccagtccattgcacagatggggaagctgggttctagagtcacagccagcagagtaaaggtgatgagtttagccctcttccctgtttccagaccctctgaggccttcagagcccagctccttgaggcagcccaccccgaccgctcctaggcttacccttccctgagcaccgcccctgtgcccctcatagctgcttctgcctcctccctcctccctcctctcccttgcccctaggctagtgtggtccccatggcaactcctggggcctgtccggcagggaggcacggggctatggggagggctggctcagcagctcaggagtttgacacctgagggggacagaatgctcactcaaggtgtggccctagggacccccgccttgcccctgtgggcctcacttggggttctcatctgcaaaatggggataataatagcttctctgtctcagagttgttagaggatgtgatgagccataacgtgccaaggacagggcctggcacagaataagtgctcagaaaacagggcctgttattatttttattattataatcaaggcagtggggaggcggcggtggcagtagctgtaggccaggaagggagtgtttgcaaactgacagctggaagggtgactaacagcgcagcagcctccgcgcccccctgtggtggcagggagtttggggaggaagggggaggcatggggatgtggaatgctagcagggcccctattcagaaggacctaaaggttgggggcccagccagccctagtgggaccctaattcaagctctgtcacccctaactagctatgtgacttcaggcaaattgttcaaccagttgagcctcagtttccgcttctgtgaaatgggggtaagagggttagaagagctcacaatcctccttccctccccgccacccccacccccacagcttacagtccacaggaggcaggggcaaggggtcctcaccacccccaccctcacagcttacagtccacaggaggcaggggcaaggggtccccgccacccccaccctcacagcttacagtccacaggaggcaggggcaaggggtccccgccacccccacccccacagcttacagtccacaggaggcaggggtaaggggtccccgccacccccacccccacagcttacagtccacaggaggcaggggcaaggggtccccgccacccccaccctcacagcttacagtccacaggaggcaggggcaagggatggttcctgtacttagtggtgactgagtcatgtggatggaggcaggtttcaggctcatcctccttgggcctcagtgtccctgcctaaacagcaggattgatggcctggcctctggggatagaaagggccctgtattctgggaggaacggaagctctttcatccaggggatggggcaggggcgcaccagacatttccaagttcagggtttcattccagcccctcctcagccagcttgcaggagatacctgtcctccccttcagggtaagcaagacttagaagggttgagtcactcaccccaagtcgcacagtcaacagagccaggtattaagcccaggcctgactatagagccaggtgtgcggcctggaagtgttggttctccctggccgtctcctccccagctccttctgctctccatgatcacatgcccccctgctgaggccccatcgcccttggagtcaaaccctggttcctcacattggcagtggaagtccccctgctgcctggcagagtttatgccaggcccacttgaaaccatcccctacagtgtcccctgagcagcggtgctcaaggtggactctggaagtgtgtggggtcctagagccccagatgggcagggtctgccttcccgcttccctcaccatcggcttccacctgggccagtttctcatactatgccagtcccctgcctgacacctttgctcagactgctgcatcaacctggggtgccttccctggcccgccctctgcctgtgtaagccctgcaatcttcagggctcagccccagagctccctcctccagggagcctgtctgagctctgcagtccgtgcctacttcacacccccagcactttgcactaaaatgtcttctcccgcgccactgcactccagcctgggcaacagagcaagactccgtcgcaataataacaataataataaaataaaatgtctccttccactggggtaggtagcaatatttgtgactgtcagcctagcccccagacctcatccactgtatcaaagagcccagcaaagaggctcatggaggagtttctcttctaacacactgtgaccacgaagatgccactggccctttctcaccctcagtttcctcacccgtagaaaggaaacagtagttccagcccctctgcttcctgagacaggtccaagggggctctgggctgggattacaaagtatgtgtgtgcagacgggtgggttgctgctctcagggaatggggttggctagggtagcttttttggggagtcaactttattgaagtaaatatacggttgacccttgaacaacacaggggttgagggcatcaacctcctccctgcagtcaaaaaatcatatattaacttttgactcctcaaaaacttaactactaatagcctattgttgtcagaaagccttgtagataaagttgattgacactcattttgtttgttatatatattatatactgtattcttacaataaagtaagctagtgaaaataaaataagaaaatcatatggccgggtgcagtggctcacacctgtaatctcagcacattgggaggctggggcaggcggatcacttgaggccaggagttcaagaccagcatggccaatatggtgaaaccctgtatctactaaaaatacaaaaattggtctgctgtgttggcgcacgcctatgatcccagctactcaggtggtcaaggcatgagaatcacttgaacctgggaggcggaggtagttgcagtaagccgtgagtcaccccaccactgcgttccagcctgggcgacagagtcttgctgtctcaaaaaaaaaaagaaagaaaatcataaggaagaggaaatatatctactattctttaagtcgaaggggatcattatgaaggtcttcatccttcacattgagtaggctgaggaggaagaggaagagttggtcttgccgtcacagaggtggcagaggtggaggcggaggaggtggaaaggaaggcagaaaaggcaggcacactcagtgtaacttactgaaaaacatccagccacgtgtggtggcgcatgcctgtggtaatcgctacttaggaggctgaggcaggaggattggctgaacccaggggtttgaggctgctgtgagctatgatcacgtcactgcactcctgcctgggcaacagagtgagaccctttctcaaaaaaaaaaaaaaaagaaaagaaaaagaaaaaatccatgtgtaactggacctgcgcagttcagacccgagttgttcaagtgtgcactatacaccaaaaagtgtgccgatcgcaatggtacagctcagtgaattgtcacagagtggacccacttcatgattgggctcagacagtctgaaaaccaaccccagaggtccccttgcattccttccagtctccctgtcccaagagcagctatcctgacagcatggattagtttggccagattttgaactttattcaaatggaattacataatatgtactttcctgtgtctggcttcttggttaacattttatttatttatttatttattcattcatttagaggcagggtctcactctgtcgcccaggctggagtgcagtggtgtgaccttggctcactgtagccttgacctccccaggctcaagcgatcctcccacctcagcctcctgagtagctgggagtacaagcacgcagtaccacccccggctaatttttgtatctttagtagagaccgggtttcgccatgttgccgagactggtcttgaactcctcctgggtttaagccatctgtctgcctcagcttcccaaagtgctgagattacaggtgtgagccactgtgcctagccatcattatgttttgaaatttatcgggattggccaggcacggtgactggcacctgtaatcccagcattttgggaggccgaggtgggtggatcacctgaggtcaggagttcgagaccagcctggccaacatggtgaaaccccatctctactgaaaatacaaaaattagctggttgtggtggtgcatgcctgtaatcccagctactcaggaggtggaggttgcaatgagccgagattgtgctactgcactccagcctgggtgacagagccagactccatctcaaaaaaagaaaagaaaagaaattcatcagtgttatttaatggttggagtttgtgttggagtttatttaatggttggtgtttactgctgtacgtagtcccttttgtgaatatgccactgtttatccattttcctctggatcggcatctgggcagctcccagtttgaggtttattacaaagcatgccacttgtagccctcctgtgcctgtctaggcagacacatgtcctgtgtcctctcggtgtgtacctagaagtggggttggtatatgtttagagatgctacctgggcgggattttgcaggtgaaggacccaaggacccacagagcataagggactttctcagatcacatagccccttctcagagctgctccggggcccctttccccacagaacagtagctggaaccaggcctggggctgacggtcaggtgtccattgtcccactagccccctttgctcctttctatcagtcctggaaggccccctgtggccttagggttggtggctccctctgcccctgggggtcctcagccctcatgctcctctacccagtaccgtcagcctgccaggactggagagaatggcccatgtgtcaaatcccagcgcaggacactcttggcacctgttcatgcccagtgaggagccagatctcagcagttggggggcatttcttcacacccctcctcagtcttcatgctcttccccacagctctaatggtaccaagtgacaggttggctttactgtgactcggggacgccagagctcctgagaagatgtcagcaatacaggtaccacaggggtgagggtctgggacatgcaagcattcccaccagccccagcggggtgcttagcagaggagagaggatgcagcttagatcaacccactcccctttttcccagcactcagtcaggtacaggcctggggaagtgggggagtctcaacaggaagggacccagggctcgttctccgggcagagcacctcacccaggctcacagaggccagctcagaggctgtgaccacgagggtgcgccagcaggtggctggagggggcccaggctgcacccgcccacgtgtcacctgccttgcaggccgcctggccatccggtacagaatgtattgccaagtacaacttccacggcactgccgagcaggacctgcccttctgcaaaggagacgtgctcaccattgtggccgtcaccaaggtaatcaggtgacgcccaccccaccatcccactgctgggccttccctctgcagggggaggtgggcctgagagcatgtctgggctgccctctccccaggaccccaactggtacaaagccaaaaacaaggtgggccgtgagggcatcatcccagccaactacgtccagaagcgggagggcgtgaaggcgggtaccaaactcagcctcatgccgtgagtaccacgaggaggggttggggagggaaggggccttggtcctcctgaaggagcatcaggagcaagcagggaggccagagtgaggggcttgggtgttggggagggcctcaggaggaggtgcagggtgcgggtgcgggacctcacagagcagggctgggggcagaggcaggagggtggcaaagaagggacagggagcagaagaagagggcctcaaatgcctgactgagcgagtgcgagccacgggtgccaagcagagggaaccccttcagaaaggggagccagggtcagtacctttgggccaccatgacctccagccctgctgctccccagttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggaggtgagctggggggtacagagccttgctcccaccctcacacaccctaaacccatctggggccctggcttctagctccagccccactgcttctgcgtggtgaccagccatgtggggcaacttctgtgagcccttgtttcctcacaccttggtggagcagctgctgcgtgccaggactcacctctgaccccacagtgccaccatgaggaggggagccttatcctcattttatagaccaggagttgaaggttcagagcagttaggggacccacctgaggtcccacagatataatttggtgccaggactagaatctgagtctgtctgatcccagagctaactttcctccagccactcacagacctgcatgctcagaagcgtgtgcagaaacatgagccatgcgccttgatcgccagggcccctgaggctctcgcacctgcacggacatgcccacaggtccctgcagcttcccaggccagctctgccagccctggccaggccacacctggcatccggtagccacaggaagcctcccgtgtccctctgtattcactcttatctccctcccctactggcctggcttggcctgtggcaggtgagggtggggtcctgggcactcctggctagaggctggtttcaggactgagccatgggttgccctctgcatcagatacccatggggcccagagtggtagcagcagctgagtgtccagcaaccgcatgtagggtggcatgggaaatgggccatacgtcataatctgggacttccctaacccctgccctaccagaaatggggagccctccccactcagtgactccaggctaggcggggctggcctctgccgccctctggtggtcaggcctggacggtgcatatggggcaccttgggctgtctctgagcaccctgccccccacaccctgcagcactacacctcagacgcagatggactctgtacgcgcctcattaaaccaaaggtcatggagggcacagtggcggcccaggatgagttctaccgcagtgagtgcaccccaccccagacctcttgcccacccacctcctcccacgcaggcttcctggcactgccccatccaggaacctccagagaaccccagtgcctgatagtccagtcagcctctgtcatcccagccatgtccctagtggcctccaggccctcactggcccctccccacaggcggctgggccctgaacatgaaggagctgaagctgctgcagaccatcgggaagggggagttcggaggtgagctgggccgggccccctgggggggttctgagggactccgaacttgggaacaagaccacctctctgcccccagacgtgatgctgggcgattaccgagggaacaaagtcgccgtcaagtgcattaagaacgacgccactgcccaggccttcctggctgaagcctcagtcatgacgtgagtgggggcggggtaggggggaggttggcctaggttaggagtgaggcaccagcttcccctttctgaccactctcgtcctgccccaggcaactgcggcatagcaacctggtgcagctcctgggcgtgatcgtggaggagaagggcgggctctacatcgtcactgagtacatggccaaggtgggcacctgccgagacccggcactcaggccttccaactgccccgaaacccccactgtgctctagggcccctgctccctcagtcccccgaccccaagtgagcttttaggtcaccagggctgggcttttgtcctggtttaccattcattgactgtaacattggacaaatcatgtcacctccaagcctcagcatcacatctgggaaatggagataataacaacttagagatttgtgagagtcaagggataaggcatgaataacacagagcagtgtccggcatggatgttctggcccctccccactccttccctgtctcacacctccctggagtgtcaacacccacccggccccagcgtgctgtgtgagagggctgcagggcacgtctgacctcggcctggtctgtccttcctgcccccaggggagccttgtggactacctgcggtctaggggtcggtcagtgctgggcggagactgtctcctcaagttctcgctgtgagtgaagcagcctcttggatgggtagggtttgaggggtaccctgccctgctatgggagccccagtctgaggggacatgtggctggcctacccccagagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaaggtggggctggcctcccctggggcctacagaggtgggcaggagtcctgggtcactccccaccctggagtcccaggatctgacgctgcttcttccatccacatggcagaaattctccactaagtctgacgtgtggagtttcggaatccttctctgggaaatctactcctttgggcgagtgccttatccaagaattgtgagtatgggtactgggatcagggtggctcttggagcaccggaggggttggcaggggcgtgagcctccttgggccctgcctccccaatcaaggcctagaagcctcaggcctgccctggggagctcacaggccactctccgggcctgggtctgcggcaaagctgatgggcatccctgagaggctgctgggtaggtgtcctctctgaggccagggcctggactgactcctgcctccccctggccacagcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgagcctgcttgtcctgcccggtcgtccctcccatgccatcttgtccatccccctgtgtctgtgagtggggctgggtggggagcatggctgggagatgtagccgccgctttgtgtcagctgcacgagtgagtgtccttgtgtctgccctccgggaagtgctcaccagttgccctgctgccgccaggcccagctccggggccccatctacaggatgctgcctgggggttccagctgcctcccctgctgttttcaagcctgccgcacaaggagggctacagctagggatgggagggagcccaggcctgcacagatgggaacggggttctagtcaagccccctgtgcaagagagagaaaaagcaatggtgggcccagtgggcttcctctggcaggaggagaagtgtctcatgcctgagaagatgctgacccggagagggacgggaaagctcctggtggttctccagtttcacccacgatgtcacagctttgccctgtccccacccctgccatgtgccaggccttaggtcataccagacttggcaggggttgaggatgcagggcagaggggagatcctggcaccttccagtcagggggagtccctccccaccccaccttgtcggggaacatatagagaatgtggaccagccatgagattttctcccctcactcaggttgtccaggggcagtggtcagtacagaacctctgaaggtgtgaggaggcttcatgtattccctgaggcaggcaggtggggtgttcccctgtcctgttgtggccccgacccttcctctaccagccaacaggacctgaaatccaggaagatctgacttcgaagtctaccttgtgtctgttcctcagccccactgtagttccatctaccagtgcaacagcctcctcgccgcctccacttcatcttctctgcatactgccagacttaatttttctaaaactacaccattcattcaacaacaaatatttgaatacctgctgtttgctaggactgaggttcatcaataagcaaaacacaccctgtggagtccacagttgggaagacaatcaaatagtcacatatagacagtgacaaacttaagtgctacatgaggaacacaaaacatgggaatctttgtagatcagggagggcttctggaaagaagcagcgtttaagctgagatcagaagcagaatgaacaggttgtatggcaggagttagcagcattccaggaagagatgctgagactggagggagggcagctttgtctcagatctccaagaaagtgggtgaggatggacgaacagccaggcctgagaggtgaggctgtggctgtggcaaagacttagcttttatcaaacagagaataatgggaagccaatgacaagtttgatcaggagggtgagatgtcagataatttttgtttgtttgtttgtttttgagaagaagtcttactctgtcacccaggctggagtgcagtggtgccatctcagctcactgcaacctccagctcctgggttcaagcgattgtcttgcctcagcctcccaagtaactgggattacaacaggcatgcgccaccatgcctggctaatttttgtatttttagtggaaacggggtttcgccgtgttgcccagactggtctcaaactcctgacctcaggtgatccaccacctcggcctcccaaagtgctgggattacaggcgtgagccactgcacgcggcccagatatgtgtttttgaaatcaccctagctactggtagaggagtttcagagagtacagtgaggactggtccagatgagagacggtctccagagagatttagctccagagctaaaattgaccgaacttggctatggattcagtgtgagagtggaggagagggaagggccgtagcaaggcctgattgagcagaacggatgcagggagggcagcagggggcatctgctgagcgaggacaggagactcatgcttaggagggagtatcatgagctctgttaaggacatgttaaggtttttgttgttttgagacagggtctcgttctgacacccaggctggagtccagtggtgcaaacacagctcactacagccttgacctcccaggctgaagcagtcctcctgcctcagcctctcaagtagctgggactacaagtgcctgccaccatgactggctaatttttaaattttttgtagagacgaggtctccctatgttgtctaggctagccttgaacgcctgggctcaagcagtcctcccacctcggcctcccaaagtgttgggattacaggcgtgagccaccacaccaagccacacattgagttttaagtgaggctttgaaactgccaagaagctgggcgcggcggctcacgcctgtaatcccaacacttcaggaggccaaggccagtggatcacttgaggtcaggagttagagaccagcctgaccaacatggtgaaacctcgtctctactaaaaatataaaattagctgggcgcagtggtgcacacctgtaatcccagctactctggaggctgaggcaggagaattgcttgaacccaggaggcagaagttgcagtgagccgggatcatgccactgcactccagcctgggcaacaagaccaaaactgcatctctcaaaaaaaaaaaaggtcaagaagaggaggttgaccatgccagtgccatgtcgtaaaagccaaggaaaaagaacttcaagaggaggaagccaccagggtccccgcctcccagaaggcacagagatggaggctgagtctgccccttggtttttatttatgtatttatatttattttttgagacagagtctcactctgtcaccgaggctggagtgcaatggcacgatctcggctcactgcaagctccacctctcaggttcacaccattctcctgcctcagcctcccgagtagctgggactacaggcgcctgccaccactctcggctaattttttgtagttttagtagagacggggtttcactgtgttagccaggatggtcttgatctcctgacctcgtgatccacccgccttggcctcccaaagtgctgggattacgggcgtgagccaccatgcctggctatttattttttttgaaatggagtctcgctctgtcgccaaagccagagagcactggcacaatctcagctcactgcaacctccacctcccaaattcaagcaattctcctgcctcagcctcccaagtagctgggattacaggtgcccaccaccacgcctggctaatttttgtatttttagtagagacagggttttgccatgttggccatgctggtcttgaactcctcacctcagtgattcatccatctcggcctcccaaagtgctgggattacaggcatgagccactgcacctggccaaactgccccttggttttagccacaatgtctgtgttgataagggctgattccagatcacagtgactagagaagggtgtgagaaacgcaagaggtggacagtctgagaaatgaagttgtaatggagagatgagagaggaagagtgacaggaggatgtggtggatttagggtttttttctttttctttttcttttttttttttttttgagatggagtctcgatctgtcacctaggctggagtgcagtggcgcaatctcagctcactgcaacctcagcctcccgggttcaagtgattctcctgcctcagcctcctgagtagctgggactacaggtgcccaccaccacacccagctaatttttgtatttttagtacagacagggtttcaccatgttggccaggctggtctcgatctcttgacctcccaaagtgctgggattacaggcatgagccaccgcacccggctggtagatttaagacagcagagtcttgagcaaatttggctgccaaagggaaggacattgacctttaaattgtactgagtactgagagtgaggcaagagatatagacaggaggggtggtatgtagatggtagagccttccttagagcagggggtgggtggtgggaacccagaacatgggggaaccggcctgagatgggagagggatagtccctccgcaagtgcagagaaggagggagactcaggcagtggtgcactgatgaatgtttaatatccaaatctaggacacgggctgggtggggtagctctgatttatagcatttgctgatatccgcggagttaatactctgactgtggtcaatttcaagcaccaatctgacttcactgaatacagcgctggatggggattccagcaatcagctctcacagctggtccaagccagctaggattcagaaacccacagtgaagcccgtggctatagggtcacaacaggggccagccaagcaacacaacagagatgggccaggcataaaacaacaggagagaagggacagggctcagccaatgggaccctgagggttgcaggctcagatggctgggtgttcccattcatctttcctttttctttttttttgagagggagtctagctctgtcacctaggctggagtgcagtggcatgatcttggctcagtacaacctctgcctcctgggttcaagcgattctcgtgtctcagcctccccagtagctgggattacaagcgcctgccaccacacctggctaatttttttatttttagtagagagggggttttgccatattggccaggctggtctcgaactcctgacctcaagtgatccacccacctcagcctcccaaagtactgggattacaggtgtgagccactgcacccagcctctctgtttctgcttgtttttttcctctttcttttctctcatctctcccttctctgccctggcaactggctcatcacagatgagcaagacatagatcctgcccttaaggagcttgtgaactgatggggaaccttctcaggactcagtctgctgtccggaaaagtgggggaatacctgccaccagcaccccaccaatggggcagaggcggtgggaagtgcagggcggctcctcagacactcaaagaacaggcagggacagcaagggcattcctggcaaaggaagggcactgcccagccaaaggtggtgaggtgcgacagcgagctgaccagcttgctggggctcagacgccaaggggtgtggcttggaagccagtgaagctgaagcgaaagcaggggcctggacctcacctgcctctgtaggcccaatgaggagctcaatgttatgggaagatagccagaagcaattgaagggcttaggacagaggtgtggcatggccagatctgtattttattttattgtatttatttattttttttttgagaaagagtttcgctcttgtccaggctggagtgcaatgatgcaatctcgagtcactgcaacctctgcctcccgggttcaagcgattctcctacctcggcctcccgagtagctagaattacaggcatgcaccatcatgcatatttggtatttttagtagagacggggtttcatcatgttagtcagactggtctggaactcctgacctcaggtgatccaccggccttggcctccctaaatgctgggattacagacgtgagacaccgcacccagcccagatctgcattttagaaagacctttttcactgcagtctgggagacggtgaggaggctgcagtcagcaggtagtggggaagaggaggataaaggggctgctgtcctattgagctgagcactgtctgccaggccctgttctaaatacgttccatgtaacttttcaaacaactcttggaggcatataccattaatgctcccattttacagataagaaaactaaggcttggcaagattaaggaaccaggtaacacggtatgaatggcaagaacaaatgtaagaacctgcctatggctagatgtggggatgaggcagagggaaggatatgggagcagttccactctctggtgtaagggggcggtgccacctgggagacctgaggcctggaggaggatgaaggggctggagaagaggaattcagtttggaattcctgggggccttagtgacatccaagcagagatgtccgctgcagagagacacattcattcaagtcttccaggagaggctggctagaagtagatttgagagtgtgcacagggatgtgcttgaagtcatgggcatggaggagcttggtcagggagtgtggggttgaggagaagcaagccctgaggcttatgggggtagggagggagagcagctggcaagggattagtgaagggagcagccaggggcagggggagaagcaggtgggccttggggggactcagggtacaggaggggtcggggagagcaggtggatgtcagcagcatttcaagcggcagagactgggttgagaagagtctcctaggaccaaagaacaggcatagctgctcaggcctttgcgagggcgttttccatggagtggtggggacaggatcgggaagccaagggcttgaggatccagtgggcttgaggggcttgaggatccagtgaggaggcggggacagaatggacaacctgtccaccagtgtggctgtgaagggaggaggagcagatggaggcaggtgagggcttggtgttgcaaaatgcttttttttttttttttttgagacagagattcactcttgtcgcccaggctggagtgcaatggcgcgatcttggctcactgcaacctctgcctcctgggttcaagcgattctcctgcctcagcctcttgagtagctcagattacacgcctggctaattttgtatttttagtagagatggggtttcaccatgttggtcaggctggtcttgaactcccaacctcaggtgatccgcctacctcggcctcccgaagtgctgggattacaggtgtaagccactgcacctggcctgtgaaatgatttctcatagcatgttctaacatttcacatgtacaactttgattttaatccatttgtaaagcttcagtcactgactcctattgggaacctccaaagcacagtaaaatttcagctatccaggattcttggcaaatgagtcattctggaaaaccaacttttatttggatgaaaatatttgaaatataggatttctttctttctaaaaaaaatttttaatgaaaattttcaaatatataaaaataggccagtgttgtggctcacacctgtaatcccagcactttgggaagccaaggcagaaggatcacttgaagccaggggttcaagaccagcctgggcaacaaaacaagacccccatctctacaaaaataaaaattaaaaaattagctgggggctgggcgctgtggctcatgcctgtaatcccagcactttgagaggctgaggtggacggatcacctgaggtgaggagttcgagaccagcctgatccaaaatggtgaaaccctgtctctactaaaaatacaaaaattggccaggcgcggtggctcacacctgtaatcccagcactttgggtggctgaggcgggtggatcacgaggtcaggagatcaagaccaacctggcaaacactgtgaaatgctgtctctactaaaaatacaaaaaaattagctgggcgtggtggcaggcgcctagtagtcccggctactctggaggctgaggcaggagaatggcatgaacccggtgggggcagagcttgcagtgagcggagactgtgccactgcactccagcctgggcaacagagggagactccatctcaaaaaaaaaaaaaaaaaatacaaaaattagccgggcatggtggtgggttggtgggtgcctgtaatcccagctactcaggaggctgaggcaggagaatcgcttgaacctgagaggaggaggttgcagtcaaccgagatcccgccactgcactccagcctgggtgacagagtgagacttcgtctcaaaaaaaaaaaaaaaaaaaaattagctagcaaggcacggtagtgtgtgcctgtagtcccagctcctctacaatcctgccattgcacttcagtctgggtgacagtgagaccctgtttcaaaaaataataaaagtagaagatataaggaacccctgcatcccgccatccagcttcagcacttaccaactcaaggtcaattctgtctcatctctaccccacctgctcaccaacaagccctggaatattttgaagcaaatccccgatgttacagcaattcatctgtaaagcttttgtatgtttctccaaaagacactttaaaaacataaccacaagccaggcgtggtggctcatgcctttatttccagctattcaggaggcaggaggatcctttgagcccagaagtttgagtccatccttggtaacataggaagacaccacctctcaaaaaaaaaaaaaaaggccaggcgcagtggctcacgcctgtaatcccaacactttgggaggccaagtcaggcggatcacgaggtcagaagatcgagaccaccctggttaacacggtgaaatcccatctctactaaaaaatacaaaaaattagccaggcatggtggcgggcacctgtagtcccagctacttgggaggctgaggcagaagaatggtgtgaacccgggaggcagagcttgcagtgagccaagatcgcgccactgcactccagcccgggcgatagagcgagactccgtctcaaaaaataaataaataaaataaaataaaaaataaaaaacataaccacaataccatattagttctcaattttttttttcgaaatggatttttgctcttatcacccaggctggagtgcaatggtgcaatctccgctcactacaatctctgcctcccaggttcaagtgattctcctgcctcagcctcccaagtagctgggattacaggcatgcaccaccaggcctggctaattttttgtatttttttttagtagagacagagtttcacaatgttggccaggctggtctcgaactcctgacctcaggtgatccacctgccttgggctcccaaagtgctaagattacagacatgagccacagtgccctaaaatttttaacaattcctcaatatagtcaaatatccattgttcaaaaatatccattgttcaaatttccccaatatctttttttttttttgcagttgggttaaaatttggctccaaacaaggtctgcacgttgcgtttttgtgctgtctctaaagactcccttcttttttccatgtaatgcttttgttgaggaaaccaggctgcttggaaggatgagcctgggggaattcgggagagggagagagggggcagggaggagagaaggatgggtgtccagatagatgtgccatccatgctgggggacacaggcagaatgtggaggcctgtctccctaactgggaggggaggccagggctgctgaagggtgggggccaaccctgggcacccccccttcccctctgccgcatccaactgctggaagtgatgggagacagaaagatggcctgagtcaggagcaggggcagagctcaggttgtcgtggggtcccgctgcccacgtcagactggaggtgagggatgggcggggcctgacagcaggcctggaaggaacaggatgtctatgctggagatagagggagaggacagtgccaaaacccagctcctggccagtccccagctcctccctgcctggccctatcccaggatcccctccccggcctcccagctatgatctaccccggggcccagacttcaggcgccttcacgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggaggtgaggggcaggggtggggaccagctatgcccagggtccctcaaagtgctggaggggctgtgacttggtggggagtgggtctgtcacagccatcctctgtccagggtggggcaaggcctgggacagtgccaggcaccccaggaccccttccaggcttgtctcctgctccaccgcctcaacaccccccacccctgcccaagctgtttctcctctgcctctctgcttccctgccccaggacttctctcttctcctctgcctctccttggacccctgcccttcctctacctctgacctgtgaacacacagacacatgctcacacactaagtcccaggcacacagaaggcaatgtggaccagcacaaacctccactctcccggctccatcccagcgggcctgtggctggccatgagaactgggggctacctggagggaagcatcctcatcccaggtgagtgggcaccagcccttccctgtatgtgtgttgtgggtggaagcaggcatgagagcatcttagcccataggtttgtattcagggacttccaaacccagacctacaaagagtgtgtcttctaccagatcttgttcaaaaaagggtttgtgatgatggaactacacgatagagggagtgagcaagaacaatgaggattagagtggagcgtgaaatagtctaggagcatggcttccaaaacatatgctgtgaggtctgtccacctgagagttgggccatggatttaattctgagcctcttagcaggcaaagcaaagacagaaagcagatcggctgtggatttctgtctataaaatgtgagttcttggccaggtgcagtggctcacgcctgtaatcccagcactttgggaggccaaggcggatgaatcacgaggtcaagaggttgaaaaccatcctggccaaaatggtgaaaccctgactctactaaaaatacaaaaattagctgggtgtggtggcgtgcgcctgtagtcccagctcctcaggaggctgaggcaggagaattgcttgaacctgggaggccaaggttgcagtgagctgagatcctgccattgcacttcagcctgggcacagagccagactctggctcaaaaaaaaaaaaaaaaaagatgtgagttctgagaaatggcacgattcctaactaaagccaggacaaaatatcccttttttttttgtgagatggagtttcactcttgttgcccaggctggagtgcagtggtgtgatcttggctcactgcaaccttcacctcccagattcaagtgattctcctgcctcagcctcctgagtagctgggattacaggtgtgtgccaccacacgcagctaatttttgtttttgtttttgtttttttttttttgagacggagtctcgttctgttgcccaggctggagtgcagtggcgtgatctcggctcactgcaagctccacctcctgggttcatgccattctcctgcctcagtctcccgagtagctgggactacaggtgcctgccaccacccccagctaattttttgtacttttagtagagatggggtttcaccttgttagccaggatggtttcgatctcctgacctcgtgatccgcccgccttggcctcccaaagtgctgggattacaggcgagccaccgcgcccagcctaatttttgtattttttaagtagagacgggttgtcaccatgttggccaggctggtcttgaactactgacctcagatgatccgcctgcctcggcttcccaaagtgctgggattataggcatgagccaccgcgcccagcccaaaatattcctttaagatgataggccctgtcagtagggtttcttccagtcctccttcatagagacacaggaggtaacaaaaaggtgggctgtttctcacagcaccaagctgggccctgcttcaggaccaggatggcaaaacttatacaacactcactgctatgggccttgccaaatctgggtgtcacagatcatgtgagggagcagaggcaccttctccaagatcacccagtgatgtgtgcattgtctgttcattcattcgttcaccctgatgttcctctgtgcccagcccagagataccaggcagagtgaggctgaaggagcccatggtctggggcaaggtctcacccacaggccttgtaaggctgaaagccttctgcaaggatttcagaggcagtgacagcttccagaggccctgggacttgtggccttgcagctctgagcctccctacccccatccctggcctttatagagcaaacaggctggattagctgcctccagaacgtcctggcagagtctgggccctgggccaggttccaggctggcaggttggagggtggggagcgagctcgagtagggcctctgagttccctgcccccagttcctgccaagactgcctcagtttctctcccattcctttttcctaccatgcagggctccttcctccccgccccaccaccgccagtggcaattctcacacacatactccatcctgcattctttcatcgcagtcctgtgggccggttctcaccttcacatctttgctttcctgctttcctcaccttggaatgccccctaggtcctgtccaccaggaagctctggcctcatttggccacagcctagagtcttgggccttcttgcagttactccctcctaaagtgctctcctgtgttctgtggtctcaggcacttccttttttgtcacaaggcctcagtttcgtcatctgagaaatgggaagggttagacacaaatctctctcgtggtggaaaaagcttgtgctttggagtcatatggagctgaattccatccaatccacttagttccttaacttttatgagcctcaccttcctcatctgttagatggggtcttataaaaacagacagcacacactgcggtgaggcttcactgacgacgtggatggtgctggcattcattgccctccccagcaaaggcccctccagctgtgctgggctctgactcctgcttccctggctggccgcttatttaatggtaggccttggcattgtcgccttctcttccgggagcccagcccgggccaagtgagagagtgaagggggagatggggtgtagtggagcctggggcttgagctgcccttgtccacagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggtgagtgtcctctcccagagctgacagagcggggtgggtcagggaggcgggtgatgagccccggggtcccagtatcccacacggttccctgagctgaggggctggggacctgcaggccgtgtggtacacccggggcaggggccatgtaggctctgtccttggggggctggcttcgtgggacggcatcgggatcttctttgactctccggcagaggatactcaggtgcgtagtggtctcctgcctgccagcccgcctgcccgctcacaccctccccctcccgccatgtccgcggctcaggctgcttctcacctccctgcaggacagtcctgccatccgtgtgctggccagcgacgggcacatcccctctgagcagcctgggtaagggcctgtctggactgaccactcacctccatttttgcactgggaggggcccatcccccccatccgagcccctgccccagcctcctccagcagggggcccaccctgccgggccgccatacttgctggactctctcacttagccgacgtccgcccccctggggcttgattccttcgacccagcagccccaggtgaaatgacacaggctggggcctgtgatgagtatctttgctcccatgatctcatcccatctccaacaccctccataagtggggggttattcgtcccatttacaggtcaggacattgagcccagagaggggaagggatgtgccgtgcgcagtgctgaactttgagcccagacttacccctggagggtcctcgcccttccctgcatagctgtcccttccctttcccctgatgatttggcttctgtccctccccggccctactgcctcctcagtagctgggccggtttgtcagtgtctctcagcaaccttctctcggctcataacaattagagtaattgcctgcatttatggagtgagctgattgtatgccaggcacagcaccaagcccttctcatttactgtcttagttaaccctcataacattgttatgaggtcgttccaattaccatcctcgttttagagatgggaacactggggtttggagagatgagatggcttgcccaaggtcacatagctcggggcacaaacccaggtggctgctgtggtgctggcttctcccctgccctgtgctgcctccctcttggcggaaggcggcactgtcagacgctctgctgtgagtagcctgaggtgtccagagacactcagcgtttaacactcttctcctgactccccagagcctgccgagccgacctgtcagggaggcagcctggtcacattgtccttggctgccgggacatgtccaggtcatccgtcctgagtcagctgcattctgagccctggcagctgggagaggaaaaggaagccagaggcacagaggacttggagtttaaaagaaggaggagggagaggccaggcacagtggctcacgcctgtaatcccagcattttgggaggctgaggcgggctaatcacctgaggtcaggagtttgagaccagcctggccaacatggtgaaaccctgtctctactaaaaattaaaaaaattagccgggtgtggtggcgagcacctgtaatcccagctactcgggaggctgaggcaggagaaccgcttgaacccaggaggcaaaggttgcagtgagccgagatcgcgccactgcactccagccagggcaacagagcaagactccgtctcagaaaaaaaaaaaaaaagagagagagaagaaggagggacgtaagggtgataggacgagggtgataggtgggtcgggggaatggagggcagaaactgtattgttggtccaggcctttgtccccttaaggaagggccacagggaggcccctggccccttctgtaaatccaagtcccaacactccgtcaggcagggcttgcttcccctgctcctctctcttctgccaagggagcagggtacaacaagggagactcaagctagacaaggtacatgtcccatgccagctcgcccagcggaaagggaggtggcacagcaaatctgggcagagtggcttctgggactgccctcactgtccaggccttgagtcctgtatatcctggctggattccaactgcccacaagagtcaggcatggtggctcacacctgtaatcccagcactttggcagccaagacaggtggatcacttgaggtcaggagtttgagaccagcctgaccaacaatgtgaaaccccatctctgctaaaaatacaaaaattagccgggcatggtggtgcatgcctgtagtctcagctacttgggaggctgaggtgggaggatcacttgagcccagcaggcagaagttgcaatgagccacaactgcaccactgcactccagcctgggcagcgactctttctcaaaaacaaacaaatgaacaaactgcccacagggatggagctagccaagggctgggctcctgtcattgggacttccggaaccggccacaccccttcagagcacggatcacctactgggggcagaggctgcgcgtgagtcacccttcctgcttctgacagggctctgagttacagagctgctatgtgtgcgtgcccacggccccaacacaccagtgcctgtgacaccacgtgaggtccctggcacacacgggccaacatccacaggggatcctccatccctacacagaatcctaacactcacccagagcacatacatgtaagggctcacatgagaccaggagtgcgggtcacctccatgccattctgataccaagccctagggccacctgccatcccacggccaggggagccagggagtcagaggtagggacacccccccactgctcactctctccatgtccctcagatgtccttgaacagtggcctcactcccagtgatccaggtgagttctgtgtggatgtggggcccctgcttttggtccctggaggtttctttggggtctcagcagccaccggcaccctggcaggtgaggatcccactggacaggtaagagcagaagggcagtgatgaataaatcaccctcagcacaccttctaaagagcactggggtggcgtcagccacttcaccacatgacctgggcttctgtgacccttgggagaagtcatgtctgccttgagacttgcaagtctcaaatgggataaaacaagagaagctttgatttcagtgctggccacataagtgcccctagctgtgagttgcgggacaagtggaagacagacagcaaagaggggcatttaggaaaatggagcaaagaaatgtgacaccatggagagtccacggagggtcccacagcgggaaagctgagggcaaccagagcgtgggagtccttgaatgccaggaccttggtctggtttctgaggaggagagtgacatggtcagagctatgctggaaaggtggccactgtgcagttgctactaccagtagcagctgtgctctgggggcctaagagtgtcagatggtctgctgccatggctctagcccaggatgttttgggatcgtccagttctgccacaggggcctgcctctgactgagtgtgaggttcaaccctcaccacccacccgtctacctgtcaaccctcacacctttcctaggaagtaagcaagacaagcatcagacggtggcccaaagtcacccctcttgcctcggtgggatatcatggcggttagggtgaaggctgagcgagggggttgctgggtggaggggtcttacttctccttcatctgtccccttccagatgatcatgatgtcctgtccttcctgaccttcagcctgagtgagcccagcccagaggtgatgccagccctggcctacctgggaatggcagcccagggaccctgccctcacccatgtcatggtgccctcagacctgccattccagcccttacctccacctggcctctgagctctgctcaggccagaccttgtgcagggcagtgctgcgggccagggccggtgtgtgaggtctcgcaggctggctggctcaggctgtgacattacagttcagagcgatcagtgccaggtctcaaaaggtgcagggggctgtgggagcacagaggaggagtcccaaccagccagggggtcaaggaaggctgcctggaggagatgagcttaaaggagcctcggaccagcacatataggcttgaggccacagcagggagggaagatggtggggatctgcgtgaaggcagaactcagagggctggaaactgcagggccagctggccagggaggaaggctgggctcgtggggaagcctgtgggaaggctccccttgcttctggatctcccatgggtttggggcccgactttctgtcttcctcccctaggttccccctcagcccttcctggagatgcagcagctccgcctggcgaggcagctggaagggctgtgggcaaggctgggcttgggcaccagggaggatgtaactccaaaatcagactctgaagctcaaggagaaggtagggaccgagagagcgggcaggtggcgcccatctgagtgtcacagcatcctccacccttatgaccaggggtcctttaatcagtagggaaactgaggcctgaggaggccacatctaagcaggccctgggcccaagtgttctgtgctatccccaccttaccactcagactcatcttccaggagagggtcttggaggcagcagccacaccttctggcacccctctccaagaagccaccccaaagataagataggctgtgttaccccaccatggctggctgcccatcccagctctgccctaatccccaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggtgagaagccctacaggcatccaaggctccacctgcgggcctgaaagaggagcaagcactgtagtcagcaactagtctcccctaaggcctggagggaaaggaaggcagggatgaaatgctgcaggtcacaggatggggcagggcagcatgcaggatggcatctctgcacaagcaaatgcgcacggggctggggctgaggctggggctggggagaggagatgccagctatttggactcagctctgtagatgaatgacagaaatagactaggtgctaatttgcatgtagcttcacatgcgatttgcatagggcttgcttaatgctcagttgcaccagaagcctcattgcatctccattgccatctggctcctcccccagggagtcataactcgggtcatgcccagcctgggggcctgagagctaaactcagccaaggtgttagatactgggcagaggaggccagcagctcttgtgggctttgctgggctctgacagctcgaggttttaatcttgtgtcagagcagcttaggctgggctgctagtgtggggaagaggggaggggacttacactccagggccaagcctctctgatcctatccccaggccctggatgcttcctgccagattccatccaccccagggaggggtggccacctctccatgtcactcaataaggtagggacccaaacactgggtgttgaccagcactggccccagcttggctggtgctctgggagaaccagggcagagaggactgggctgggcctctgcttccttcaggggacagaaccacttttagaagggagacgtattttggcttggcatggtggctcacgcgtgtaatcctagcactttgggaggccaaggcggacagatcacgaggtcaaaagactgacaccatcgggcagatcacaaggtcaaaagatcgagaccatcctggccaacatggtgaaaccctgtctctactgaaaatacaaaaattatacaaaaattagctgggcgtggtggcatgcatctgtagtcccagctacttgggaggctgaggcagaagaatcgcttgaacccaggaggcagaggtagcagtgagctgagattgtgccactgcactccagcctggccgcagagcaagactccatctcaaataaataaataagaagggagaagtattttgagaaaaccctgaagtggccactgttgggaggaaacaaccacccctggggagaggggcgtgagtggagggggaatgtggatgcccttatggatgaggtcagagaaacacagtgtgtccaaataaggaggccctggtaatctgggaaggcctctggaaggaagaggctgcagtgccgctgggaaggtgggctctgagaagagaggggctatgtcctgggccctagacaagaggctgcccctctgcaggactctgccaaggtcggtgccctgctccatggacagtggactctgctccaggccctgcaagagatgaggtaagggactgggtggggacccctccaccaccttgtttctccgccttaagttcctccattagcccttcattccttccatcatttcctgagcgcccagcacacagcctgtcaattggaagggctactggtggagttaggtttgttgagttgacttgaatttaattgaatcaagtttaatgttttgcaagtcctagttaaaaagcaattctctcctggagaagcccatcatgaaggccccctcagacactcccaccctcaggaggcttaagaaatctgagcattccttcaatggcagctcctaggatgaggggcattttgttgggggctcttggagagggagcacagccaagatcagaccagttggatgagacagtccctgacttggttttgtgcccccattaacttcccggtatcccactctaggccaggcctctggagccctgggggttgggggagtcctggggatgctgtggaggaggcatgcatcccaggctgaagcctaaagccccacctgtacacacacagctagatgcctagggttgggggtggagaggcacctagatgagaagaaggaaaggagttaaatccccaggggctgggaatggaaggcagagccggggagcctggggttgacacagatagctttagggagatctttatctgagctaaagtctcaggatctaggaagaaggttggaggtgaaaagaccagcccccaagaaggggccccatggatggtacctgttccccatccatgtgctgcccttggggagatgggaaatgattaggccatctgggtggaagcagaagaggtaatgagtcatcttacttggttaccacccccggttagggatgcagctgtccgcatggctgcagaagcccaggtctcctacctgcctgtgggcattgagcatcatttcttagagctggaccacatcctgggcctcctgcaggaggagcttcggggcccggcggtgaggggaaagtagtgggcagcatggggtccccaaccttgacgtctgggctcagccacccttcttccagcacttcagcagccccaagccctcctgcctttgccctcccctcccaggactgctggcaagcacatctgtgcctgcgtcagtgtctgtgtgtccgtgcatacgtgccaccacacatctcatcttttctctgtcctctctcctctctgaagagtcccacagactcagcagcagcagggccctggacacccctcgatccaatatccaatgaccagaggggaaacagggtgggctgtgtccaagatcactgagtccagtggtagtcagcgcttccccatgccctgtcccatcctcgttccctcgccctcaccctgctcaccctgtctttggctctttacttctctcttctcttctcttgaaccctgggccccttgatgatcccaggccccaggccttcccagctgttcccacagatgcagccatgggagctggggtgggggaggcagctttgtacactgccccctctccaagttccctggatgagagccaggacgccccaagcctggggaaaggaaacggagcatgcacatggcctagattccaggtcccccactccttctgggtaagaagctaagctaggaccttagactttcccctttcagaaggcagcagccaaggccccccgcccacctggccagcccccaagggcctcctcgtgcctgcagcctggcatcttcctgttctacctcctcattcagactgtaggcttcttcggctacgtgcacttcaggtgggccaccccgtgagcaggatttcccacagcactggcatctcttggttctcagctataaccattggatttaggagaggggacacttcagctcagaggggacctgccgagtccccaaatcacaaagagcacagtgcgggatagggcccattctctcaccaagcactactgaccacctgctcggcccccagccccatctgggtcctgctctcacggagctcactcacacaggtctaactgaccctgtgtcgtcaatgccatgatgtcaggaagctgaggggctacgagagtgcaggagaacacacttgaccccccttggttagggaatcaacctggaagggacatttgatatggtcattaaggtgactaggagttttccaccctgacaagataggtaaaggcatagaggcagagggaacagcatgagaaaaggcagggaggcatgagaaaaacataatattttagagaaaaagtggcaagttcagtaatgttggagcaaagggcaggacgagtttgtgaaattgggcaaagagatctgaaaaagtgagaggaggtcactagttttgcttggtgtgtgtttgctgaatgaacgtgcaccgtttagagatgtggggtgtgctaaaggcctcagcaatgagactgacaatctttgttggtggaatttcaagacaagaagagtccgtgtgggctgggatggtcctggaggaggagtaaaatgagctaagctttaaaaagcacaaggtagaaatgctcacaggcttcagcacatgcacaggagtgcagtggtggcaatcagcctggagccactaggacagaccttacatgcccagggggaaagcgtggaccatatgcagcgggccaaaggagccacagaaagtccaagaacagcggaggttgtggtgcagtgagtgtagcaaggcaagcatgagagtcctggtttttcaaaagcccataaaggagagacgcaagtaacctgtaaccttctctctggcagcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctccccatgctgtgatatgctggtcttctttccagcctcaccctaatctctgtgaaggcttccaccccttctgagtacctggctgggagtgcgctccaagcaggcaaggaggccaaggcctggcttaacctccaaaagaccggataccccacgggctttgaaccctcgactatggagggaaagagagccatgactgtatataattctgtcctcaaactcacccataacagagagcagtgtctcccagtgtccctcctggcccagctcagccagcatcactgagcagctctctccctccccactcctagctgctccaggggcagcaggggaggcgcgtgacagagcaaccctgagaggccaactcgtggaaccataactgggattcccgctcgcgccctcaggtctccctcccttttccagcgtcaagctctctgggcagctgctgggttcagtgacttgggtgggtggggagaatggggggcacccaaggctgggtttttaccccttgctgctacctggatctcccagctgaaatcctagttattagtggcccaggagaggagaaagttggaagaggctatggaacagggttccgggagtgtatgagctcaacccctctcccgggagagcgaccccaccaccgcaggccctaatcctctgtcagcagtgcccagcggagctcggcgttgaaggaggcacgtgggggaggcgggagtggggagcgggcacgtggtccagccttctcagccccgtgctgccccccgcccccagtgaggaggggtttggggaggtgggggcgggcccgggcgggggcgggcggcgggcggtgccaagcgtggggcgcgggcccgcggcgggagctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagtgagtgggatcccttcctggctccaacgacctcccctccccacccccacagctgctcagtccatccccgggccagcctcaggtcccaatcccttctcccctactttcctagacacggtaagagaccgggaggtgtcctctacactgcccccagacccatcctatctgacacccaaaaccccgctccagcatcatgctccggccaagggggagtggggggaggggcgaccggacgagggaccgaccggagcctgggacgaggaagggggtgcacgtgcgtttctgacgaaacgataatcccttaatccgatctggtcccagccgcctatgtcttccaactggggctcctctgaacttgaggctctgaaaaaagtggtgcagccgctcagagtcgcggagacagaccctgagatgggggcactcacaaacattgagcacttgtgtgcccgcagtgctgggacagagtttggggctggactctgctgctaggctacttgggttcagagcctggctttgcctattagctggataactttaggcaagttacttaacctttctgtgcctctgtttccttttctggaaagtggggatggtaatcataatacatgccttgtatatttatgaagattaaatgccaatgcatgtaaactgtttagcacagcacctggcacatgataaagtctcataaatgatagctattatttcgctcaatcctgataacagttttgtgagttgcaaaattttatccccattttacagaagaggaaggtaagtgacttacctaaggatatacctaaaatggtagtggagctgggatgtgaacccaagtttggcctgaatacttttccccacatgacatagcttgtcagtgagggaacagcagaccaagttggaggccatgagggacaaataattaggatctgcagagagagccagacagactgccaccctggttccctagttccatccagtggcagagacgacaaagggcactgtgatgggcagaggcagcagaaacctggatgtccgggttggagcgcttttgctacacacagggaccaatgcagcagctgctaggactcagagaccccttctgtccctccctcgaagacctcaacccccttctctcagccctcgtggtgactctgcctccggtgaccctgcaggatggagcgggatgcacagttcacacagaggaaggcagagcgggccacactgcggagccacttccgagacaaataccggctacccaaggtaagctggccccggctgtgaggcacatctgggaccctgagctctgggttctggactccttcgccccattctgggcaccacagccctcagctatgagactcacagggtatttggttagatccttccttctcattcatttgttcttttattcattcactcactcgtagttaaatctgtgcccaccaagggccagggctttgtgctgaggggaccccagtcctcatgagactgacaggtctgtatttctggagccaatctaggcctcttctctcctccaccccccatatccccaccaagcctgggccaggcctgggcagaggaagacacaggggaggcagaaatcagtagatttgactgcagaggtgagtgttctgggggtttctgaacctactgaagggcagaacttacttaaggtgggggagagaagccctgtgtgtgccaagtacttgaccttcatgtcctcatctaacccccaataatgctgccaggcagctatcacccacagcgacaaaagatgaaactgaggctaagagaaatggagggacttggctaagatcatacagccagtgagccatggagctgggaccagccctcaagccggtgaatatgagcctgcctttgctccagggccccaggctgctttccagagtatggagtctgcccgtagagagccaagtacccccttggccggccaagcagccagagagtatatctcaggagatccctgcccccacgctcccctgggcagtgcaccaccagatgggcgtgtaagtgtgctgctcctgttgtctaaggaggggaatgaagcacaaatctctcccagaatatcaccctagtgcatccagaactgtgctggactcaggggaaaacagcacagggctatagcgctcctgattttgatcttccacttgaattgaatgaccaaatatatgaacatcacattcactcattcaacaaatatttactgagtccccagctgcttctgactccccacagggcaccaatcttttggaaatctgtcacggggaaaaaccggtccagaaagcctgcctcactgcaaactcttctaggaataaaatcattcctcagatgcttgcgctaggcatataagagacacctgccatcagcaaagtcagagttgagcagaagagccaagacttggatgcaactgagtaggacataaggcgccccccagaagaatagtgaagggcaatggtcatcgtaggtgccatgcaaaaaaacacagatgttggaatcagtgacataggtttgaatctagctccccaacatcctgcctgtgtgatcttggataatttaagttacttaagttacttaagttagttaagtaacttaaatttaaagtaagttacttaaatcctgtaagcctcaatttccttatttgtgaagtggaaataacaatacctacctacctcacagggttattgtgagaattaaaagcacccagctcaacgtctgccatgtaatagatataatagatgtttgataaatggtacccatcactatttttggttacacccttaagcataacaagagtcaaaacatgacttagctgactgtaacagtgtgactcataggtattttcattttgtctttactcactgtgctggtccttcagcatctcagagtgaaataaggtaatataaaaaggtctccatgtccaggcatcaaacgcttgatcctgggatgtgggggtgggagctgagctcactggaacatggggctcaagaatctaaggggccgggcacagtggctcattcctgtattcccccggcactttgggaggccaaggtgggcatatcacttgagcccaggagtttgagaccagcgtgggcaacatagggagacctcgtctctacaaaaaaaaaaaaaaagaaaaaatagaatctaggggcctggaacccagtccaagcctcctccctgtcctctcaactctgggtcctcacagacttccactccaccccaccccctcttcccctcttcccttcagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtgtgcctaccttcccacttcttactggcttccaggagtcttggagttcatagccccccgagcctgccttaaaggggtgtcctccaccccccacctacagcttcacaggaggggagaaggcatccagtgctaggagtagaagtgtctccagctctgttctcttggggccctgggtgaaggtggggtctggggcttatgaaataggtctgggctttgaggaggatggagcagcctcattatgtggggaagatggggcctctggggcgtcactgagaccacaggtggggccggggctggaccgcagctgtcttgggtgcctgtgcctacacccctcctcaccctagagacggaagatgtgcaaaaagaaagaaggaagggcaactgcattccagccccacactgtgatgactttgagcctgtcctttccctccttgagcctgtcttgcttgtcccctgtaaaatgaacagtccccctctcccccaaatagtaataatacatgtttcaaagggtgaccatttataaagcatatgacaaaccatatcaataaatgtaactcattcttttaaaaaaatgaagagcccagatctcatcccgctcacctgtggcaggggctgaggggcaggggtcaggggaggtttaagaaaccagccaggaagctccccaagcaggtcgccccaggggcctgggcaggaggaaggtgctatggggccaaccctaggtgccccaccccgaggtccagggcccggcctgtagggaagccagccaaggttcacaggcaggagcggctgtctgaggattgggtttcaagggcaaagtttccatgaggtctcctttgtaaaataaaaacaaggcatatacaacctgtacaggagatcatgcggggctggaagagaggagacagggcagggagagacacaggcccagccctggagtctgctgctgaagctgtcactcttggtctcactctcctgagtgtccccagggaatgggcctgggcctctgagctgctcctgggctgcccccaggccagggcctcctcctgaccttctcagagctggaggagacccaagccagagccccaagccgggtaggggggtcatgggctgcctccgcagcatcagcagcaaggcccacgtcagcactccgccctccggggccttctgcctaatgggattcgacagaccccttccccctcagtgcttcgcagggccgagaaggagaggcaggggtggtgggcagtgggggctggggaacttgcactcgctgaaccctgtcaaagcaaggctggttggaacctggattaaaggtcgggagaggggtgagcccccacattagtttccccttcaccctgggagcggaactccaagaagccctgaccagtttgcactatccctggaatggggtggaggaggctgtggggctcagatagagatggacaatgagggtaggctgaggggtccctggctctgttgggcatgcctggcctcccttcttccttccccctccccatcagccctgcaatctgggtctctgtcagtctgcacccctctcacctgtgtgccctcatgccctgctgctctgctggctcagtgcctgtcctgtatctgcccgcagctgggggctgacttggcccaactggagctcttctgcacctgccccccaactcccaagccctcgagccctgaatacatcaactactactctcttcccaagctgttcccaccctctcttatttagacaatccaatgtctaactaggatatttacatatttgtcctgtgactggtccacccacctggtgtgatgtgagggccacagagtcatttgccaccaaaacttcccatttcaccctctgcctagaaccccgttagtaccccgtagttaggactctgatgtttcaggcctgctccttccttccctccctccctccttttcccctttcctttctccttcatacccttgcaggcagtctgagcatacaggaaatgttaaaaggtagttaagagagcccctccaacttccccaaaccccttcagcaggagggaagaggcagagatggttgcctgtcccaccacctttcaccctcaggggctctggttccacaatgcagatttcagggaaaccctgcccaaggagcctgcagtcccctgctcctaccttctacccacccggacagctcaggcccagttgccagcaggaagagggtgccaagagaacaagtgactttcccaaggccagctggtccccaggaaggaactggggagggtgaccagggtttgcagcatggaggatctcctcttccctcaacagccagatggttcctcctcagacaccggaggccccaggcaggcgctaaggacacctgggacatgcttgttagctgagccgagctgctgacattgcctgttgacccagctgacactcagccgtgaggctggagcttctgtcctctatcccacagacctgaggtggggctgggggtgtagttacagggtccactgccatgcctccaacccaatgcctgccaggcagagctgtccccagaggccatttgaggtttgagatcaggggagcagcagcagcactgaggcagcctcagcctcattcagcaggagctgcgcctgcatgtgtgctcatgagcgtgtgtgtggggcctgcgggggtttgtgagcctgcacacggctgtcttgtgtctgtgggatctgctgtgtgtaggtgtagtatgagttcctctggggaagctgtcattggtgtgctccttcccttgggccccagcctcggtgttgggccattgccctttcagggagggctgggacagcaacccggcctctggggacaaaagcccttctagatgaccttccgcaggaacaaaggtcctatgtcctttcccacatcccaggtaaagagggtaaagaagggccagctggacacctgggtccctctatctgcttctgaggcccatctgcatcttccagggctggccccgtgggagaaggcttgggtgcttcccccagcttggcccagggctggctctgtgcttgggtgactgggatggaggtaggaggacagggcagtcccctgaacgttgctaggaggtagccatcctgctttgggcacctacagagtgttgaaagtgagaggcaaaaacaactctgcctcctctgaaggaaaacatgacctttagaaagtggatctgcgcatttcctacaggcctctgccgttagaagcaagccctgcccccctcgccccagcctccggactgcgctgcctccctgcttggcaggcggcttggacacaggaccaacctagagaccatctagatgttttattcaagaagggccccttcccaggggctcctccagcagcctcagtccccaggcctttcgagtactgaatcctccctgtgggggcccactgctctccacacctacctgcctaagaacttcaggcctctgttctcagccagccaatatagtgatcacaaataagcaactggagtcgatgggccaaccctttctctattgcccttcaattctctctagtcttccatctcgtctttcatttccactcttcctcccatcttctttttttttttttttttaagacagagtctcgctgtcaccaggctggaatgcagtggcccgatcttggctcactgcaacctccgcctcccaggttcaagtgattctcctgcctcagccttccgagtagctgggactacacgcgcccaccaccacgcccggctaatttttatattttcagtagagatggggtctcaccatgttggccaggctggtctccatctcctgacctcgtgatccacccgccttggcctcccaaagtgctgggattacaggtgtgagccaccgcacccagcccctcccatcttctcaattcatccactcaaccaggtccattcattcccctcctgttccctcactttatatattgaggcttttttgtctggcccatttccagagataatctgaagtacctttctctccttagatctgaaagtcacattttattgtattcttactgtatgccatgcccatgtgcaacatctcattacacatggggcccttatcctcaacctcattctatgaagaaataggctcatcgatggatcctaaacttcaaggccaagtagcagagccagaattctagcagttcctcctgccctctgggacactgctccacactgccccccgatggccaggccaggggcttcagggagaatagttcccagggtctgttcccatccaggtatgggaaaccctgggatgactgagcaacccgggggcatgggtaagtctaaggaactgctcccctgctggctgccaggggatgtgctcccctcctactcccaacaagtgctgatcagattgacacctggggtgtacgtggggttgggggaaggccagggtacagagcctgctggaaatggagaccctgggggctgggtgtgagcatgatacctcaaaacatgccctttcctccagtccagctcactgctccctcagtggcccagggtaagggagggaaggaagccaagagatcctgtctggggtgagacagtgtgcggtgtggagggcagagcatggtggaagattgcactcctggagctgagccttcccagctcccaggcctgtgctcctctccccaccggtcgcctgggtgtgggcagcaatgaccctggtcagcccttctcctggatctctgggggctgagggcagatgtggctatcattctcagcattcccctccatctcgcgacctctccggccctacctcagcttccgcagcttttgctgcagtccttcttgccccagcctgtgggcagcggccacctctcctgtcgttcttaaggcaagaagagacgcgcaaatagagaaaataatttaatagagaaacaatgaatgatactctttacactcagcctcctgcagggaggacagacagctcttgcccaaggaagcatttaagggcagaagggctacaaatcaccaacacccgctgattatttaaaagaaactctcaaatacattcttttccaggttaaattcactttgtcctcataagtgcccatgctgtgggctgtgaaggtatcagccccattgaagagatggggagacccaggcccagaaaggggaaagagcttgcccagggctccacggcggcagggcaggcctagaagtgggtggcctagagggcactgggtcagactgtctccaagcctccctctccctgtcccaggctcaaactccagcacaaggcccgcgctgtggctagtgtggggcccagagggaacggaggtgggagagatgaggaccaaggaaccctcctgagtgctccctaggccagggcaggaacaaggcttgggcttcttaaaccccaaaagatccagctttcatgcttgagggattaacctaaagtaccaagatggcgggcaggtgtgagttcccagaaagactggtgggttctgtggggctgagtgcatactgtggggagggtggtccctgaggggtgttggagtgccccattccagtgcaaagaggagctgagttggaataaggggtcccgggaagggcaggccaggggcacagctgcctgctggcagggcgagggcaagcacagaagtaccctgcgggggccccttgccctcttctcggagccaaaaatgatagagggctgcatgccccaaaacggacaggcacaggacccagtaaccaccgagtaacaaaggtctcatgaaagaagtgctgttctcccagagtcctgccctcccctccagtatacagcacagccatcaaaccatctgtggggtgcagagtaacctgagggaggctggggactctgggatatgggggtctcagcactgtccatccaagaagcctgctcgccagggctgcagtgggccacttcattcttggcgtcagcctgggttagtgcccctctgctccagatggctcacatctgtccaatcattcttctagggtcactgaagggtgcaagctacgggggtgagggggacaatgggggagggtcagtctcaggtctttggtaagggaggcagaacccagggcccccagccctcacccctccttggatggaggatcgaccccagggcaggactcacagctacgaacagattccgacagtccctctttgtccagggtgtcagcttcccagcgagattccctcatctgtgggatgtgaaggcagcacaagggatgagaggcagacacacgagccacagcgcagtgccgagcaagtgagagagtgaaggacggggacacgagccacagcgcagtgccgagcaagtgagagagtgaaggacggggacacgagccacagcgcagtgccgagcaagagagagagtgaagggcagatacagggacagggaggcctgcagaggaggcgagagagcagacatacaccagcagggggggacgacagccacaagcagagagcaacagaacccacagaccctagccccagcgtggcccccatgtgcccaccttgacctgctccttcaagtattcagctcgggccatgaggttctgaacctgccaaggaaagatatgcccttgggtgtgggggagagtggcggggggtggggtttcaaagggaactcctcctcacccctgatgctctccagaaccctctgccccatcagaacaacttgcctcctgagtcccttatctgctccttcctccaggaagccttcccagactttttgctgctgggttcccagatcccccactgccctgtctgagcaccccagccctatggtttgacttccagacttggaacaccctgacagtgggacattccagagggaacccaaagaggtccccacaggtaagagcagagaaaggggaagaggaagccccccaaccctctcaagctcagtgggcacctcagtgtgaagcagctcccgcctccggcccgggggctccgctgtaaagagagggtgtgtggtgaggacagggtggccagaggccctgtggggggcataaatgggggccctcacctgccagcaacagcagtagctcccccaggctgtgctggtacaggtccagggcatcctgctccccgccggcggcctcctcctgcagccacaaggacaccaggctgcttagggtcatggcctgggtatctccctgccctgccccgacccacctggacccctcccactggcacaaaccttggccatggcagctgaagccacttccagggcagctaggaggcgtggcttgtcccgggccatctctgagatgaggggaaaggctcagggtgagggaagcaacctgcctgttcgctgcaggatgcctctccccacccgcctccccctcaggctgtggggaggtttgctgggggccctggggtcagccagaaaccggagtctacctctgagcaggtctcgggcagaggtcccctgcctcagcagggcctgattggaagaggagacgatggccttgagctcctcagcccgggacacgtactgccccacctgtagcagggaaagggcctgaggaggggctgtctcaccagctacccttgccagaacccacctccaagttctccctttgcattgttagtgactgcctcaagctataaacatgtcagggggcaaatgtggctggcctgacccattcccagctctgtgttgcaggagaggaagttccaattctaagagagccattccccagaggcccccgagatctccgggccttaccccctgcccccccacttcctcatggggactctcacccacctttgccttaattgcctccttccgctgggcatccacttcatctgcagaaagtgaggtcatatgaggagtctgggcgaacccctccctgccccacaacgaaccctctggaatccctcaaaacacaatattccaggtttacgctctgctttatcgcctacaaaattctagatagagaacttctggaatccacctactgcagccacagatgactcccatccctgctgcacccacgggcttcaggcatggcctgggactcacagtgcagggcaggtacaaagaagtccagagccttgcagtagagtgataaggcagctgctgaatccccctcctggtctttcttcacagcctgcaccaccagggcggtctggggatgggcagatcaggggtcaggtccacctccctaccctcccacactcaccaagatgggagatcagctcccctgagcccgccctctgtctctgttgggtgagtcaccaattcaccaccaacgggggcaaggagacctccagcccaccctcagcccaccccagccccagccgtctgctcactgctcgccccagactctccccactgggcatgtgctccaggtccacccaggggtgcgcaaaaaagtcctggaaggagatgcgacggctggggtcccgctccaggagccgctgcagtaggtcccggcagtctcgggagagcaggggccgcaaggggagctgcagggaagggaacggcagggacagatcacactgggctcctccacccctacccctagcccaggggtctgcgaggaaccccagaggtacgcgttggacaggtggggaatctgagaccgaggaggaacaggatgggtcaggatgatggagccagcggggagcgaggcctccatccctgggctcccggtgcaccctcgctggagccctgagctgagctagaatcgtgtttctgggtccttatttccctccctggactatgctcctaggaaggctgggcctggctctgctttgcattctccccacaagggcctgcaaaatgggcactgtgctgccagctgtgggctgacctgaggccctgggacagcctggcacctcgacttccagcctagaacctgcccctccaccacaaaggcagcctggagcccatactccagtctctgcaggtcagaacgaggtctaaaccctcagggccctgactccctctgccccccagtggtcgctaaggccctgctagacacacctcgatgacccggttgctacggatcttctcttccagctccgagaacgacctggaggcaaaggggggctgcccgaagagggcttctgtggaagggaggcagagcggaggctgggagggaatgggtcaagcctggcctgacgcccctcagcaggggccctgggccagcagtcagttttcatcagaacccttcagaagtggcccagagaggccttgcctgaggaaactgtaggcctcagggtgagaagcagggaaaagaggtctcaccatacaggatgacccccatggaccagaggtccacgcgggcgtcatactgccgctggcacaccatctcgggggccatgtagaggggggagccacggagcacgtgcttctcatcccacggggacatgtgttgtgcgaaaccaaagtctgcaggcaagaggagaggcagcagggcttgaattccagctgcttcagctcctgacttgtaaagcctcaccccaggctcctctccaccctccagacccgccaggatcaaccctatttccaagcctctgctcatcattaggctggaacaccctcctatatctgcctctggggtataaaacctacccatccttcccagctcccttgggcaccttttcctaggaagcccacctgatcacaccagctacctgcataagcccccaccctctcactgtccccccaggcttaggttctatcacagtctctggcctccagtgtcaattatccaaatcttatcaagggtcaccacctcctactcccccaccacacccctcctatgtggccacagatggagtcacagacttgagccccaattctgatgacagaccaagtcctgtccctgcccacagagggatccctgatgcttgtcacacgctgaaccctggcactgttcccagattgacccctaaacctggacacacagtgagtcccaactctggccacagactgagccctaactccacccattatgctgctggacttgagcatgggtagcctgagaaagcttccaccttttgatgacagggcccaaccccagacttcacggcctgtcactctttgaggactctatagagggctccataagaaccagggctgctgagtgagcccaggcagagggaggcctctgcactctccaaacctcatccctgctgtttcagacacagacctgccagttttaggtggggcttctccaaggagctcagtagaatgttctgtggcttcagatccaggtgagagatattccgttcatgcaggaattgcagggcgctagctgaggagcaggacccacgaagagagacagttcagagcccattcccgcctgcctctcgcctccccggctcacatctgcctcctcaagcctgcacaaccccagttcctgcctggctggtctaatgttttccatataagcaccaagatcacaccacttctaggagtttgccaccccacccgagtgcccaccctccttccctctgccccttcacaagtctccccacctctcagaagcttctctggatgccccagcccttgagatcctgctcttttccttggcacagcacttgagtcctacctacaggactctggaatgttctacaaggtccttatattatgttctatgtatggaagcctgaacaccccacagaggggttaccccctcatctctcccacagcgtccttgagcaagggttgagtgtatgagataaacaggaccataaaatttcaggctgtgcaggaggcagctgcaatgcgtgccaaggctctaagcctgggggaggggtgggatggtggggggcagagaacaagggacagagtgtcaggctggtgtcacaggcctttacctaattgctgcatgaagacacgcgccaccttctcaggcagaatcctgcgggtatggatgaagcgagacaggtcgccccctgcgcaaaactccatgatgaggtagatattgtcactgtcccactgtgtttagaggcagagaggcggcctgaagagagtgtcccttctccagctccctttggcagcggccccgccccaggctcacacctgaaagtctttcagctgcacaatgtggggatgtcgaatgcccttgaggatctcaatctccgtgaggaggttctccaccgatgccttgttcagacttttcttggctacacactttatggctaccacttcacgagtgtccttctgcgagacaggagatttggggactctgccttgagggggccaggacccttgtctgactggaaaggctctatctggttccctctgttcccccaccccgcccctccccgggtctacctactgcacaccagcaccgggcttcccagctttcccttgtgaggccagtgaggaatgctgattctggaatcctggcttcccgacacagcctcagcctggtcttctccaaccctcggctagctgatccatttctttgcattctggagtgctcccggcagaggcatgtcactcagggttctagaaccgcccactctgcctcccaactggctccagtcccagactcctcccagcccaccaggtaacctgttttgagcctgttcttcagccactgaccctgcaggtgggtgcaggtgcgctctttaagacctaagcgtggcagtcggctccaacctccgccgagggtcagctggggcgaggccggcctcccgcccctaactattcccacactgtcgctaacctctcagagtctccccggccggcaccagccgagctagctcgggcgggcacggggccatcggccggcacccaccttggcgtaggccttgtacaccgtggcgtacgtgccgctgcccaggcgctcggtgaggatgaagccgtccaggcgcgggggaccccagccgggccccgccattccggccgcctgcgcccgcgcgggcgcttcctcgctgcgggcggcggttccggcgggttgcggggcgggccgagcactgggtggctccacgctgcccccagcgccgcccgccggaaatgcagcgcgcatcggggacgcggatccgcccggctcccggcgcccctcccctgtctctgggcctcgccgggtcacgcgccccgccagttcctgcagggcccacgtggggatacggaggccccgcgagcctagaagttaacaacggaggacggccggcgtggtctccggggactcctagcgggcgcagaggcgtctagagatcgcccacgtgagggcgcgggcggcggagcgggcgtgtgtgggggcgacggcgtccgggaggctcccagggcccctccccaggacccgcagctctgaaaggagagctactggcacgagaaggcgcctttggaagaggccgcgttggcttcccaggcctcccagctgcttttcacttttctgaggaagggccttgacctatttattgcatcttaactgtccccgctctccaatcttagcagcggcgcccagcccctaatcctgtgggctgccccgtcctcccaagtccaccagacatgtggacccgtgttgtctgaaaatgtttttatttttacttaagcacaaaaattgagacgtaacatatacatttgtacatagaggggaaaaaataccagaaaggagttcataaaaccccagccgctgccagtatcattcagtggctggggcctgcggctgtctcgggcccagagccggaggctagttttgtgggaaggcaccccagtccacacacccactcggcagcctcgagggacagggtgctggttttaagggtggactcctacgtgtcccatcacagtgacacaccccccagggtgtgaaccagactccactgggtattagggggccctccgagagatggcttatcagtccctgctgagggatgcggttctggactggctggccctgcccttcctgaaagtctggatgctgctgatggggagcatgggcggggcaggtggcatctgaggcagagacaaaggcagccgtccctcggttcggggaggggggggggtagtcacagcaaacagggccaaaccaaccacaccaggacaggcagaccccaccctcctagaagacgctggacgctaggcaggacagcttggggtcagtgtccttggtcccttccagtccccaaatcccaaccaacggcattgtacattcagaaagtctgaagagagtaaggctcagcaaggggagggctccagagggctcaaagtgccatcccctgcaggagggtgcagggggataaagggctattaatccgtttctcaggaacacgaggcagggaagagcttaaggcaaccagccttctctggatccgtttatgaggcagagaagagcttgaggcaaccagccttctctggaagcctggagaccactggagtgacctggggaacagatctgtccaccagaacctgtgagaggcttattcccagcccaggcaggaaggactgggctgtgtctaagaagccagattcaggccaggcctgcagggtgggggagtcaaggcccaggaccctggcagaaagctccagctgggatgggcccaggtcagcctgtgatcccaactgtgtgggggtgtctgtgtgtgcacaggacgaagagaacttcagtcccactgcttccagagacaaaagaatcctaccaaaccatcaccagagaaggaaagagagctttgtttttttttgtacatagagggggaaaaaattccctgtccctcccgttccagggagagctggtcgctgagggaggaggaagagccacggcaagaaccctgccaggtctgtgctgggcacaaccaccaccacataaggcacccacggaaagtgcagctcagaaggcaggcgagagaaaggctgagggggagagaagagaggaggactaattcccctggaaggctccttgggcagcagatgaagcagctctgtggaaggttctgctgctgaagatgccctgggaaaactcctcctgggcctgctggaagctggcccctgtccgtcggtagagggagtgcacctggcgaagaggggtggggtgagagaagcctgtcctttgggcccaccaggaagccagccatccaggttatactcccaaaggggtcaccagaagcctggcactgcctgaccccccacccagatccctggagaaaggtactggacctttgggggcctaggatgcccaactgcagtggtgaaaaacatctcgtggcaagggcaggaaacggttgcctgcctcctcccatttgctgtcagccctgcccacaccactcacccgctgcaggaggaagactgagagcacggcacagagggtgaagaagccagccaccaccatcatgatgactgatatggccagggaatgattatccagtgtagacagggctgcaatccaaccgctataaagggaagaagaggccagagggagcaaagtgggagtgggctccaaaagtcagcataaggggctcttctccaagtggctgctgtgtcctgaccatcaccttggcatctccccacagcacagggagccctgtgagccagaagcccttggcctgtgaggccagacctccgtgaaggctgacaggcccacactaccccattcacaaggggaatcttctggttatgtgaggtctgaaagggaggatgtggttgctgccttcacagagtcagaagtagcaccgggctgggtgctatggctctcacctgtaatcccagcactttgggaggctgaggcaggaggatcgcttgagcccaagagttcaagaccaacctgggcaacagagggaggccctgtctccataaaaaataaaaaaaggccaggttcgtgcctgtaatcccagcactttgggaggccaaggaaggcagatcacttgaggtcaggagtttgagaccagcctggccaacatggagaaaccttgctctactaaaaatacaaaaattagctgcgcgtggttgcacacgcctgcaatcccagctactcgggagactgaggcaggagaatcacttgaacctggaaggtgcaggctgcagtgagccgagatcatgccattgtactccagcctaggtgacagggcgagactccaactcaaaaaaaaaaaaaattagctggctgtggtcatacatgcctatgctcccagctacttgggatgctgaggtaggaggatcacttgagcccgtgaggttcaaggctgcagtgagctgtgatcacgccacggcactccagcctgagcaacagagtgagaccctgtctccaaaaaaaaaaaaaaaagaaaagaaaaaagaaaaagggctgggcacagtggctcaagcccgtaatcccaacactttgggaggccaagatgggcggatcacgaggtcagcagatcgagaccatcctggctaacacagtgaaaccccatctctactaaaaatacaaaaaatgagccaggcatggtggcaggcacctacatagtcccagttactcgggaggctgaggcaggagaatggcgtgaacctgggaggcggagcttgcagtgagcagagatcgcggcactgcactccagtctgggcaacagagactccatctcaaaaaataattaattaaaaaggtagcactgggccgggcctttttctgctgctttgggggtggggagtatggaaagcgtggctgctcactcctgaggacccaccttctgtgaaggaggatcactggccaacttgctgtcacctgtctgagccccatgtcctcatctgtaaaagggatatcctcatatttcttgacatcaaaacttactacaaagctacagtcactaaaatagtgtaggactggcataaacatagacatatagatcaatagatcaatggaatagaactgagattccagaaataaacccatacacctattgtcagttaatttttttttttttttttttttttgagattgagtcttgctctgtagcccaggctggagaacagtggtgtgatcccggctcactgcaacctccacctcccgggttcaagtgattcttctgcctcagcctcccaagtagctgggattataggcacctaccaatgcgcctggccaatttttgtactctctagaaacaaggttttgccatgttggccaggctggtctcaaactccttcctgacctcaggtgatccacccgccttggcctcccaaagtgctgggattacaggcatgagccaccgcacccagccaactcaagccttctgattcccagtacaggtgcaaacggcagtcatgaatcacagcttttctaccagggtcttacttaggtaaggagtaatgaaattgggtcactggtcaaaagggaccagattaacaacagcagggcaagaagcatgaggggtggtgggagggcagcgtgcacttgtttggagggcaaggggaggcaacctttctctccccactgctctggacttgccagctctgccagagggaggggaccaaaatagcaccgcccttccaggctcaggctgtcagccaagtgccagtctgacctttctgcaatgctccctgtgcactggggcagaaaggaaaacatcagccatcagcttttcttttgagattaattttgagctgaggactgaggtaccctggaaactcaaaccagccgtatgctcaaagagggcagccagaagaagcctgtccaggggaggtgagggaaccgtctccttaagttacaaggcatctggaaaaagttgcagctcagagtctgcaaaggcctgggcatccatcagctttcaggagggtgtggcaggagaaaaggaagaggctgcaatccagtgcaggacactgtcatggtagcctaaagagtcaagccaagttcacccacaataccctggaaagtggagagcaagggaagatagtgtcttttttttttttttttgatacaggatctcactctgtcacccaggctggtgtccagtggtgcaatcatggctcactgcagcctcaacctcctgggctcaagtgatcctcctgcttcagcctcccaagtacctgggactataggtgcatgccactgcaacaggctaatttttttaatttttggtagagacaaggtcttcctgtgtttcctaggctgtctcgaactcctgggcttgagcaatctgcctgcctcggcctcccaaagtactgggattccaggcatgagccactgcacctgaccaatagtgagtgtcttttgatgcctttagtatcaaggagaaaaaaaaagtgagtggctactgatgaagaactggagagaaggcccaaagcagatccgagctggcccactcacccactccccgccatgggaaaagcagggcactggcggggctctgtgggagctagaaaacagggcaagagaggctgagtcccatatccaaagcctaattccctctgtgatgcccaggtctcacctgtcccccaggccagggatgccaaccaactggatgatgtagatccctatttgacaaaaaaatacaaagaagaacacaaagaagctgaaagagttgtcggacctgtggagagagagggaaataagtcacaagagggcttgggctgtgttcctcagcatccttacttggtgtgacatccctcctcactaggagccaggaggcagcatgggcaagagacagagctccaggggcccagccataccacccgtaaggacacgcacacaccccccaccataatcaagaagagcttgcctttcactgccttccaatttaaggggtcagtgcttgaccccttcctcaaagagctgataaagttgctcccccaaaggacaatataaagagcctaacactcctgcagtgagccaagatcacgccactgcactccagcctgggtgacagagtaagactctgtctcagaaaaataagtaaataaaaaacaaagaacctaacactccatctcctggagtacttgcgtttcataacaggcaagaaaaactaagccaatctcttaataataagtaaatctctatataataagtaaaatctctaataataagtaaaactaagtaaatctcttaataataaaactgtatgaggccaagaatttgagaccagcctagccaacatggcaaaaccctgtctctactaaaaacacaaaaattagctgggcgtggtggtgtgcgcctgtaatcccagctacttgggaggctgagacaggagactcacttgaacctgggaggcggaggttgcagtgagccgagactgcgccattgcactccagcctgggtaacagactgagattctgtctcaaaaaaacaaaacaggctgggcacggtggttcacactcgtaatcccagcactttgggaggccgagacaggtggatcacttgaggtcacaagttcaagaccagcctggccaacatggggaaaccccatcgctactaaaaatacaaaaattagccaggtgtgattgtgtgtgcctgtaagcccagctactccggaggctgaggcaggagaatcatttgaacccaggaggaggaggttgcagtgagccgagatcgcatcattgcactccagcctgggtgacagagcgagactccctctcaaaacaaaaacaatagaacttgaggatacgtggtaacaaagaacaatgagaaaaaaacaaaacctgtacatctgactggaagaaaaaaatatttgggaaacaggggacaccagacaaaactctctcacgagctgaggacttccatctctgtgtccttgagggctagatcacagtgagggttcagggcctccagtggtacagggatggttcagccactaccctaatccctcttcccagggcctgctgggctcccagccctgaaagcataaaccctgaggtacaattccagaacccctgggggtctgtaaggtgtatccagctatgttcccagtatctagcttaggtgttggcagtctttattgggaagcatcaatagtcatggagaaagagccctggagagcactcatctgatactaccagagaagcacaccttagagcctcagaagggagttcccaaagagcgtcccctccctcttcccagtaacggcatcagccagactgggagcagtgggatgggaggtcccttctctaggtctcctgtgcctggtccaaggacagggcccagagcagacctcaggtacagaaactgaggaacggggcccccaatctctgctctgggtgggaacagaggaacagaatgtagggaaagtggatttccctacattctattctgctctaagactcagatggggtcccagggcctatagcccttagcctgctacctgggatgccagccataaagtctcaccccttgccccggcctcactcacctaaaggccttatagatgggtcggtaccaacaaaggaaggcacagggagtgaagatcagaaaccacaggatggagaggccaaagtccactcccttggagctgttgcccgagaaccaggccaggcaggcaagcaggttcagaaacagagtcactgaatgcactggggaaggggacaggacagagttatgacttgtgccacagtggctgaggggctccaatgtggcagccactccctaggagaggtgaggttcatgctgcgaaggcagctgctgaaacagaggagcccgctctgtacctaggcagggatagttcccatatcctggttttctgggacctcaaaaccagggatcaaactacgttcctgagaggtgatgggacagcccgggtatctgaggggtgtggagggaggatgcagacccagggctggtccttggggaaggaagtctttctcttagcaatgcttttccctggccctggatggcccctgatggagctgcagggggagtctccttcctcacccctcagagttcacaggcctgtgggcagggaaggccttcacctaaggagggccttttagtgcagtgagctctgaaggaacttggaagcctctagttagtcccaccctccctgatcggtggtctggactgcccctttcaaggaggtttccagacagggggcagcctgtgggcagaggcatctccccaacccagcccaggcactgaggaaggctggagtctgctgaaagcctgtataccagggaggagcagccaggaccaagatggggctctcaagtcacacccaattcgcccttgcgcttggaaggcaggagtgggactcacacatccacagatagtagagcatcttgcatatccgctggtagtcggcagggatctctgtggagaaatcctgatagaagcagggcttcacagggcaccacgagggcagagggggccagttgttctgtctcactgggtagggcaaaaagagtgacgaggtaagggcccagcctcagaaggggcatcaaggtgcatgcacgccagcatagtgtatgggccaaaccagggttcccagaggggctccagcaagcggggcttggagtctgcatggagcatggagtgggacagaacaggataatggaacccaaagagataccaacaagctcacatggagataaaagaccccaaatgcactgggaaatacagacagctaaatggcctaagtgattatttttattaacaagcagcccataagtgtgagaactcagttcatcatcattagcaaggaattgtgggaccaaagcccctatgctatcaaagaatcaaggaatttgagagctaggaaggagtgcagaagtaatctacagccattacaactacactgcaggtctcctgacttgcaacttactgctcttcccaggaccagcatcctgtgatgagaagagccccacaaaactctaaggcagctcagggtgaatgctgggaggccctccgcacaggtttcaggacactcttctatgccaggcagggcagccccaggccccagcagcctcccttaccatgcaagttggctacagtgttctgcagctcccgctccttgcgttccagctcggcagctttcctgtccagttcttcctgctgccggagcaggcctgcctgggctgcagacaccacggcctggagagaacaggggaggtacagggacagccagacacaacaaacagaaacagtgtcagcctgggtaggcaggcagagaggccttgccccaggcagggacagccatcaaggagtcccagaagcagtccccgccccacagagtgtcttaggtaccagagaccaccttagagaggccaacctgtcttccactgcccccacaccttcctgaccccttggccatgactaagctgtcctctcccctcatccctaagcttgagttgggaaaactacccccattggcttctccacctcttccccatactgggtcaaggcagcgctcagtgattgtgacctttgggaaaaagacctcacaagaaactaaactataataagaaacccacagacccaagcctcatttgaagagcctggtggatgtgtgagaaggaaaacagtgcaagcctgctaacagtgagtggaaaggggagacacgtgaaggcagatggcgtgtgcctgagcctcaggatctgtacaagcaccctgccccatggcctgcccccaggagctgcctcctgaggtccccctaaactgcaattggctacaccccaggacagccccttaggtgtggccctgccctgcctggctttagtggcatgcagagtccacacttatctcctctccaggcggggtagagcctctgagtaacagtaagggactgactgtatgtgaggctgaacagacctggccccggggccctgcacctgctggcagctgctgccatttgggccaggttcctcctgaaggatgagactacagtcctttttagggagagatctcaaactggtcatttcacaggatgacaaaccaggcacatgtgtacacacacacatgtatacacacaccaacctctccaaaagctcttcaaagacctaaggctgacgtggagagccaagtttcaggcactgggggcggaagcaggagcagaactgaccccgctgtgccacgctgggggtcttgacctcctccaagtctgtgacgccagctgagaaggacccagctccctacagcccaccacccagctgcacagaaaggcaactccgcatgtaaggcctgcctcacctccacagggctctggggcctgggaggggtgtggggcaggctccgggtgccctgcccttcctcctgctcatctacattaggcctaccttcggaagctttcgcatgtagctgtctctgagaatactttctcctcctaggagcatctgcctctctgagagctcgctcactgccaggaattgggcaggcgggaacttgctggcctgtctaagcaggagctgcaacacacaactccaccatgggtcacgctcataggggcagcgaggggtgcagcgggagggcagtgaggcggcgcagtggagcaccaggcacaaagcaggcaagattcacagtatttggtgaagggacaaaggaagacaggaaggaaggtgagaattaatgaagttaaaaaaaagagagagattctgggccccaaggaagagagaacaagccaaaggcccgaggaggacctggaggggtacaacagggacaaatgccctctctggaggcaccgaggagcccggcctggtgagtagagcttatttctcagtggtggtggtgggtgggatggagggagtaaggatattaattggcagagcagcccctctacttgtaggtgaccagctccgaacaaattagcaagagggcccttagggggccaaggctgaaagctctctgcttgcccccagcctcagggctcagctactggtctggatgattccctcactggagagaaaaggccagagttctttgtcagcactacctggggggtcggctgggttggttccactgatggctggagaaccgctggctgtgaggacccagggagttgggtgacaggaactgttgtcgctgcatttgtctacatggaacaaatcaaaagacagaattgagtgggactccattagctggtgacgagggggcaaacccacagcaggatgagtgatgtgcccctgcctgtgaggggactccctcggggcctgcactgggccttcccctgtggcttcccagccaacaagcctcaggttcaggccatctgatccctaacccggcacccctgggctcgctgggtccagcacacttgggcactgccctgacctccttggggaggggccccggtcacagatcccaaggggagaattttacagagcgtttggtggctttgccatccttaccctgcctcccgggttcatgttaggactgtccctttgaggactgccgcttctcagagctgcttctgtccttgccaaggatccctgccccggacaccccagcaccaccctagagggccatgggacttggaaagagggcctgctcaccaacctctgagaaggggttgaattccgccaggccgccctgcggggcgttggtcagctgggtcacagagggatcctgagaaggtgaaaaaaagcccttagacacagtggagaaaatccgggccaggggccggcaggcgagccggtgacgcctgactgaagcagggcagctgatcaccctcccgggaccctgagaagcctctctggaagggtcctgtgcctgcctctgccacaccacagctgcggtcccttctcccttcccccttcctggaaaaggttcagcccagaagagacccagagcaagctttacccagaagcttgagagtacacaccacacaggctcctgttggtgccctatacagattcaaaatggttcatagtatttacctctagggagtgggtttttttttttttttgaggggtggggtgctgaggggcaagtgaatggggtggtgagggtagagacttactattgactttataacctttctgtactgttttacttattattcatttattcctctttttttatatttttttattttttcgagacagagtcttgctctgtcacccaggctggagtgcagtggcgcaatcttggctcactgcaaccttcgcctcctgggttgaagcgattctcctgcctcagcctcctgagtagctgggactacaggcggccgccaccatacccggctaatttttgtatttttagtagagacagggtttcaccatgttggccaggatggtctcaatctcttgacctcgtgatctgcctgtctcggcctcccgaagtgctgggattacaggcgtgagccaccatgcctggccattcctcttattttgtaaaagacagtctaaggtagccgggtgcagtagctcatgcctgtaatcccagcactttgggaggctgaggcgggtggatcacctgaggtcgggagctcaagaccagcctgaccaacatggagaaaccccgtctctactaaaaatataaaattagccaggtgtggtggcgcatgcctgtaatcccagctactccggagactgaggcaggagaatcacttgaacccgggaggcagaggttgcagtgagcccagattgtgccattgctctccagcctgggcaacaagagcaaaactccatctcaaaaaaaaaaaaaaaaaaaaaagtagtctaagtttctagaacaaaaacatgctgctggctgccagtactgattttattaaatcgggcacacttgctaagagcagagatatgatgagctgaggtgaaaattcaagaaaatgtttctgggtttcgggggttttttaaagtcttttcataaaatccaagaatgtcctcagaacacaaccttgtctccctttcccatctgatctctgcatggggctctgccatcctctttactgtgcccctgctggcctggaacagttgtcttcaccctgccctgccccaagaagagctcctccacaccctccccttcctagtaacagatgcagggctcaggtccagcttcacagccatgcctgggctccatgaggaacagccctgagggtggccaaattcagggctgttcctgcctgtggagacaccgcttgggttccacacctcaccccacacccctaattattaaaccagatgctcccaaacttcaggcccagcctcacctccactggaagcctctgcagagccagttcttttttttttttttttttttttttttttaagacagagtcacgctctgtcacccaggctgaagtgcagtggcatgatctccactcactgcagcctccgccttctgggctcaagctattctcgtgcctcagcctcctgagtagctgggattacaggcgcctgccaccacacctagctaatttttatatttttagtagagatggggtttcaccatgttgggcaagctggtcttgaactcctggcctcaggtgatccgctcacctcagcctcccaaagtactgggattacagatgtgagccactgcacctggcctccagttcttttttttttttttcctttttcttttttagagacagggtctcactctgttgcccaggctggagtacagtggtgcaatcatagctcatggtagcctcaaactcctgggctcaagcattcctcccacctcagcctccggagtaaccaggactacacacatgagccaccaggcctggctgatttttaaagtttttttgtagagatggggtcttgctttgttgcccaggctggttttgaagtcctaagctcaagtggtcctcccaccctgggctcccaaagcactaggattacaaatgtgagccaccttgccctgtccagatccaattgttaaatacaatgctaatattagacatagccacagagtgaccccctcagtttacagatgtagaaactgatattcaccatgatcctaggacccaaaatgggagctctctccttactctgaatatttatagagctgagggtcagcattgaatatgttctctggttttatcacagatacttcctcttatctcttatcttcccacctgagccaccagttcatagagggtatgaatgtctgactgcctccaggcatacagccagaactcactgtgtctggacgggcctcatactacagcctccaccccttccaacctcctctgcgacagactgtggctatgttcttcctgctgaacaccacctctgccctgatggctcctgcaacttggacaaagtgacaaggtgaagttcaggaggctctgtgttgctgaagaattggccttgaggttatttcatgcctgaatgaccagtggtttactaccagaatcatctggcttcctgcaaggaagatttggggcttggtatctgttcccctctcagactcagcagacacctagccaccgctgaagtcactgaaatcggatctaccatccacagaagtggctcctcgagtctgagtcaccagaggacagaggaagaggggccactctggtagcagtttcaggtaatggcaaacagacatctggccaaggtgcacatgtttaataggtgatctccaggcccacaaagagatgccatttcctttatgaatggcagacagaaggggactgtgatggggatcatagggtgactgccctgtccactctgatccctccctttttcctaaaatcttaaagacatggccttggactcctcaccgggctcctcataaacaaatctgatctccatgattaagttagaagctccctgcagccatgtgcatctgtgtctggttcatattctagttccttggtgcttggtgaagggcctatggcagcacagcagctcagcggtttgagaagacacgcagcacgctgtagggcctccctctttttagaaagcactgcccaagtgccagggcatagcaaacaggaggcacctgcatcacagcagtagcccaagggcctggaagcacgttgcctaggaagagcaacctaaaacgctgagacaagtggatattttcccatctaagaaaacctaggctctttctgaaagatgtgcgtggcttcaagacaagctgagccctggcaagaaagggagggaggaggagggactggggaaggaagctgacatttacttagtgtctacggtgtgccaaactcaccacacaatgatgctactgtgaaattctagtcaccccagaactagccactgtgtcgagttgtcagaaaagagggttttactggccttccttgacctggttcttcaaaagacttatgaccccctaatccactatttataatgactttactgctctcctggtacctagggtggtactagttatactccatacttgagagagctgagagagtcactccaatcagcttctctgttctgtggctcagctcgggaccctggctgagaaaagctacaatacagctcctcatttaaccctcacaacagccttatgaggaaggaatatttatattttgcagctggaaaagctcaagctcagagaggggaagtagcttgtcttaagatctcaggggtagtggctcagccagattttcaatccaagtctgtctccagggacacaagatggtaaagctgagtggggcaaagcatctcgaagcctggtacggagcctgacaaattgaaggcgctcagtgaatatgtggcaggatgaatgagccccactccaggaggacactgacaagggcttctgcttgtttccttgcttccttctttccttcaaagagctggttcttttttttttttttttttttttttgagacggagtcttgctctgttacccaggctggagtgcagtggcgcgatctcagctcactgcaagctctcccgggttcacaccattctcctgcctcagcctccccagtagctgggactacaggcacctgccaccacgcccggctactttttttgtatttttagtagagataggtttcactgtgttagccaggatggtcttgatttcctgaccttgtgatccgcccacctcagcctccgaaagtggtgggattcaggcgtgagccaccatgcccggtcctaactggcttttaaatgggtcaagtaggatggtgagggctaagtttcacctacaaggaggaataacctaaaactcccctgcagtgccactcagagtggctattgccctttactgaatttgtaacaaataaaaggctcttaacctcagttcttttcattcagcaaccagctacagtgtgaggaacataccacaatgcataagacacagctctcacccttctggagtccacaatctggtatctgagacaagtgggcaccccctgaaggggtgctggggaccacggcaaggtgcagagcaaaaaacaggaagaaggggagacacctcggtgggcttcaagaaaggccaggttgtagaaggaagacagacagcaaaggcccagatcagtaaggccccccaccactgcaaggcaggggggcacttccacatagctggggggtaaaggcagtgagggaagagaggcaggcagagttaggctgcagctctcccaggaacggccatgaaaaccacacttttttttttttttttttgagatggagtctcgctctgttgcccaggctggagtgcagtggcgcaatctctgctcactacaatctccacctcccaggttgaagcgattctcgtgcctcagcctcctgagtagctaggattacaggcacataccaccacgcccggctaattgaaaaccacacttgtcactggtttggaaacctcataccatgcgtttcacaggtgctggctgtctgagctctctgtgacttttccttgccttcccttcctgtattccacccaggctcccagtgtgaggtttatttcaggctccaaataaacacattaaataaatatcttatctcacggactaaaaaaaattcagggccagccgggcacggtggctcaagcttataatccagcactttgggaggctgaggtgagagggttgcttaaatccagtttgagatcagcctgggcaacatagcgagaccctgtctcttttttttcatagtaaaaataaaaaataagtttaggcctggcgcggtggctcaggcctgtaatccctgcactttgggaggccaaggcaggcggatcacctgagaacaggagtttcagaccagccaatatggccaacatggtaaaaccccatgtctattaaaaatacaaaaattggccgggtctggtggctcacacctgtaatcccagcactttgggaggccaaggcaggaggatcacctgagaccaggagttctagaccagccaacatggccaacatggtgaaaccccatctctattaaaaatacaaaaattggccaggcgtgatggctcacgcctgtaatcccagcactttgggaagctgaggcaggtgggtcacctgaggtcaggagtttgagaccagcctggccaagatggcaaaaccccatatctactaaaaatacaaaattagctgggcgtggtggcaggcgcctgtaatcccagctacttggaaggctgaggcaggagaatcgcttgaactgggaggcggaggttgcagtgagccaagattgtgccattgccctccagcctgggatacagaggaagactccatttaaaaaaaaaaaaaaaaaaaaagccaggcgtggtggtgcatgcctgtagtcccagctacttgggaagctgaggcaggagaatcacttgaacccaggaggaggctgcagtaagccaagatcactgcgcagcactgcactgcagcctgggcagcagagcaagactctgtctcaaaaaaataaacaataataataataataaataaattctggccaggcacggtggctcatgcctgtaatcccagcactttgggaggctgaggcgggtagatcacctgaggtcaggagtgtaagaccagtctggctaacaaggtgaaaccccatctctcctaaaagtacaaaaattagccaggcatggtggcgggtgcctgtaatcccagctactcaggaggctgcagcaggagaatcacttgaacccaggaggcagaggttgcagtgagccaagatcgtgccactgcactccagcctgggcaacagagcgagactcaactcagggaaaaataaataaataaataaattttaaaacattaaaaattcagggtcatgctgagaggcagagagtcagcaacactctggaacctctgtgaagtcctattggctttggagatgaggctgagtgtcacagagcacgaaaaagcaatcacccccagagtggctagctgggtcccagtgcacaaagagccacaattgaccttggtgctctctgacctgatacctgagaatctgtcctaagaaaatatcacaaaaacatgtaaaaatctgtacctgcaatgatattcataggaccaggacttacaataggagaaaaaagcacgaaacaaacatccaatgacagagaccacaggtatgttttggtacgcatccccttgaaggcccacaacgccactaagcatcacagctatgaagatggtgcagcaatacagaacaggctttctggtcgggcatggtggctcacgcctataatcgcagcactttgggaggccaaggtgggcagatcacgaggtcaggagatcgagaccatcctggctaacacggtgaaaccctgtctctactaaaaatacaaaaccaaattagccgggcgtggtggcgggcgcctgtagtcccagctactctggaggctgaggtgggagaatggtgtgaacccaggaggtggagcttgcagcgagccgaggtcacaccactgcactccagcctgggcaacagagcaagactctgtctcaaaaaaaaaaaaaaaaaaaagaaagaaagaaaagaaaagaaaaggctttgttacatcaatactaaattatgggccaggcccggtagctcatgcctataatcccaacactttgggaggccgaggcaggcggatcatttgaggtcaggagtttgagaccagcctggccaacaaggtgagaacccgtctctaccaaaaaaaaaaaaaatacaaaagttagccaggcgtggtggcatgcgcctgtattcccagctactttggaggctgaggcaggagaatcgcttgaacctgggaggtagaggttgcagtgagtcgagatcacatcactgcactccagcctgggtgacagagtgagactctgtctccaaaaaaaaaaaaaaaaaaaaaaaaaattcctggccaggtgcaatggctcacacctataattctagcactttgggaggccaaggtgggcagatcacttgagatcaggagttcaagaccaccctggccaacatggtgaaacctctcactactaaaaatgcaaaaattagcagggcacggtggtgcatgcctctaattccaggtacttgggaggctgaggcaggaaaactgcttgaacccaggaggcagaggctgcagtgagccgagatcacaccactgcactccagtctgggggacagagtgagactccatctcaataaataaataaataattaacaatggttgcaaatgactggtagaaatatggaagacttattttctgttttccaaattttctataatatggtcatgttattttgattttaaaaacacatatacataatcccagctacttgggaggctgaggcaggagaaccgtttgaaccagggaggtaaaggttgcagtgagctgagatcgtgccactgcactccagcctgggtgacagggcgagactccatctcaaaaaaaaaaaaaaaaacaaaaaacaaaccatacacacacacacacacacacacacacacacacacacacacacacatatttttaaaaagagaaagaaaaaaaaataggctggacacatggctcatgactgtaatcccagcactctaagaggctgaggtgagagaatcgcttgagcccaggagttaagaccagcctgggcatcatgatgaaaccccgtctctacagagaatacgaaaattaggccgggtgcagtggctcatacctgtaatcccagcattttgggaggctgaggtggacggatcacctgaggttgggagtttgagaccagcctggccagcatgatgaaacccagtctctactaaaaatacaaaaattagccgggtgtggtggcaggcgcctgtaaccccagctacttgggaagctgaggcaagagaatcacttgaacctgggaggcggggagattgcagtgagtcgagatcactccattgcactccagcctgggcaacagagtgagactccgtctcaaaaaaaaaaaaaaatcagccaggtctcgtcgtgggtacctgtggtcccagctacactggaggctgaggcaggagaactgcctgagcccaggaggtcgaggctgcagtgagccatgattgcgctactgcaccctggcctgggtgacagagacagaccccatctccaaaaaaaaaaaaaacagtaagtgagcaaggtacactcaggcctcgcttcctgccaccggctgcaatgtgtggaacccttcagaaaagcaagtctgagtcacctggccgggcattcaaggccttccaggacctggcaccaatcctctaaaggaatctaccctcaaaatgggacacttactatctcctcgcacctctgtgtagtctctccatacacaaaccattccatgccaagcactgggctagggaaaccaagaaagaaccttgattcctgcctttgagaagcaaatagtacagagaatcacacagaagccagggcaagaggtgatggcacatgatcagcactgtaacagggtgagggcagacacagggtgagacacagtgtgatcatagaggagagagtaattaagctgtctgggagagtcagggaaggctctactgagctggaatctgagttggatcttgagagatgaaagaaacctagcaaacagtaaagaggaaggcaagaaccacacttgcaaagccacaggatctttatttatttatttattttatatatgtatatatttttgagacggagtctcactctgtcgtccaggctggagtgcagtggcgtgatctcagttcactgcaacatccgcttcccaggttcaagtgattctcctgcctcagcctcctgagtagctaggattacaggtgtgtgccaccatgcccagctaattttttgtatttttagtagggacagggtttcaccgtgttagccaggatggtcttgatctcctgaccttgtgatccgtccgccttggcctcccaaagtgctgggattacaggcttgagccaccgcacctggccgagaatctttaaaaagagcttgcatgtgttcagaagagagaaggttatggaggctgtggaggggtgtgtggagagaagagtctggagtatcagggaaccagtctgaagagggtggggccagattgtgggactttggatgttgctctacaggcaacggggaacaactagagatttgcagtcaggggtgacatgatcattctatcagcagtgaagggagtgcaacagcatggtaggacaacagcgggaagactggctaggacacaactgtcaacatgggtgaagtgaggaccaaattgagggacagcagctggggatggagaagaggaacaagagggacttcagagaccttcctcacatcaatcccacaggctcagcaactctctgggttggcctgggaatggaaagactacagggcaggaaagggaagggaaagaatagagttgaggccaggcacagtggctcacgcctgtaatcccagcactttgggagggtgaggcaggtggatcactagaggtcagaagtttgagaccagtctggccaacatggtgaaaccccatctctactaaaaatacaaaaattagccgggcgtggtggcacattcctgcaatcccagctactcaggaggctaaggcagaagaattgcttgaacccaggagaggtggaggctgcagtgagctgagatcacaccactgcactccaccctgactctatctcaaaaaaaaaaaaaaaaaaaaaaaaggccaggcacagttgctcacgcctgtaatcccagcactttgggaggccaaggcaggtggatcacctgaggtcaggagtttgagactagcctggccaacatagtgaaaccccatctctactgaaaatacaaaaattagccgggcgtggtggcatgcgcctgtagtcccagctacttgggaggctgaggcaggagaatcgcttaaacccagggggcagaggttgcagtgagccaagatagcaccactgcactccagcctgggcaacagagcaagactttgtctcaaaaaaaaaaaaaagaaaagaaaagaaaaaagaaagaaaggagtgcccaaaataagtgactgtgggagaggaggaacaggtttttcaagggtgggtgtggtggggtagggagaggatccgagaagatattgagtcaggttggagatagctgtggaatatttctggttggaaggattgggaaggtgcaggtgtgagtttgaaatagtggtctgagctcaggaggaagctgagaactagagatctagatctgggatcgctgaaatgtggatgctattctgaagtcatagaaatgaaggtataaagtgagaacagggtaaacccagcactttgggaggttgaggcaggattgcttgaatccaggagttcgagactagcctgggcaacaaagtgagacctcatttctccaaaaaaaaaaaaaaaaaaagccaggcacgatggtgtttgcctgtagtcccagctacttgggaggctgagatgggaggatttctggagcctaggagattgaggctgcagtgagccgtgattgtgccactgcacttcggcctaggcaacacagtgagactctgtctcgaaggaaggaaggaaggaaggaaggaaggaaggaaggaaggaaggaaggaaggaaggaaggaaggaaaggagggagggaggggaggggaggggaggaaaagaaaagaaaagaaaaaaaagaaagacaaagtttaagttctgaacttccaatagcatgaataaaaacaaaaaaagaactctggaatactcctaaatgtatgagacaggaagtgaaaacaggctgaggaaggtgagaattatcaggataaaagaggccaaggatggagagaatttcaagagactggccaaacaagcatgtgagtcacaagcagcagacgcatcccaggctcatgactccctaagagaccattaagatctaagagtgaggacatgcctgggggtgcaggggtaagagtggacacaggagtacagggatgacagcaagcaggagcgacttttggttcttggcactacttcacccaaaaatactctgttttctggccgggcgtggtggctcacacctgtaatcctagcattccgggagaccgaggtgggtggatcacctgagatcaggagtttgagaccagcctgaccaacgtggttgaaaccccacctctacgaaaaatacaaaaattagccaggcatgctagtgcacgcctgtaatcccagctactcgggagtgtgactctgtctcaaaaaataaatgaataaccctgttttcccatctgccaggctttctgctttcagtccaagccctctgtgccacaggtctctgcccttcctcctgagagccctcccagctcctttggacactgccctgatcccacttgtgatgtgctgtcactctcagtgagcatttattttctttcttttttttttttttttgagatggagtctcgctctgtcatgcaggctggggggcagtggtgcaatctcggctcgctgcaacctccgcctcccgggttcaagcgattctcctgcctcagcctcccgagtagctggaactacaggtgcccgccatcacgcctggctaatttttgcatttttagtagagatggggtttcaccatattggccaggctggtctcgaactcctgaccttgtgatccgcccgccttggcctcccaaagtgctgggattacaggcgtgagccactgcgccccagcctcagtgagtatttcttagctctcctgccagaagccattgatcacatactgtgctcatttaccatggtctcctgcacaggcctgcagagcagcatgacctcagtgatgtgcactaacgtgaacatctcaaagcagcacttgctggatgggtcacagtttgcaaatgtgcacagcactcttctctgaatgaacagcaagtaccccttgtttgtcctggttaaatattaccatttctctgaaattaagattatcttaccccaagtgtttccaaagaagacttaacggaagagtcaaagttcacctatctctctacccaagttttaacacccagcctggctccaggtgccaaccataaaggcaggaatcctatctgggcagctgtctgtagtcacagtgaagctgtaagaaccctgccattttcaaatttcttgagacaatgctctgttacacaggaaagttctaccaggtccatctggttattccaagaattcccaaagttatggtcaagctggggccaaccctctctgggaaggtcccactgtctgcacagggaaattcaagtaactttgttcacacccaaatcacgtttctgccaccacttcttccttccacaggagagaaatatttcaaatccttgggaagcagccacaacactgagattatcttttaactgcaaggaggcaatgtgtgaaagtgatattgtgtgacttggcaacttacaaacactgaaaggttttctctgttcaatgccaccacctattccacttcctctccttgagatcaatgctgtctgcctgggataatctggcagaagtgctgagtgggaaagcagccctaggcacttgcctgggtggtctgatttttagtggactgctgaaaaatggacagtacaatgactccctttagctttccaccccttcatcacctgacaagacttaatgagaaacttttgggagcagacaccctggatcattccaaagcagagaccgaaatactcagagggtacaaagcagctgccataaccaacagaggaattagggtgtgccagtggaggctgtgaaatcaacaacacttggcttgcagtttcctgcttcctcctaggaggtgggcaaacctctgtggcacactcatatcttaacttcccattcacagctctttctgtgcaggaagttttctaatcatcccgatcataaccacacgcaaggaagaggtcataaaagcacatgcccacagtgcggggtggaagcaggcacttaataaagaaccttggatgaggaagtcaactaaatggtgcactgggagtttcaaaggatataacgactgagcagaaaacagattccatggtcgaataaccttgagaaatgctgggtcaaataaagctgagccaatgtctttttgtaggatttctcagagcctttaacaaactaacaggccttgtgaatctttattttggtttgtttgttttttgagatagagtttcactctattacccaggctggagtgcaaaggcactcctcagctcactgcaacctccacctcccaggctcaagtgatccccctgtggcagcctcccgagtagctgagcccacaggtgcatgccaccacacccagctaattttttgtatttgttgtagagatggggttttgccatgttgcctaggccattctcaaactcatgacctcaagtgatccacctgccttggcctcccaaattgctgagattataggtgtgagccaccatgcctggccaagccttgtgaatctttgaaaaaacaaacaggctgggcacagtggctcacgcctgtaatcctagcactttgggaggctgaggcgggtggatcacctgaggtctggagttcgtgaccagcctggccaacatggtaaaaccctgtctctagtaaaaatacagaaattctgagcgtggtggtgggtgcctgtaatcctacctactcaggaggctgaggcaggagaatcgcttgaacccaggaggtggagactgcagtgagccaagatcgcaccattgcactctagcctgggcaaaagagcgaaacaccatctcaaaaaacataaacaaagaaacaaaaacgaaataggtagcaattcccaaacctatttgaccacagaaccatgagcacctttcaggactggcattactcagaatatatattgctttaaagaactgtcttaaaaagcccaagaattgttctccagtggaaaaaaaaaaccaataataaaaaataaaaaaattaaagaacaaaagcacaagatctgtattattccatcccctcacactggagaaaaaatgtagcttagctaatactaatttgttactttcaccactcccagtactctcaagaatggtgacaactgtgatgatgttacattccattctttccttagccagcctaaaatagccccagtgcagtttaacaccaatgtctgagcttcaaaacctttaaaacagccctgtcctgggaatgagacccaggtcagcaccttcctgctgctaaacaactgatgactctggcacataccatcctcattgaggtcttggtttcctcatctctaaactgaagaggttagaatagagttctaagaatgttctcagctcttaacagtcaactatgagctctgaacactaggtatatttttgcaatccaccatttctgtcactgcatgacggaaataaaaacgactgttctggagtgtgactaggtgtgacagtttctgagtctatcgcctctccacctgctctctcctgagcttggtgccaacaccctgagtaaatgaagctgggctcacacccaggcacccaagggctacacctcccaacgtcctagccctggcagtcaaggaagcagacatcaccatctcaaggaaaaggtgggcagctctgaccaggagaaggttcagaggcctcacatccaaagctgtttctccccacaccactgtgtgccaagaggaaaagcccagcccaggatgaggaggagcaaatcgcagccagccagccagctttcttcttcccacccaggactccccaccagatgtggctggttgacaggaccacagctgcttcctgtcatgccatatcctggggcttcctgatggacagactgtctcgctagaatgcagaagttacttctaccacagtttgcacagtcatttttggagccagagatgaggtttaagactttcaagcagctattaatacagggtagaactatcttgccctctgctaacactggagcaaagctctctgcatttttagacaactgacttcctctctgtcagacagcagcagactttttatttctgattctgagaggacaaaaaaacacacataaaaaatggaaaatcatcacatacaacatacaccataaggctacaagatcctactaaaacccaaaccccagtattatacagcagttttgtaattaaagtctgttaccagaagacattggcagaaaaaaaaaatgcaaatcttctttctttactcaatagagatgactgtttgccttacataagagacaaggtccttgcaaacgctctgtcaagaaacattaagctacgagaggaatgttcagaattccctgatgttctaaggaacaagctatcagaatttgccctgagggctcctgttggctaagacaccttgagaccaagaaagaagcaaaacattttcactctcctgacagcgtataattatttagttcaagtctcctttgattttgctctgacccttgaagcgattcaaagtgggaaaactcatgctgtgaatgacaggaaggactccttcaaggacttctctgacacctgcaggaaacttaaaagctgccaatgaccaaaataaaggacaagcagggtgagttaatgtgcctggtgacatcctgacagagcagaatatcagggctcataattcaccagtcagcacaaacaagcttccctagaacgggttttgagcagacgtgaaacaagaggcataggagctctggaggtaacagttcagcccctcatggtggaaaaagatcatccctgtgctctcagctgaaaggcagaaaggtgtgggctttaagtaggaagactgtcctgtggctcatgcctgtaatcatagcactttgagaggctggggccagaggattgcttgagaccaggatttcgagaccagcttgggcatcacagcgagaccccttctctacaaaaattttttttaaaaggagtcaggcccagtggcacattcttgtagtcccagctactcaggagactgaggtgggattcaaataatcatttgaatcctggaggtcaaggctgccatgacctccactgtgctacagcctgggcgacagagtgagaccctgccttaaaaaaggaagaaagagggctgggcgcagtggttcatgcctgtaatcccagcactttgggaggccgaggcaggtggatcacctgaggtcgggagttcgagaccagcctgaccaacgtggagaaaccccgtctctactaaaaatacaaaattagccggtcgtggtggtgcatgcctgtaatcctagctactcaggaggctgaggaaggagaattgcttgaacccaggaggctgaggttgcagtgagccgagatcgcgccactgcactccagcctgggcaacaagagcaaaactctgtctcaaaaaaaagaggccaggtgtggtggctcacccctgtaatcccagcactttgggaggctaaggtgggtggatcacttcaggccaggagtttgagaccagtctggccaataaggtgaaaccccgtctctactaaaaatacaaaaattagccgggtgtggtggtgcacacctgtaatcccagtttctcgggaggctgaagcacgagaatcacttgaacccaggaggctgaggctgcagtgagccgagatcgcgctactgcactccagcctgggcgacagagcaagaattgtctcaaaaaacaaaacaaaacaaaacaaaaaaaaaggaaaagaaagaaagcaggaagattgtttcttccttgattgctgttcaaaaggtcaggccaggcgtggtggctcacacctgtaatcccagcactttggaaggccgaggcggatggatcacctgaggtcaggagtttgagaccagcctggccaacacggtgaaaccccgtctctactaaaagtatgaaaattagctgggtgtggtggcatacgcctgtagtcccagctactcaggaggctgaagcaggagaattgcttgaactcgggaggcagaggttgcagtgagcggaaatcgtgccaatgcactccagcctgggcgacaaagcgagactccgtctcaaaaaaaaaaaaaaaagtcaggccagctcacacgtcagtgcatctcaactatgttgccaccacacacagttccatcagacaaacgttccctgtgggtccagaatttttcacagtcccccgcacctctcctctctccctaacccgggctctcctatctggtcaaaacccactccaaactagacccatggccaaaatgtggaattcttatcaaggccatttttcaacttgggctaccttcccgccctctcccatctttctttccctgacaaatctcaggggctctcctgtactttatacactagtttggctggtggtggagcggtggcaggtgtcctgggcttttcccacatttttcccctccaccagaggcttcaccacctcctcatatgttgctgtcaccccctcttctaaagtgactcaagacaggtgtctatccaagaatgagggaatgcgatagccacatttcgcttctccctgacgctaggagacttccggaagggtccgaccgtacctgctccagtccccttccctagcacagcccagcctccgggtgctagaagaccccactgtctccaacacttcagcgccccgcctcctctgcagttccacctgctgctagtcgcgcccctcacgcgttacgataggccagacctcaaagcccgctctcccattgggcagatgacccgtccctcctacgccacgtctcccggctctagcgagaggcccgggcggcggccgtgggccctagggaaatctgagagctggatggcgggagaggggctctacctggaaggggtttacatccactgggtccgcgaaggggttggtgtcgaaagccgacatggtgatcgggggccagcgggcgaactccgcgaacgctgctgcctccgggcacccagacccagcggcgcttcgtgtagaccctccacttccgggagcgaggcagcggttctggcgcaggcgcgatgccctcccccgagggcgtggccctatgacggcaccggggtcgctccgccccccccccccccccccccgcccagcccacaatagtgcggtgggtgggcattcggcttccgtccacatcttcgctctgctggggattcaggggtcttggctgcgcggagcgtctacggagccagaggcgtggccggagtccttcccaactgcctatcaatctgacaccttccaattttatgtttctaaagcaaactctcaaaagtgggacaggaaacagccccttcacttctctgtagaccaagtttgggaagaagtccaaactgatccctgggcaaaggacaggggtgacaggtgaggccagaggccttgggagaactaggaaagcgcttcttctgcagaacgtgctcggggaaagagaagtgccaggaccatccagcagtcctccacccgagctgagcctgcttcttctagggctgctcgccctctgatgtcgtttcatcgttttagggacgagggttcctgggcccatcagctttgggacctgagttgggacttgaacctggacatcaaacatttatgaagtgactcacggaattcagcaacacagcctcaatcatgggggaggtggctgcttcactctccacagctccgctttcccccgcccccgccccccacagggtctcactgtcgcccaggctggagtgcagtggtgcaatcatggctcactgcagcctcgagctcctgggctcaagcaatcctcccacctcagcctcctgagtagctgggactacagctggtcaccaccatacccagctaatttatggattttttgtagagatggggatctcactatattgcccaggctcgtctcaaacacctgggctgaagtgatcctcccgccttggcttcctaaaatgctaggattatactcatgaaccactgtctggccaaatccaccttatttatttggatctgtctggtattattcatctctgctgtcaccgaatcccagccactgtcatttttaccctgaactaatacagtgctgttaattggtctattgttcttcatgttgtaatcaaagatatgtttaaagggggcaaaattatcacagaactttgttaaaatttttcaattaatttccataaagggctgggtgcgtggcttatgcctgtaatcccagtactttgggaggcagaggtaggaggatcacttgaagccaggagttcgagaccagcctaggcaacataccaggaccctggctctacaaaaaaaaaaaaaaaaaaaaaaaaatatatatatatatatatatatatatatatatacatatacatatctcacacacacacgtaattagctaggcatggtggcctgtgcctgtactcccagctacttgggaggctgaggcaggaggactgtttgagctcaggaggtcaaagctgcagtgagccatctttgcaccactacactccagctgagtgacagagtgagaccctgtctcagttaaaaaaaaaaaaaaaaaaatcaggccaggcaaggtggctcatgcctgtagtcgcagcactttgggaagccaaggcaggcagatcacctgaggtcaagagttcgagaccagcctggccaatatggtgaaacctcatctctactaaaaatacaaaattagctgggtgtggtggtgcacacctgtaatcccagctacttgggaggctgaggcaggagaatcgtttgaacctgggaggcggaggttgcagtgagctaagattgcaacattgcactccagcctgggcaaaaagagtgaaactctgtctcaaaaaaaaaaaaaaaaaatcataaaggcccaaattcttagtttgtcttcaaggtcctaaaggatctgcccctacgtttctccccttctgaccccttctagcccccaacccccacccactgttccagccatgcaagttcttttcagttgctcaaaccttccttgtgccctcctgtctcagggcctttacacatgtgttccttctacctggtatgcacttaacccatgccccactatcatcctctggttaacctctccttaccctttaaatgcaagttcagatgcctttcttcaggagtagcttcccttcactctcttggttacatcatcacctcatacccaacataagctctcctattgccctgtacttttccttcacaatacccattgcagattgtaattaatactagtataggtggttctttatgcctgtatcctccgctagactgaaagctccatgagggtagggctgaggtctgttttgctcactgttgtgtttctgtcactaacatagtataaagcacatgatacacatttattaatttattttttgtgggtttggggttttttttttttccagacaaagtctcactctgtcacccagggtggagtacagtggcatgatctcagctcagtgcaatctccgccttccaggtccaagagattctgctgctttagcctcccaagtagctgggattacaggcactcaccaccacacccagttaatttttttttttttttttttgtaattttaatagagactgggtttcaccatcttggccaggctggtcttgaactcctgatttcaaatgatctgctcgcctcggcctcccaaagtgctgggattacaggcgtgagccactgtgcccagcccacatgcatcatacacatttagtaactattttactgtttccctgcatccatttattttgtttgtttatttagaaacagggtgttactttgttgcccaagctggtgttgaactcctggcttcaattgatcctgccacttccgcctcccaaagtactgggcctacaggtacacaccactgcgcctggtcatctgtttctttcaccttcctctcccatctaaatcctgactatcctttagggtttagctcagctttacttcgggaaatatctgcacacaagtgggaggatggggaaggatccattttgtatccccttagaaattgcctgtccccaagcctctatggccacccctcaagggcagcagacagatctttgctgtctgctctctgcagcctcagaggagaacagtccacaccccacaaggcagtcctgcctgctctgggtctgctgcagccaagtacaatgctgggctggtgaagaaagaatgaaacttaattacaaccaatgtggtggctgcccatctatctgtctaattccctacaagagagacatcattcatttattctacaagagaggaggtatagagaatgcagctctttgcttttaaaccagttatttcacctctccaagacccatttttctcatcttgatcttgaaaccacctttgcaaaaattataactgaggaaattatgacagtgggagagattagacctaacctactccatcttgcttctgacctttaagtggtccttgttcattcctgggtgtaggctgaactaaccttgggaaggaatttatagtttaactctgaaacaaaattgattatagcccttttccaaaaaaaaaaaaaaaaaaaaatcccttcttgcctggggaccagtctgcctttctggactaataaattagctacaagattagaaactatggtttagggaccatgcagccttcagctgtgagtctgaacctccccagattgctcctgagaataacatcactattgtaaaacctaagatcagtgcttgagatattttgcagaccttgcacttgatggatctgctgacaccacctccaacagtaatgtagctcagacagttctgccatcccactcaggaacagaagacagcaagaaaaactcacttcgaccccctatgattccatctccaacccgaccaatcagcactccctacttgcctagcccctaccagccaaattatctttttttttctctctttttttctttttgagacggagtcttgctctgtcaccaggctagagtgctgtggcacaatctcgggtcactgcaacctccaactccccggttcaagggattctcctgcctctgcctcccaagtagctgggattacaggcatgcgacaccatgcccggctaatttttgtatttttagtagagatggggtttcactatgttggccaggatggtctcgatctcctgacctcgtgatctgcccgcctcggcctcccaaagtgctgggattacaggcatgagccaccacacccggccaaattatctttaaaaactctgatcccagaggctgggcgcagtggctcacacctgtaatcccagcactttcggaggccaaggcaggtggatcataaggtcaggagttcaagaccagcccggccaagatggtgaagcctcatctctactaaaaaatacaaaaaaaattgctgagcatggtggcagtcgcctgtaatcccagctactcgggaggctgaggcagataattgcttgaacccgggaggtggaggttgcagtgagctgagatcgtgccattgcactccagcacaggagacagagcaagactccatctaaaataaataaataaataggccgggcgcggtggctcacgcctgtaatcccagcactttgagaggcctaggcgggcagattatgaggtcaggaattcaagaccagcctggctaacatagtgaaaccctgtctatatactaaaaatacaaaaaataagctgggcatggtggcggggcgcctgtaatcccacctactccggaggctgaggcaggagaatcgattgaacccgggaggcagaggttgcagtaagccgagatcacaccattgcactctagcccaggcaacagtgtaagactctgtctcaaaaataaacaaacaaataaattaaaataaaaactctgatccctgaatgctcaggacgactgatttgggtaataataaaactccggttttctgcacagctggcgctgcatgaatttactctttctccattgcaattcccctgtcttgataaattggctctgtctaggcagcaggcaaggtgaagctgttaggtggttacaatctcacagggttgtcttgagagttgatgaaaaaagcagtgtttttttctccctcacaactacagactccctcaacagtcattcaacacaatacttctgacacctgacgtgtgtgggttgtttctccacacatcaagcaattctgcagcagacactaactgggtgtccttcaatttaatttaattccaacactttctacctggagatagtgtcagattgtaactgcagtaagttcattgccagatgtgcaaatcaatacgctgaggcaccgggttgcagcaaagaaaaaggtttaattgtagggcgacctaaagaggggatgggagaaaaccccaaatctatttccccaaggtgtttagggttagggatcttttttttttttttttagatggagtctcactctgttgcccaggggcgtgatctcgactcactgcaacctctgcctccctcaggttcaagccattctcctgcctcagcctcctgagtagctgggattacaggcgcctgccaccatgcctggctaccttttgtacttttagcagagatggggtttcatcatgatggccaggctggtcttgaactcctaaccttaggtgatccgcctgcctcggcctcccaaagtgctgggattataggcatgagccaccgtgcccggccgggttagggattttaaaggttttttttttttttttttgagacagagtctcacattgtcgcctgggctggagtgcagtgtcgcgatctcagctcactgcaacctctgcctcctggcttcgagcgattctcctgcctcagcctcccaagtagctgggattataggcgcccgccaccaggcccagctaattttttgtatttttagtagagacggggtttcactatgttggccaggaggctggtctcaaactcctgacctcgtgatccgcccgcctcggcctcccaaagtgctgggattataggtgtgagccactgtgcctggcttggtttgttttctgttttttttgagacagggtctttcttgctttctggcctaggctgaagtgtagtgaagcaatctgcagcttcaacctcacaggctcaagagatcctcccacctcagactcccgagtagctggaaccacaagagaacgcccaccatgcatggctaatttttgtattttttgtagagatggggttctgccatgttgcccaggctggtctcaagctcctgggctcaagcgttccaccttcccaaggtgcgtgagccactgtacatggtcaggagtctttaaactgtttggcatcacttgttcccccagaattaaggatctgaaaaacatcttaagcaattcttttttttttttttttttttttgagacgcccaggctggagtgcagtggcacgatctcggctcactgcaagctccacctcccaggttcacgccattgtcctgcctcagcctcccaagtagctgggactacaggtgcccaccaccacacccagataatttttttgtattttttagtagagatggggtttcaccgtattagccaggatggtctccatctcctgacctcgtgatccacccacctcggcctcccaaagtgctgggattacaggcgtgagccaccgcgcctggcccatcttaagcaattcttaaacaaaagctttatgattctaatgtcagacatcctatttataggaacagtgtggatgcagatggtcagtatctagggctacggtgacttttggttacagggaggtggccctaagtgcagactgagtaatgcttaattttattttactttatttatttatttattttgaaacggagtctcgctctgtcaccaggctggagtgcagtggcgtgatctcagctcactgcaacctccgcctcccgggttcaagtgattctcctgccacagcctcccaagtagctgggactacaggcgtgcaacaccacgcccagctaatttttatatttttattagagacagggtttcaccatgttggccaggatggtctcaatctcttgacctcgtgatctacccaccttggtttcccaaagtgctgggattacaggcatgagccaccgcacccggcccagcctgattaatgcttaattttaaatatatttgtcttcttttttttttttttttttgagacggagtctcactctatcgccccagctggagtgcaatggtgcaatcgtggctcactgcaacctccacttcccgggttcaagcaattcacctgcctcagcctcccgagtagctgggattacaggcacacgccaccacacccagctaatttttgtatttttagtagagatggggtttcaccaggttggccaggctggtctcaaactcctgacctcaggtgatccacccaccttggcctaccaaagtgctgggattacaggcgtgagccaccatgccccgcctaatgcaaattcttggtaaacaacataggaactgcctcttcttttcctttaaaaacccattagtggctgggtgcggtggctcacgcctgtaatccctgcactttgggaggctgaggtaggtagatcacctgaggtcaggagttcgagaccagcctggccaacatggcaaaaccctgtctctactaaaaatacaaaaattagctgggcatggtggtgtgtgcccgtaatcctagctactagggcggctgaggcaggaggatcacttgaacctggaaggcggaggttgcagtgagccgagatggcaccactgcactccagcctgggcaacagagtaagactctgtctcaaaaaaaaaaaaaaaaaaaccattagtaactgttgctaattggagcatatattaagggcaacttgaatccatgctcctgatcacaggcctcaaatttggcccaaataaacactacttatattaaatttgtctaagtttcttttctctttaggtcaacaaaagatattacaaatgatacagatagccagatggaagagatgcatggagcaagacccgtgggaaggggtgtggtgtttccatgccctttctggaggaccaccctccagtgacctccagggaccatgtgttcagctatctggaagcttttttttttttttgagacggagtctcattctaggttcaagcgattctcctgcctcagcttcccgagtagctggaattgcaggcacgcaccaccacacacagctacttttttttatattttagtagagatggggtttcaccatgttggccaggctgctctcgaactcctgacctcaagcgatccatccgcctcggcctcccaaagtgctgggattacagggattacaggcgtgagctaccacgtccagccttggtggttttttttttttttttttttttgagacagggtctgctttgtcgtccaggctggagtgcagtggcagggacatggctcactgcagcctcgaccttcctgggctcagactaaactcccacctcagcttcctgagtagctaggactacaggcatgtgccaccatgtccagttaattgttgtatttttttgtagagctggggtttcgccatgtagcccaggctggtcttgaactcctgagctctagtgatctgcccacctcagcctcccaaagtgctgagattacaggcgtgagttaccgcacctggctgacatatgcccttgagttgtcttccagaaacccagacccctagcagatggaaaacacccactgctgtcacatagaccccagataagggggaactgaggactgaactctggccttacccagtgtataactgaggcgggatttttctcagcccctttgtcagccggaggtcttcagctggcgacacccctgcccgggccttgctcaggcctgggcttgctgcaggagatgccccgtctactcaggtcactgggccacgcctggcttccactccaatgcagatccctgcactcagcccctggagggaggaggtgtgagcaagtgtggagtctgaccaccacaccaagcacagacacaggagtgggttccatgcagggcttgaggctggaccaggcatgttgcactgaggggaaagtggtggtatatgaacagggatgcctatgaccccaaagccccagagtgggtattacagcatgctaatagctcttttggtcccactgtctgcagcctgatggacagcggctgatgtgttaacagctctgtcagtcccattgccccattccagcctatggctccagtactggcttggccctgccactccttcccatcacatgaggcacctgacctcagccagtggaaggcagaggaccagtgttacagcctctttttacctacattcggtagtcctaagttcttgtcccgtgtccaagaagaatgaggttatgttgacgattgaagggtgagggggacaaagagctttactgagtgacaaaagagatctcagtggagaggaggatgtgagggcttcccccacctgaagttgggtggtctcttactcggtgtggctgtgtctgcggcttttataggctcagaatggcagagtacatgctgattggtttgtgagtatgcaaaaaaggctaaaacaaaggcatcactcaaaggtgggcacaacagtgtaagaaaccaattagggaagggtaggtatatgtaaaataggtgaggggtggggatcaatcagaggaaagtgcaccaaagtggaagagaggttctcactccagtccgtggatttacccaggacttgtagcttggctttcaggctttaaactgtctttggtttgaaggttggttttcaccggggacctgtccctgtctgcctaggatttgtctgcctcctgccactctcataacaataaaagttagctgcagccaggtgcggtggcttacacctgtaatcccagcactttgggaggctgaggccagtggactccttgggctcaggaatttgagaccagctgggctacatggcaaaaccccgtctctataaaaaatacaaaaattagccaagtgtggtggtgtgtgcctgcagtgccagctactgaggaggctaaggtgggaagatcacttgagctcaggagatggaggttgcagtgagatgtgaccttgccactgcactccattctgggagactgtctcaaaaaaaaatgctgctattatagcttgaaccctcagctgggcactggcagaaatgtgaagctgaattagacatatagtctagaagggaagagagagaggaaagtgtattgtcactagataatagagtgtgatcagttctactagagattgttaacctaaaaagaagaggctgagtcacaaaattaaagttacttgattcacagtgagacagctgtccataagactcatacccaagtaaccttggatatgagctctgttaggcctttgtttcaagttttttttttctgtttgtttgtttgtttttccgagatggagtcttgctctgtcgcccaggctggagtgcagtggtgcaatctcagctcactgaaacctctgcctcccgggttcaagcgattctcctgcctcagcttcctgagtagctgggactccaggcatgcaccaccacgcccagctaatttttttgtatttttagtagagacagggtttcaccatgttggccaggctagtctcacactcctgacctcgtaatcctcctgccttggcctcccaaagtgctgggattacaggcatgagccacagtgcccagccacaagtatgtttttaaaggtaaaatgcagggacaaggagtgggctgatacagtcttttgtcaggaattctcattggtttactgaattagcactgattagtgattggccatacattgttaagctgtagggtatgggttacagtgtccattgtggtattattaggttaatttatacctagttgtggcaatagcaagcagtttcaagagataaataaatagctcaaaaggaaggaagtagaatgtggttgctgtctcattttaatgttgttactgaattgaccttggatctgctttcctagtgtgcagaaaaagccaaacactggccaggcacagtggttcatgcctatactcccagcactttgggtggctgagacaggaggatcacttgaggccaggagttcaagaccagcctggccacatagtgagacccaatctcttaaaaaataagcaggcgtgatggcatgtgcctataatctcagctactcaagaggctgaggtgggaggatcacttgagtcttggaagtagaggctgcagtgagctgtaactgtgccactgcactccagcctgggcaacagagcaagactctgtctcaaagtaaaaacaaacaaacaaacaaaaaaaaaatgccaaacagcgacaccaggacttgcagcaaaagaaagtgagataatttattgcaggtgccaagcaaggagaatcaggcagctaatgcttaagacctgaactccacaatggcttacaagcaagggtttttaaaagaaggggcacatttcaggaaagcaaaattgtaaatcgatacatagaggttacacattggtttgccccaaaaaagtgggatatcttgaagcaggggctcatgtgaattcagagattctttgatttgtaattggctaaggaagcaaggctttgtctaaaaacttggtgtcagcagaaaggaatgctaaggtttggcccgtgggtgtgactctctccacatccctcaggaataatttggaaaaaaggatggtggtcagagttcagtcttcagttcccccttatctgaggtcaatgtgacagcagtgggcattttccatctggtaggagtctggaatcccagcactttgggagactgaggcaggagaacagcttgagcccaggagttcaagaccagcctaggcaacatagcaagaacctcccgtctttacaaaaaatttaaaaattagtcaggtgtggtggcatgtgcttatagtcctagctactcaggaggttgagatgaaaggatagcttgagcccaggagttcgaggctgcagtaggcctggatgacacagagagaacccatctctgaaaaaaaaaacaaaaccagaagacatgtcaaggtgttatttgtttttagagatgcagtctcactctgtcacccaggctggagtgcagtggtacaatcacagttcactgcagcctcgactttccaggctcaagcaatcctcccacctcagcctccagagtagctgggactaccggcatgtgctaccaccctcagctaatttttaaagtatgtttagagacagggtcttgctatgttgcccaggctggtcttgaattcctggacacaagttatcctccgccttggcctcccaacgtgttggaattacacgtgtgagccactgcacctggccaagatattattttcatttttttttaaatagtaatgagatcttgctatgttggccaggttggtcttgaactcctggcctcaagccatccttctacctctgcctcctaaactgctaggattacaggcctgagccactgcactctgtctttagttgttgtttgtttttttgtttttttttttattttgagacggagccttgctctgtcgcccaggctggggtgcagtggcacgatctccactcactgccattctcctgcctcagcctcccgagtagctgggactacaggcgcctgccaccacgcccggctaattttttgtatttttagtagagacggggtttcatcgtgttaaccaggatggtctcgatctcctgaactctatctcatgatctgcccgccttggcctcccaaagtgctgggattacaggcatgagccaccacgcccagcccctatctttagtttttatagagaactaaacatcttgtgactctggcttacttgggtggctgcttaagttactattaccttcttccttggtgggttattcatttacttccctaattgctgggtgcagggctagctagttcctgaaatctcccttgaagggactcaaaattttccctttatctccatacttgcgggccagaggggcacctaagaagggtctgtcctccatatcaatgtctctctgggcctgataatataaaaggatgcacattcctcagataaaatctcttttctcaagatagaccagcaagagggaagaagtagaaggttctaggttctccaaacaccctagtttctcttacagataagtttttctgtattgggggagggtggcatggggttggggggtggtctgtatctcccaacaatctaagttcttccttcactttgcagggatactatgagcaaataaccctgactctgttttctgtggtagtggtagtggggagtgctccaagaactccttgagcctcattagtccctcgttcttatctgagaaggttcctattgcttggtgtattagtccgttttcatgctgctataaagatactacctgaattgggtaatttataaagaaaggaggtttgggccaggcatggtggctcatgcctgtaacccagcactttgggaggctgaggtgggtggatcacctgcagtcaggattttgagaccagcctggccaacatggtgaaaccccgtctctactaaaaatacaaaaattagccgggcatggtggcacgtgcctgtagtcccagctatttgggaggctgagacaggagaatcgcttgaacccgggaggcggaggttgcagtgagccaagatcgtgccactgcactctactctgggtgacagagtgagactccatctcaaaaaaaaaaaaaaaaggaggtttggcctgacgcggtggctcatgcctgtaatctcagcactttgggaagtcaaggcaggtggatcacctgaggtcaggagttcgagaccagcctgggcaaaatggtgaaacctcgcctctactaaaaatacaaaaattagccgggcatggtggtgtgcacccagctacttgggtggctgaggcaggagaatcacttgaacctgggaaacagagcttgcagtgagctgagatcatgccactgcactccagcctgggcaacggagcaagactcaatactcaaaaagaaaaaataaaaaaaaagaaaggaggtttaattgactcacagttctacatggctggggaggcctcaggagcttataatcatgacagaaggcaaaggggaagcgaggcacatcttagatggcagtaggagagagagcgagaaagtgccacactttaaaaccatcagctcttgggagaactcactcactatcatgagaacagcatgggggaaaccacccccatgatccaatcacctcccaccaggtccctccctcaacatgtggggattacaattcaagatgagatttgggtggggacacagagccaaatcatatcacttgggtagtggagatgagggaaaggagtggtattccaaagcacgaggtattgagtacgttgtttcatgagtcttttttttttttatttattttttatttttttattgatcattcttgggtgtttctcgcagagggggatttggcagggtcacaggacaacagtggagggaaggtcagcagataaacaagtgaacaaaggtctctggtcttcctaggcagaggaccctgcggccttccgcagtgtttgtgtccctgggtacttgagattagggagtggtgatgactcttaacgagcatgctgccttcaagcgtctgtttaacaaagcacatcttgcaccgcccttaatccattaaccctgagtggacacagcacatgtttcagagagcacagggttgggggtaaggtcaccgatcaacaggatcccaaggcagaagaatttttcttagtacagaacaaaatgaaaagtctcccatgtctacctctttctacacagacacggcaaccatccgatttctcaatctttcccccacctttcccccctttctattccacagaactgccattgtcatcatggcccgttctcaatgagctgttgggtacacctcccagacggggtggtggccgggcagaggggctcctcacttcccagtaggggcggccgggcagaggcgcccctcacctcccggacggggtggctggccgggcggggggctgacccccctacctccctcccggacggggcagctggctgggcagaggggctcctcacttcccagtaggggcggccgggcagaggcgcccctcacctcccggacggggcggctggccgggctgggggctgacccccccacctccctcccggacggggcggctggccaggcggggggctgtcatgagtcttgtattatccattttattattccttagtgcatggtaaagcttcctttaaaatgcaagctgatttatttgagccagaggaccccaggggaggtgagatagatacccacacctgggcagaggattacagggaaaacggcacccgctctttcccctgggcacatatggtagaggctgtgggaatgagggtattgcaggggtgatgagggtagagtcaggactgtaactcctcattccaggttccccggagctttgactgttgtgctcctagcctcaagcaatccttctgcctctgcctcctaaggtgctaggattacaggcctgagccactgactgtcctcctcctaggaggctgttgactgagaaggtctggatgtcaaagcctttcaccacaggatatagccaagattactgcagagccaaggcccaaggccatccttccctatgcacagctcttcgtaattcccctgacttctgtgtgtgcaacttgtaagcagctcagcctggagtagaagttggggttctgactttctacagcacctgggacgggaaggatcagaggagcacagggagctgactgccttataggtgtctcacgtcatcccatctgaccctccaacaagcatgtcaggctggcattattcaccccattctacaaagctcagagcagtgaagggccttgcatgtgacatttaccatcatcatcactagtatgtccctactcacatcacagcaattctttgctcaaatctgtaattgctgagactcgaagtaaaacccaaagtcttcacaatagcaatagcctgcaaagctctgcccccctcctctcttctctgacctcctcactgcccctgtcttactcactctgctccagccacagtggcctccttgctagcagttccctccccaacacgcccggcacagtcccacattcccgccttgctctggcttccgctgtggctgtttcctccccgcagaacactcctgccttcctcaccgccaagtctggactcaaacctcacctcctcaagaggcttgcccagacagccttttatattctgcaaactgcctcccactgccacctgcccccttactttttgtggccttgacctttcaacatactacatgatttgcttacaatacttgtctgtcttgccttcaccagaatgtaagcgctctacaaaggcagagggaaggctatcttgctctctgatgtatcctccagcccttagaacagtccgtggtacttagcaggttttcagtacatctgtgcccggcgatggaaagaatgaatgaatagtgagaccgaagatcgcggccgtaagcctctgggcacgggtgccccggggcctggcggaacgctcagggaactacatttcccgtgaagctctgggcgcagagggccgcgggggctgccgggaaaggcatacgtgcttaatcctggtgcagggggcgagcatggccgctccgcgaggtgagccattggctggggtgtcggcgagtgtgttcgtggagcgcgtcctggggacgactcccggcattatcggccaggttgagtccgctcctggcattccgcggaaagatgggtgggtgccgggcagaggtgtggccacctgcgatggggattgacctccgaggggagggggcccttctagacgtcgtgccgtgggataggtaccttctgctccctccccgccaccctgcctcagatcagcacaaggtccttactgctgcccatctgacagttgggaacatcgaggcctgcagcggaggggggtctcatccaacagcctacaaaacccttatttgactctgtccccagtgagcacccccagctcttgcctggtttcccgggacactagggtggggcctgaggagtggagtggcagctgaccctgtctgtgcccctagtattcccactttcctgtgcggtgcagcagtatgcctgggggaagatgggttccaacagcgaagtggcgcggctgttggccagcagtgatccactggcccagatcgcagaggacaagccttatgcagaggtgagccccgggctgtatttcagcccactttacccgcaggtcaggagaaagggcctgaggcaagtcataagaatcagctgggaagggtgaggcagcaaggagggaggagacccacttggctcttcaggctaatggactagatagtgttatcaaaaagaagagaggttttgtcataataggctgggatttccagcactctccttcccccaaccactcttagcacttagtgaattttaattcagccctctttgacaattaagtttttttactttgactatttttttgcatttttattaacctaaaatatttctcctgcctatttagtggagaaaaagccaaagcataggaaggctttcgcctctgcttctgaaactggaagatgtatgttaacccctgaaagaatcatttaagagtcatagtttttctgctaccttgacagtgcagatgtcattctcctctttggacagacaaagaagatacatctaaagaagggaaataactagtccaagtcttcatagatggctagaggccgagtctggacaagggcctgggtctactgcctccctgtatgtccatgatggcatgaacatttgtatccagacctgggaggcctttcccaggactcagttgccctgtggggagcacagcataacggattgggacaggccaactcagggtggcaggtttcttcccccttcccctcccaagtttcctgtctttccagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggtaaaggacagagtgcggtgcagaggtcagggtacagaagggcttatgctaaggccctcccgtgacttttactgccacttttaccccacccatgccaggctcctgcccaaggccaaatccaggctgacaactcccaatttagctctgcaaagccagatggtagtgacacatgcagcaactaagtctaagcaaacagctcaccggcctgtgccaggggagtttctctaagctcattccaaggggcttgttcctggtcttccctcatccaacccatgtctattcatatctgccatttactcatctgctttcaggaagagttcaacttgcaaggcagggcaggtaccctcagccccacccccatggagtctccctacacaagccggagtcccatcctaagcaactgtggatcaaaactcctttttttttttttctgagacttgagtcttgctctgtcgcccaggctggagtgcagtggcgcgatctcggctcactgcaacctcctcctcccaattcaagcaattcttctgcttcagcctcgcaaatagctgggactacaggcacgcgccaccacacccagctaatttttgtatttttagtagagatggggtttcaccatgttggccaggctggtcttgaactcctgccctcgtaatccgctcgcctcagcctcccaaagtgctgggattacaggcgtgagccaccatgcccagccaaaactccttatttctagatacacaaagtaagacccagagaagggagggatttaccaaagccacacagcttgttagtgtcagagcttggtctggtatttgggtttcctgattcacaggccaagcctcttaaagtctgccccagcttttccctgatttgccccggggttgcccctgatttgcccctgccctgggttggctgagccccaagtttctgcaacatgctttgactgggctccttgccagaggtaggtagtcactgccatcctgcaactggggagggtggacagcaggggctaggtggcactggtgtacctgctaggtaatggctgtaccctcaccatcctcctcttcccctggccaccccacaggagctggcagagaagctgcacctccaggctccgcagcactaccccgatgccaaccacaagccagagatggccattgccctcacccccttccagggcttgtgtggcttccggccagttgaggagattgtaacctttctaaagagtaagttgggcagaatgctgaaggcatgcgtactgggccagggatacctggggaaccaagatgataggaacagtggctgagaacgggtcacatgtcacaggaactgaagggcctcatgaagcagtttttggagccagtgagccaggccagtgagaccaggctcaggtgtggtagtcaagggctggtggtgagtgattggtttccactgcaaagtttacttagcattgccggctctttggttagggctgggatggaaaggtgtcctccaactccccacttgtgtgggttccatcttaccattcctgatatgggccctgggccttgccttcctgtagaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaaggtggacacagttatattcctggttgggtgcaatgctctggcctgggcttcccagcagacaccagactctggggacagttctcaacccccttgcccaagtggaacactaaaaggggccccacttagatgacctgttggcaacttagcattgcttgcctagtctttgtggagcagggcccttcttagttgagtgctgcttcccaactggtcatcttctccagatggttggaggcagactggcatagaggactcttaggatgccttccacctaggcattctgagattttccctagccctgcagctgccctccatggatggacttgtatctcggggctaaagaggcaggaaggggacacgagcatcctccctctcctggaaaggactgatgcctccagcactcagtcatttgatctttcctttaccttctgtgtgcccaaccttgtgctaagaagagttcaggaaatgactgtgatgggtgtggtcactgtcaccctaaaggtggggagtcaacacaagcagtaagaaacccaaaacagaacagactcccagcaatgagcttatgtggtgcaggcgatgaggtctcagcttcttagcctggcagccacaaccccttctctaggtggcccagagctctctttttattttacctctacaggtttcccattacctttgagccttagggcattatttatttgacccaagcatatttttttctgttcagtgtgtgtgtgtgtgtgtgtgtgtgtgtgtgtgtgtgtgtgtgtgtgtgtgtgtgtgtgtgtgtgtgtggtctctttctgttgccccaggctggagtgcagtggtgcgatcttggctcactgcagcctctgcctcccgggttcaagcaattctcctgcttcagcctcctgagtagctgggattacaggcatgtgccaccacatctggttaagtttttatattttagtagagacggagtttcaccatgttgcctaggcgggtctcgaactcctgagctcaggcaattcacctgcctcagcctcccaaagtgctaggattacaggtgtgagccaccacgccaggccccttgcctcactttaaagaagcctggctgggcacggtggctcacacctgtaatcctaacactttgggaggttgaggcggccgtatcacttgaggtcaggaattcaagaccagcctggccaacatggtggaaccccatctctactaaagatacaaaaattagccaggcgaggcagaggttgtggtgagcctagatcatgccactgcacttcagccggggcaatagagtgagactctgtctcaaaaaaaaaaaaaaaatgctgggcatggtggtgtgtgcctgtaatcccagctactcaggaggctgaggcgcaagaatcacttgaacccaggaggtggaggttgcagtgagtctagattgcaccactgcacttcagcctgggagacagagcaagactccgattcggaaaaaaaaaaaagaaaaagaaaaagaaaaaaaatttaaaaattaaagaagtccacccttgccactctacccaggctgagctcattttcccttgtcgtttccaggacacattttggccctcagcgcattctgcctcatgctctctggagcagaccgagagagattctctgagacatagaactttcttttttttttttgagacggagtctcgctgtgtcacccaggctggagtgcagtggtgcaatctcgatcactgcaacctccgcctcccgggttcaagcgattctcctgtctcagcctcccgagtagctgggattacaggcacgtgccaccacacctggctttttttttttttttttttgtatttttagtagagatggggtttcaccatgttggtcaaactggtctcgaactcctgacctcgtgatccgcctgccttggcctcccaaagtcctgagatgacaggtgtgagccaccgcgcccagctgagacacagaactttcagtgctaaaaactagaaagtcgccgggtgcggtggctcacacctgtattcccagcactttgggaggcctaggtgggaggatcccttgagttcaggagttcgagaccagcctgggcaatatagcgaccccctctctctgcaaataataaaaaacttagccgggcatggtggcatgcacgtgtggttctcgctactcaggaggctgaggtaggaggattgcttggtcctggacagttgaggctgcagtgaggtatgatcgtgccactgcactccagcctgggtgacagcgagaccccgtctcaaaaaaaaaaaagggaaagctcgggcatgttggttacccttcatgaaactcttttgcgttatctccctagattttgagctccaagggcagtggttctcatacaggggacatttggctgttgtctggagccattttttgattgtcaaaacccagataggggttgctagtggcatcttgtgggtggaggccagggaagctgctacacatccatcagtacacaggacagcccccacaataaagaattacctagcccaaatgtcagtagcgccaaggctgagaaatcccatcctgaaaggaccatactctagctcttttagtggctagtatagtcctgggcatatgaatagtcaagatatgatgaaagatggtatttgtatggactggagtatcaagcaaggctcgacccccaaagggctggaggcgtggccagaaggacagggccactttggcttctggattcctgtggcagggaccttttcctaggactccctggccaatgtggggctatgaacagcactgagtatccccctaagtgaccttggggtgctctgtgaccctcagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtgagccacatttcagcagtgagccccactgccatccctgctgggccctgtttccctatctggacaaaggaaggagaagggtggtcaaggagacccccaaggaccttgcagctctgacctctgagggttcctgggctcagcaagcaacagctggtagggatgatgaatgcatttagcattgaacacgccttgaatcctgacaccaaccctgtgatgccatgctactctgattttaagtcctgccagtcagtgtgggaaccacaatttgaacgcaggctatattggatcaaagctgttgttctgtcacagcctttgtatgtctgtcctacctaccagggatttttacactaaaatatgcatgttgccatggaaggatgccacctttcgactgttggctgcttatccacacatgcctcatgcacaggattctggggtagaagtgggagactacagagttggggctccccaacccccaggggttaacatgactcccctctgacaataatgggtgacctgtcacctgtttttggtatttgatatcttaaccccattctcccagagaatacaattcatggaaatttttacctaacttggcatggggttcatggagctcaggttaggaggcccagaactggagagctaaggcatacttcatcagcttagcacatgacgactgtctctccagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtgagtgaggggctatgatgggtgtccttcgtgtgccatgaaaatctctggcaagggtcacgatgtggaggacacctggggctgggtttcctgtcaagcccacttggcggagggtggccccagggcctgcccattccttcctgtaccagggaccaggcctctatgctgactgagcctgggttgtgcgagaaggtggcagagctctccctcgtgccctggggactgtcctgggcccatgagctgatgagagcagagtctgagctgcactgccttatcatttcttcctgcccaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgaggctgtggggtaatgagcactcagcctttggggtacctgttcctaaagtgggccaaaagagccctccctacatgatgccccagtttttgctttattcctatttcatacagcttctcgggggagtgagcaggctacactccagaacaccggtatgggaaggagtgggagaggaagccagctttggcctcacaggcacagcttgcaagcaggccttgggtctgcccagaggcacagcttgcaagcagccctacagagaaggtgactcaaaggatacaccagtcaccagtgcaagactcttcgctcctgtttttctcttttttttttttttgagacggagtctcggtctgtagcccaggctggagtgcagtggcacgatctcggctcattgcaagctccgcctcccgggttcacgccactcttctgcctcagcctcccaagtagctgggaccacaggcgcccaccaccacgcccagccaatttttttggtatttttagtagagatggggtttcactgtgttagccaggatggtctcgatcttctgacctcgtgatccgcccacctcagcctcccaaagtgctgggattacaggcgtgagccaccacgcctggcccggctcctgtttttcaactggccctagaggaggggtccgcaaaccaggctggcaggccagttctggccatacctgttcatttccatactgtctggctgctttcaagccacagtggcaaagttgaagagttgcactagactgtacggcctgcaaaactgaaaccattgactgtcaaccacttctctacaacatactcaactgttgcagattacagggactcaggaaccgaattagacaattttcatggcgaggagaagcccagttagctttcctaaacgggcaggaagtgtgaaggagggaatctcctgatgccctgctccaggggtggcacacacctgcaagaggctgtcggctgtctgctgctgctgaggtttctgacctgcaatcgtagatcctgtcaccacagactaatcacttagtccactggctccttcctgtgggataaaggtttaaattcatgcaaaagaatctttctgggcttctgcccacactagagtccctatacaatggagttccaggaaaccaccttcaaaaatctcctgggttttcttgcctccaaattttcttcagctaaaaaacaataaagatgagctggaaagaaaaggtctgctaaagggaacccattctacagaagtgacttgcaagagcctatttcactcatgccgtccagtgaaacaggcccgaaagtgatgcccagtgggaacagcagaaaggggagggagtttccagaaggaattgctgtagtcagctgttaagctatttcttcatttcaggatatccaggatattcttaacttttatttttttgagacggagtctcgcactgtctcccgggctggagtgcagtggcgcgatagctcactgcaacctccgcccactgggttcaagcgattcttctgcctcagctcctgagtagctgggactacaggcgcctgccaccacacccagctaagtttttgtatttttagtagagacggggtttcagtagagacggggtgacaggatctacaattccaggtaaggtcaggttggtctcaaactcctgaccttgtgatttgcttgcctcagcctctgaaagtgctgggattacaagcatgagccattgtgcctggccaaggcctttaaaatccactgcaacacagacacagctcaactagtgtgattgcatttattcttataaatgtacagagctgtagaagtgcaagccaagagttctatagagtagtacataaacaccatatggtaccactcctgctgggaggtaagcctggatacacccctctcctcaggaaactgtcacctgcagaacacacagcactcagaattaaggcagtttggccctgggcacattggtggtattttggtatgtggccactggccctaaacaactgaccatttctaccctgcctcactgcactgtcccaccaggtccctccagctttttctacaaggtaacaccctcctacatggggtcagccagctcagaaacctcttcttcagggacagttgcagctgaatatgccagagctgattattacaacaacgatgcagagggccttggttttggggtcctgccaccctcacccctagaagctgctaaacacccaggccattctgccctgaccacctccccaacagagatgtaggtctatacttaccttccacagccacctcccagcacacactgggtccctctacctgtgttgctgtctttctttacactgtgctacatttgatccctttccacatgtgcacttcacctctgcagacacaagaaaggcctggacatggtctctgcagatggggaaggggttctggatggagatgttcttgagctctacaagcatttgcacaaagtgctcagaatgttggccactgcatagagctgcagagtcccattccagaacagagtaaccatctgcctctcttcccaagaccccaagctggcatgactctggtctctgtcctatctctctgctgtgatgctcctagctagtagagtaagtcagcccccagatactgtatattcctctcaaccttccatggtttgagaaaaacacaaagatagatgtccatcaggcactcacaggattaccatcgtaaggatggttgtcagacaaataacaaataaggccgtatctttttattagacttgctcatcttctagtcaccccttgtggtagagcgaaaagagtgtgttgtccctctcatgcctctggtggtcacaggacactgagtaaagcaagagactggatactttcccatgtagaacctataccccaatcccgactattgggctgggaaccctgtctatgcccattcaaagctcaccatgtgggaggactgcttgggcctgggaggttgaggctgcagtgagctgtgattacaccactgcactccagcctgggtgacagagaccctgtctccaacaaaacaaagcagaacgctcaccatggttctgagttaagccaaaaaacaaaacaaaacctgttggaaaaattctagaaagaggcttggtatagagtatagcaagatatactctccaatttgtgggtagggggtgtcacagcagaaattatgcctatttctgctgtttgggctgggggctgaaagaggctgtgtcacacccagaggtctgcttaaagcccaatcctgagtatccagtaaggcccatgctgtgaccagaagaatctggcaatagaatggtccatgctggagtgaagggaggccctctacactggtggactgatttcctcaggcaagggtctaggagctggcttaggtctctcttacccttcctgtctgtaagcctcagtctaggacaaagcccacacagctgtatacccactctcacgagtccattgctacttctcaaaagtttaaaaagtaaacaataggaaggcaccggactgctccctgtagctccctctgctggtaataataaaaactgcaggcttctggggccagccccagtaccttcgacctaatctttagctcaaagactgggtgaagaaactcacccagaccaaggaaatacaaataaataaatatgaacatgtcagagcagtttttctctaactagggaagggcaaaccagaatcactaaactcacccggacggttggaccagttggggatgccccaggtccagggattctggaagccaggatcctgctgtatcattaagcaacctgctatgatccctgtcatagttagacaggtgcaacctgaagagggacaaaaggactcactttatgctgtcttgaaggtcaagcctgcaaaccatcttagagctaggaagaatagagcaaacggaatttctcgaactggtctcaaacagtttcttttttggattgccagctataataaaccataaagtgctattttctgcctccattcaacactatctagcacagcctgggcacaagagctccctttttgcctccctgaagcactatgacaaataccaatcaagctgtctgcaagtgttttccttagccacctttgtcacccaccataagaaccagaattttctgtcttgcccttattaaagtgacttctccaaactctgctccaacagcagaggaaaactacagaattctacctatcagcccacagcccagatgggggcctctggcctgagaagcaacaggtaagggctacctgcaggtcactttctaggggtcagtgacttcagtgctcactgcactgtgtgagctatgagtggccaacagggctctgtaggcctcatggtgagcagggcccaccttggagggtaatgtctactggagggtacaggaagaagagtccccaagacagcaccagcagcaggagcatgttgaagaggccatgggcttaggggggatgaggtccaagtcctcgtcatctggaatctcatccaggtgatacccatcctgaagcagctgccggctcacatcctggttcacctgctaagagaaggagaggagggaactataggccaagatgcaaagcagaagtaactgctacccaaaagacagaaccacattccgttaccagggcttcctgtccatgtcccaccccaggccaaccccacacatccctggactacaggaggaagtaccaccttctcctacttgtgcctcagccagcagtaagccttagtactgtccagacttcactgtcactgacccccagggatctgttctcactaaatcctgaggcattcatgtaaatatcgagttcccaatatgtttgaaaatcagtgctctgacagttcccactgggagcccagactagtccctatcaaagctgaagaatatgggataataacagaacaatgggctagcgtagtagagcatgggttacagtggaagggggtggtgagcagctttgtctacacactgctggttagacttatcctttgatgccaacagaggtgggttcctgcaaagtggaatttgttggttggtttcatcagttcactgaacataagaaaaataaggctgggcgtggtggctcacgcctgtaatctcagcattttgggaggccgaggcaggtggatcacgaggtcaggagatcgagaccatcctggctaacatggtgaaaccccatctctactaaaaaatagaaaaaattagccaggcgtgacggcgggcgcctgtagtcccagctactcgggaggctgaggcaggagaatggcgtgaacctgggaggcggagcttccagtgagctgagatcatgccactgcactccagcctgggccacagagtgagactctgtctcaaaaaaaaaaaaaaaaaaaaaaaagaaaaagaaaaataaatgaggctggggaaagtgtaagacttcctcttacacacaatctttgacactcagacatttaaggaggacaaaatttgcaaactgctctattctctgtgacagaaactcagagattagccaagatttccaggagagtaagaaaagcaagtggtgtagagtcaggtccccagcacttcacctctgtcaaagggaatgggcttcacttgccaggattttacatccctgtttttctatctgggacagtcactctagaaaaatgtctacatggctatcccaggagtgttttagcctgagttttcatagatggaacaactgaagaaacagaagttgtttggtctggaagaaagcaagcttggtgaaagatgggcaggggagagacggaaatgctgatctcagagaaactagagttgctgtgtgacactggaaagcaggtcaaggaccaatggaaccattcagattaataaggaagatttctctaacagctactcaaagaaaaaattctgtgtgtgttgagggaagggtgggtagcaaggctccttggaggtggtcagtacccaattacaaaaagcattcaagtaagcacagactagcaaacacttagctgggatctatcaaaagggttccttttgtaagctgtggcctagaagacttttattttagagtcttattttagagacagggtcttgctatattgtccaggctggtcttggaactcctgggctcaagcaatcctcctgcctcagcctccctagtagctgggactacaggcatgtaccaccatgcccagcttacatgacttctgagatcatttctagccctgagtctaaatggtctcctcgattctcaacagccctccttggtcacctatacctccaccgggggaagagggcagagtggaagatcgtagaacagaccagaagtctggcacagtgctgtgctcacagcgggcaccaaacaagcatttggcagtggtggtaatgctgcctgcagcctggccctgcacagaaaggtgttctggacttgcctctgcagatgaatacccggaggagtatctggatcccagctccccatcactaggagaagaggaaaacagtcagttccgggaggtacctgtggtgcacagctgtaaatcatcaggcggagagcatgcaagggcatctggaagacttttgaagcaaaggccacacacaacagaactcaagtccgaacaggccttgaataatactggttccctcaattggttctggcagggacagggtcactctcactaacaatgcaaacataacagggcaggatgatcccccggacattggtgctccgaattctagagcagcacgattacctatgagtcttctaaccaagccatcctgggaagggatattgttcagaagagaacggccctggaatgtacatgaagggccttggaggagacagggaacaagcaaaggcatcaggcgatcttcagtcccagccaagttgcttcccaagggggtatttccaaggggagcactcacctgtcagagtcgagggacaccaggttttcatctggactctggctaagagcagtatagcccttgttaaacttcactgacctgaggggagacgggggagaagagaccaaacatagatgaaagcataggcatttcacagggataggcagagtcctcgccctgaaggagaaagaattgactgcactactgacttgccttctccctggtcacagccaccactgcctgcagctccatgtacctggctacagtgcctcagaatgtgtatgttctcattctttttttctttttttggagacagagtctggccctgtcacccaggctgcagtgcagtggcgcgatctcggctcactgcaatctccgcctaccatgctcaagtgattttcctgcctcagcctcttgagtagctgggactacaggcgtgcccagctaattttgtatttttaatagagacgggctttcaccatgttggccaggctggtctcgaactcctgacttcaagtgatccacccgcctcggcttcccaaagtgctggaattacagtcgtgagccaccacgcccggcctgtattctactcctcccataggtcttggaaaaaagcacacctccccttgcctgatctaggaaaagcaccctctccccacttatttaatcagaggacacaaaaactgcaagtctttgggtaaaaggttagggttaaccttcacttctccgagtttcaaccctcatctgtaaaaggaggcactgaataaggttctatgcagctccgagtttactattctgttaaaaacaaacaaacaaaaacaggtctagccattcccacactgctcttcgtcctcattgctggggactccagccaccattctcctccctaacagaggaggagaatgatagtgaatgagcctgtgcactcacagaactcccttattccgaagccctttatctgatcctatcacatccttaaaggaaaagagagattgttcctcttcccattttaaagatagtgaacctgacaggttgcatcaggggaatcgctagctcggccttaaaccagagcaccctgcctccgtcctggggattaaagccttctctaaagctgctggcacagaggaggtggcgcctgctgagaccttttccctgaagagtctgggcggttcggcgaggcccccagcatgccttttctccgcagaacggccttggccaggtcccggtgcttctctggaagttaaaggacccgggtcagccgggtcttccccactccgccgcgtctcccgaaggctgggaggccgctctttccgaacggattttgaggggcgagagcaggctgcagctaaccccttccctccggggccgaggcccagcggagctccggaacccgccctggggacgcggccgcccgcccagggagaaacctcccccgaccatcgggccacactcacgcagcttggcttgaatggagggtgcgcgcgtcaccatgtatggcccccgcttttccacggccgcgggggtgcgctcccccagacggagggctctattaccgatctgcccggagggtggccccgcagctcccggcgcgcggtcccgagccccgctgggccggggtcccggggtagacaaccgcaacgcgcgcccgctgggctccgcggtcgccatggccgggccccgccctgccggatggtgcaaccccgcccgtggcgaaagagtgaccggccgagggagaggcgggctcttttaacaagatggcggtgcgcaggcgcaggtagtcccctttcggagctctccggttcggtagtctgaggacttggccgaaatgttccgcccttcttttcggggggaccgggcagttccgttctcggttttggggtaggcggcttgagcctggtgatggttaggcttagttctgtctctagtggaaattaaatactgatactgtcgtggggctgcgcgtgtgcgtcggtcgggtgcccacggtttgagtcctggcgcgccgcactctgtgcttctcgcagtgtctccttgggggtctccccacatgtggggctgccagagagcagacttgggttgaagagtcatatgaggacaagcgttatcagcgaccttttctagcaaaagaaacaggccccagaagttaaagaaccttgtgaaggtgacacatctagaggcagtgcttgcgctgatccatctgacgccaaaccccaccttctttccaacaccaattggtgcctgtgacattggacaggacctgaccctctctaggcctcagtttccacatttaaaaatagagccaatgtcactactcattgtacagtgaggcaaataggcgttgaaaaggagggtgaaagtgcactctgagtctgtgtgtggtaggctatgtgtcagggctcttgacttctctagcccccaagggatgtgcttgtgactggctggaaagaaactccagatccttgtagaactcccaaatctcatgaggctgtcccttgactaacttactggcttcaatagggtaggtcaacagtgtgcaacctccgagctcccagggccacgcagaccgttgggtggcactatgccttgggcaagagaggtgaaaaggaagaatttagggctgaagttttcaaaaatcaaaagcacaaaggaatccttaccattttggtagattccccccactccccatgatgttagactgtttttgcctccagaaacagcaggttcatatagctcaacttagtatttaatggttataacctcccaatgaagccaatagttattcttgttaaacaaatgaagcttagacttggtcaagtttaccagttaagtgataaacctggaatttgtacccagttgcctgtggactccaaagaagtagttttctggccgggcacagtggctcacatctgtaatcccagcactttgggaggctgaggcaggcggatcacccgaggtagggagttcaagaccagcttggccaacatggtgaaaccccatctctactgaaaatacaaaattagccgggcgtggtggcgggtgcctataatcctagctattcaggggctgaggcaggagaatcgcttgaacccaggaggcggaggttgcagtgagccgagatcaggccactgcactccagcctaggcaacagagcaagacgctgtctcaaaaacaaccaaccaaccaccccccagccaaaaaaaaaaaaaaaaaaaaccaacaaaaaaacaacgaagtggttttctcctggttatgctgatgtggacatcaccaagggccaaagaaaatgtgatttaaaccagcagtctccagcctttttggcactaggggttggttttgtggaagacagtttttccacggggtggaaatgcgggggctggttttgggatgattcaagcacatttattgtgcactttattattacattacaatatataatgaaataattatacaactcaacttagaatcagtaggagccccaagcttgttttcctgcaactagacggtcccatctgggtgtgatgggagacaatgacagatcatcaggcattagattctcataaggagcccacaacctagatcccttgcatgtgtggttcacaatagggttcatgctgctatatgactctaatgccacggcttatctgacaggaggcggacggagctcaggtggtaatgtgagcaatggggagccactgtaaatacagatgaagctttgctcactcatggaccagtatccatccatggcctggggcttgggaaccccgacctaaacccacttaatgtcacaagatcactaggaacttgtagcaaaagtgtgacagccttcatgcacactcctcccaatcttccatcaataatgctgttaactgctgactgattgaacatagaccctgaagccaaattatttgctctgttacctactggcaaattattaaacctctttatgtctcagtttctttagctaagtggagataagaaaacccatctaatggaagtggaattgtgaagttcagttgtaaagtgtttagaatgacacctggcaaatagtaagtgttcaagaaatatatgctattatttacacaacccttatacagcattacaaggatttagtgtttattctctcatttgactttacactccccaagggcagaccttattcactttttagcataaggttatagtaataagtatttgttgaattaatatcctatttcccctcttttagttaactagtatcatagaactttggggctggaagagatctttttttttttttttttttttgagacagagtcttgctctgtcgcccaggctggagtgcagtggcgcgatcttggctcactgcatgccctacctcccaggttcacaccgttctcctgcttcagcctcctgagtagctgggactacatgcgcccgccaccacacctggctaatttttttttgtatttttagtagagacggggtctcaccatattagccaggatggtctcaatctcctgacctcgtgatccgccctcctcggcctcccaaagtgctgggattacaggtgtgagccaccgcacccggcctggaagagctcttagagattatataaagtcattattaatgaagaaattgtggtcttgtgatagttgtactcaatgatcctggcctggatgtgggaagttcccttttccacttaagaaattatgttcactagggctcacgcctgtcatcccagcactttgagaggccaagacaagtggatcgcttgaggccaggagttcaagagcagcctgggcaacatggcaaagccccgtctccacaaaaaaaatagaaaaagtagctgggcatggtggtgtgtgcctgtggtctcagctacttgggagtctgaggtggtaggatcacctgagcccaggcagttgaggctgactgacaggaggtggagctgcagtgagctgcgatcgcaccactgcactccagcttagatgacaatgagaccctgtctcaaaaaataaataacttacaattcaaaaaaaaaaaattatgttcactaggaacctaagacaaataaatacccaccccaccaccaaaaatacccccaaccaactctaggttgcaaggggatgagtctccagagcaagaattgccacagcagaaagggcacaaagcccctcttccttgctcctactactcagaccttaacccagtgcttgtgctgcctgccttgctgggcctggggcttctcaatttagcatagctttattcatctcctactgtgtcacaggtgctatgctgggtcctgcaaacctaatgatgacaaataaggtatctcccagttcccagtcttatttctttgttattggggggtagtgaatcctcggggagagattattggctgttaggagcaaggactactaccctggcttttggaaccctcattgggcagttactctttatccctggctctaaatctaagttattccctaaactttcttggtcctgggacagatacatctccatcatcagttgagaattctggttctgctgttgactggagctgaattccttcatacaggcaagtatctggggttaaacattaaaagggatggaggacagagattttttttttttatcctgctacttccctttcaagctctcttccatctcagaagccactgtctcaccaggttgtggcctctagcccaaggaacttctctcattattggtagagtacagataactagataggacctatgaatctgcaggtctttctgggttcccaggttaccagacccaccattgtcctcacagttatatgcaaaggtatggccacagctgtggcgggctgctgtggcttgtctccaccaaaccccatgtttaaatttgatccccagtgttggaggtggggcctaataggaggtatctgggtcatgggggtggatccctcacgaatacattaatgctctctctgaaggtggtaagttcttattctataagttcctgagagagctgggtttttaaaaaaatatcaattatatatatatagtgggccataaaaactatctctgcggccaggcgcagtggctcacgcctgtaatcccagcactttgggaggccaaggcaggcggatcacaaggtcaggagtttgagaccagcctgaccaacgtggtgaaaccccatctctactaaaaatacaaaattagccggacgtggtggggtgcgcctgtaattccagctactcaggaggctgaggcaggagaatggcttgaacccaggaggcggaggttgcagggagccgagatcgtgccactgcactccagcctgggcaacagagtgagactccgtctcaaaacaaacaaacaaacaaacaaacaaacaaaaactatctctgctttcttgaagtgtggatttagccaaggagccaaaaaacaaaaaaacatagcagtggaaatttactagttatagggatagtcttagatatatatttatgtgtgaatatatattatctgtatagataactaggtattaatgtcacataagatggtgtgaccacacacacacacaaacacacgtgcagagagagggaattcagccacgtggtgtaggttggttaattacttgagataaatgagaagcaggcaggtctgtgctgagctgtgtcatcagtgaagatcacacttggaggtgacattgaagctgattcctcaaagaaccacgaaggaggcacgtggagacccagacagggaacatcagaggctccagaaagagcaggtcccagaaaagtctcagcctgttcttcagaaaggaatgaccactttgtctgtggggtatagtgggaggcagaggaggagatggagctgagattcagggccttggtggattcagaataggtcaggataaactggccaggaaaaggtggccccaccatctcaagagagttagatattaaagagcctggtatctccccttcctcttgcttcctcgctcaccaagtgatttctgctcaagcctgctcccctctgccttccgccatgagtggaagcagcctgaggccctcaccagaagctaagtagatgccagttccatgcttcttgtacaaccaaaacaaccgtgagctaataaacgttttttttttttagaccaagtttcactattattgcccaggctggagtgcagtggcatgatctcggctcaccccaacctccacttccccagttcaggcgattctcctggctcagcctcctgagtagctgggattacaggcatgtgccaccacgcctgtaattttgtatttctagtagaaatggggtttctccatgttggtcaggctggtcttgaactcctgacctcaggtgatccgcccgcctcagcctcccaaagtgttgggattacaggcgtgagccactgtgcccggcctaataaacattttttgttaagagatggggtcttgccttgttgcccaagctggagtacagtgctgtgatcatagctcactgtatccttgaactcctgggcccaagcaatcagtccatctcacctttctgagtagctgggactataggtacataccactgtacctggctagtttttaaaatttttttggtagagatgggggtctcactatgtggcccaggctggtctcgaactcctggcctcaagtaatcctcctgccttggcctcccaaggcactgggattacaggcatgagcccctttactttaaaaattacccagccccaggccgggcgcagtggctcacgcctgtaatcccagcactttgggaggccgaggcgggtggatcacaaggtcaagagatcaagaccaacctggccaacatggtgaaaccccgtctctattaaaagtataaaaattagctgagcgtgggggcgggcacctgtagtcccagctactcgggaggctgaggcaggagaatcgcttgaactcgggaggcagaggttgcagtgagcagagatcacgccatcgcactccagcctgggcgacagagcgagatgccgtctcaaacaaaacaaacaaaaaaaagttacccagcctcaggtatccctttacagcaacacactaaacccgtttaagacaaaggccaagcccagcacagagtcatctcacttggcgttcaaccaaacttctccaatgcagcaaaatggcaaactaaacaatgttactgcaaaatgtgactatagactaataggctctgctgctaaggacaagctctctggcatccagttaaacaaacagccaggaaaaactgaagtgatagttagcaaaacttaggagagaatgactaggcttaagccattttcccaagcacaaccaaaaaaatgattataacaaatagaacataatctgctaacctttcattcttgttatatccttgtgaggtggctcccattttcagataaggaaacaaaaggacagaagtgtaggcaacatatacacagtcatatgactgttatacagtagactgggatttatacccaagtctgaatccaaaccccattttctcatcttactgctacattatgctgccttccatcagctggtaggtgtatgtaataaaaagacatgaggacaaactgacatcatgtccctcctgaggggatacaattggaatttcacatagtatttttgccaaaaatgtttagctggatttgaataattaggaaacagacacaggcagattacaggacattctacaactggcctggactcttcagaaatatgaactgtatgtatttgatgctaaacttattatttttttttttttattttgagacggagtttcactcttgttgcccaggctggagtgcaatggccaatcttggctcactgcaacctccatcttccaggttcaagcgattctcctgcctcagcctcctgaatagctgggattacaggcatgagccactacgcccagctaatttctgtagttttaatagagacagggtgtctcagtgttggtcagcctggtctcgaacttctgacctcaggtgatccacccgcctcggcctcccaaagtgccagggttataggcgtgacccactgcgcctagcctgatgctaaacttcttgaaatagaacagaattgtgtttatgtaggaggcaaaagtcctttttctcagatttttgctgaagtattcaggggtgaagtgacgtgtgtagatatataacatataaacaaatgtgacaaactattaattgctttgaaatttattttcttttttttttttttttttgagacggagtctggctctgtcgcccaggctggagtgcagtggtgccatcttggctcactgcaagctccgcctcccgggttcatgccattctcctgcctcagcctcccgagtagctgggactaccggtgcccgccacctcgcctggctaattttttgtatttttagtagagatggggtttcaccgtgttagccaggatggtcttgatctcctgacttcgtgatccacccacctcggcttcccaaagtgctgggattacaggcgtgagccaccgcacccggcctgctttgaaacttaattaaaacaaactgtaggaaagaaaaaggctagagaccccatcctgttagggtagaagccctgtccatccaagtcaagctgtggaaggatcctcatatttaccatctacttcttttgtttgtttgagacagagtcttgatctgtcgccaggctggaatgcagtggcacgatctcggctctctgcaacctacgcctcccaggttcaaacagttctcctgcctcagcctcctgagtggctgggactacagacgtgcaccaccatgcccagctaatttttgtagagacggggtttcaccatgttgggaaggctggtcttgaactcctaacctcatgatccgtccgcttcagcctcccaaagtgctgggattagaggcgtgagccactgcacccaacccatctacttctttaggtagagctaggatccatcaagctaaaagatgtacctacttttttttttttttgagatggagtttcattcttgttacccaggctggagtgcaatggcatgatctcggctcaccgcaacctccgcctcccaggttcaagcgattcttctgccttagcctcctgctgggattacaggcgctcgccaccatgcccagtaaattttttgtatttttagtagagatagcgtttcactgtgttggccagctggtctcaaacttctgacctcaggtgatccactcacctcagcctccccaagtgctgggattacaggcgtgagccaccgcgcctggccaagatgtacctactttttccagcacaacaaagaagttgattcaatttgcctaatgggtgtgtgtgtgaagaaagtttgatgagacaaattcaccagtagattgaatttatctagtcacttttgccttctagtaacatgccttgtgatttttgtaagtttgcttcttgtgaaaattatttctattattttagagtaaaggtgggcaaactttctgtaaacaggcaaatagtactctctggtccaactactcactatgtcattttaatgcaaaagcagctatagataatgcacagtgtgaatgtacctaatgccactgtactgtaaactcaaaaatggtcaagatgaggccaggtgcagtggctcatgcctgtaatcccagcacttcgggaggcccaggtgggcggatcacgaggtcaggagattgagaccatcctggctaacacggtgaaaccccgtctctactaatataaaaaattagccgggcgtggtggctgatgcctgtggtcccagctactcgggaggctgaggcaggagaatggcgtgaacctgggaggcagaggttgcagtaaaccgagatggcgccactgcactccagcctgggcgacagagcgagactccatctcaaaaaaaaaaaaaaaaaaaaaaaaggtcaagatggtaaattttatgtatgatcttaccataatttactaaaaggcaaaaaaataagccacagataatatgtaaatgaatgagggcgtgtgactgtgttccaataaaaccttatttatggacaccatatttgaatttattattttttgagacagagtcttgctctgtcgcccaggctggagtgcagtggcatgatctcggctcactgcaacctccgcctcccaggttcatgccattctcctgcctcagcctccggagtagtggggaccacaggtgcccgccaccacgcccggctaattttttgtatttttagtagagacggggtttcaccatgttagccaggatggtcttgatctcctaccttgtgatccacccaccttggcctcccaaagtgctgggattacaggtgtgagccaccatgcccggcccatattctgaatttcatacagtttttatatattatgaaaaatttttttttttttgagtcagagtctcgctctgtcgcccagcctggagtacagcagcatgatctcggctcactgcaacctccacatcttgggttcaaacgattcttctgcctcagcttcccgtgtagctgggactataggtgcgtgccaccatgcccagctaatttttatatttttagtagagacatggtttcaccatattggccaggctggtctcgaactcctgaccttgtaatccacccgcctcagcctcccaaagtgctgggattacaggtgtgagccaccgcgcctggccgaaatatttttcattgatttttcaaccatttaaaaacataccaggccgggcacggtggctcacgcctataatcccagcactttgggaggccgaggcaggtggatcgtttgagtccaggagtttgagaccatcctggctaacacggtgaaaccccgtctctactaaaaatacaaaaaataagccaggcgtggtggcgggcacctgtagtcccagctactcgggaggctgaggcaggagaatggcatgaacctgggaggcagagcttgcagtgagccgagatcatgccactgtactctagcctgggcgacagagcaaaactctgtctcaaaagaaaaacaaaacacaaaaaacccataccagcctgggcaacgtggtctacaaaaaaatacaaaaattagctgggtgtggtagcatgcatctgtagtaccagctcctcagaggctgagataggaggattgcttgagcccaggaggcagaggttgcagtgagctgataccacaccactgtactccagcctgggtgacagagcaagaccctgtctcgaaaaaaaaaaaaaaaagtaaaaattcctagagcaccccaggtgcagtagctcatgcttgtaatcccagcactttggagggtgaggtgggcggatcacttcaggctaggagttcaagaccagtccagccaacatggtgaaaccccatctctgctaaagctacaataaattagccaggcgtggtggcacatgcctgtgatcccagctactcaggaggctaaggaaggagaatcgcttgaacctgggaggcagaggttgcagtgagccgagattgtgccactggactccagcctgggcaacagagcaagactccgtcttagaaaaacaaacaaacaaacaaaaaacttaccagagtacccgtttccttctaagggtatacatgagtgaatcagataaaataaaatgttgaaatctcaaccttacctaagatacaaaggaggccagctgtggtggctcacgcctgtaatcctagcactctgggaagccaagacaggcagagagcttgaactcaggaatttgacaccagcctgggcaacatgagaccaaaaccacaaaaattagccatgtgtggaggtgcacgcctgtggtcccagctactctggaggctgagacggaaggattgttggagcccgggaagtcgaggctacagtgagccatgatcacatcactgcactccagcctgtgtcagagcaagacagtctcaaaacaaaacaaaaacacattaaaaaaaaaaaaaaaagcaaaggcaacaagaatcactttccatctactagttctatccagctacaaataaatcttctgcttgtaaaagaaaagccaatgcctcaaccctcaccatctttcaaatcactctcattgcctaagatcactccttcgcctcctgcagtttggcctcaaccgcccacaaaaacatggccaagaaattaaaatttcttgagcatctggctgggcgcggtggctcacgcctgtaatcccaacactttgggaggctgaggcaggcagatcacctgagaggtcaggagttcgagaccagcctggccaacatggtgaaaccccatctctactaaaattacaaaaattagcagggcatggtggtgcatgcctgtaatcccagctacttgggagactgaggcacaagaattgcttgaacccgggagggggaggttgtagtgagccgaaattgggccattgcactccaacctgggcaacagagtgagactctgtcttaaaaaaaaaaaaaattttgctgagcatctgtatatgcttacttgcttcacttagtgtcatttaatcctgacaaaaatggctcttaaaagtcctccattcagcatttcacaggtatacacatgtaaaagctcaagctacatactttaagatttgcacacttggctgcatgtaagttataccttactaaagttgctctcttctttccctctaaatgtacctgcttccagtttcggccttcaacgtagttcacatctgcctccaaacagcctccttggaagtcttactttttgctgtttcaaaccttaaattcttttctctagtctcagtctcttttcagagctcttgtcgtaactagcccacggatgcctgaaatttaacagatccagaatcaaatgtagcaatttctccactctgcaccaaggtcctccttttgctgactcctgtatgaatggcatcaccactcaaatctcaaaaatggccttcccagagttctcatttcccctcatcgaattacttattaactacacctcaataatgtgattctcaaaattcatccctttccattcctatggctactaccctaattcaaaatccccattaagttataaccacactgtgcctaacttttatccctacctccagtgtctccaggttccaatattcactgtctctcctgttcactgctttaccttcagtgcctggcatgtttgttagacagtaggtgttcgacaaatttttgtagcatgaagaccatcacagcatttatctcaccctcatagataactgtgaccctatgttccttcctctgctcctcccatgacatgaggaacgagaccatttttatggcagtgaggaggaaagcgctggcccacagtgggatcaaacctaagaaccatggcctaccaactatacattaaaaatatgtgccattttagtttcacatttctacttcctaaaaactgggcagggggttttctggtagcggatcagcctttataaaaggtctcactagtattagaacttcaccaaaactgattttaataacaatcccttacatggctctaggagagaagacatctaaatttcaagctaatattaattcaatttccctaatactgcagtctggactggctatactagaagtcacccagatctagaacctctttatccagcagctggttctagtattatggcgcttctaagacaagcaggatttgttttactcagctgtttaatcagaatgcctccaaatttacaaagcaaatgttttaatgtccaaggctaatacaccactgcaagggaagaacaggtaggaaaggaaaggggcactaagagaggaacacaccgtaagagggcttggctactgcatagcacatcctcaagactatctcagtgaccacttttaaacatcattaaaacctgttttggaaaggtacacaatttgatctatccccacagacaaccagtcccctaagcctagggtgtcaacaagaaaattctatataaatgacttctagccttcagctaatttacaagctagggcacccaaacatattaatgaagctgattttcatgtcagatggtttccagagaattaacacagttctctcagcatgtaagagggcagcaaaaccatgaaaccaatacagcacttaattttctgcttattaatgcaaacacatgaaacaaatacctaatttcagttcaaactcatttcccttttattaaagtccaagttaccattacatggcttggtactcaataaaggaaaacttgttcaaataaggtaatatgttatcatcagtatttccaggtaactgttcacactcaagtagcaatgtcaataaatccttggggaagcccatctgtaagagaaaacacaaagaattagccaggaaagaataaagaaaaagtagaaatcttttaaaaataacccttagtgctacaaccagggaaatcactgtctctctgtaccctttactgctcttacttaatcctgcctactgtcaacccacaagcgactagctttgtggcttttttgttgtttatacactggtacttccttcccaatcagaaaagtgtccagtagctgccatttaacaaaagaaattttttttgggccggacacggtgactcatgcctgtaacgctagccctttggaaagccgaggcgaatggattgcctgagcatagaagttcaagaccaccctgggcaacacggtgaaaccccgtctccactaaaatacaaaaaattagcctggtgtggtggcccatgcctgcagtcccagctactcgggaggctaaggcacgagaatctcttcaaccgggaggcggaggttggagtgggccgagatcgcttcattgcacttcagcatggatgacagagcaagactctgtctcccaacaaaaaaaagaaaaaaagaaaaaaagttagtatagctagaatatatcctacataaaaaagatcttctggaccccttggaataatacttgataaaatgaaaactaaaaccatcttttaggagttcattatagaatatgaaccacagggctgggcgcggtggctcacgcctgtaatcccagcactttgggaggccgaggcaggcagatcgcgaagtcaggagatttgagaccatcctggctaacacggtgaaaccccgtctctactaaaaatacaaaaaattagccgggcatggtggcgggtgcctgtagtcccagctactcgggaggctgaggcagaagaatggcgtgaacctggaaaacggagcttgcagtgagccgagatcatgccactgcactccagcctgggtgacagagccagactccgtctcaaaaaaaaaaaaaaaaaaagaaaaagaatatcaatcacagggccagacgcggtggctcacacctgtaagcccagcactttgggaggctgaggcgggtggatcacctgaggtcaggagttcaagaccagcctggccaacatggcgaaacccggtctctactaaaaatacaaaaatgaaccgggcatggtggtgggcacttgtaatcccagctactagggaggctgaggcatgagaattgtttgaacccaacaggcagaggttacagtgagcagaggtcgtgccactgtactccagcctgggcgacagagtgagactccgtctcaaaacaacaacaaaaaacaaacaagagcttcaaaagtataactaggaaaatttccattctgaacaactagttttctttaagtactcacagaagtcaaaaccattgcatatattataaagatgagctacttcagggaggttgtgctggtgagggggtggacaaagataaaatgaaaagaccattgcttttggctcacacctgaaacccaaataatttggaaggccaaggtggaaggatcacttgagcccaggagttcaagaacagcctgggcaacatagtgagactctgtctctataacaaaattaaaaataaataaattaaacaaaaacaaacaaaaagaccactccgttaaagcaagctttaaaacgagatcccacctgggcgtggtggctcatgcctgtaatcccagcactttgggaggctgaggcgggtggatcacctgaaatcaggagttcaagaccagcctggccaacatggtgaaaccgtctctactaaaaatacaaaaattagccgggcatggtggtgcatgcctgtaatctcagctacttaggaggctgaggtacaagaatcggcttgaacccgggaggcggaagttcagtgagccgagatcatgccattgcactccagcctaggtgacagagtgagactccgtctcaaaaaaaaaaaaaaaaatcttaaaagtagattacaaagttttcagcattttctgttcagtttctcaacaggaagactgaatataaaaattccttgaattctgaatatttttctttctatgtatgtatgtatttaattaactaaaggagacagggtctcactatgttgctcaagccagtctcaaactcctgatactcctgaactcaagcaatccttccaccttagcctcccaaagtgctgagcttacaggcatgagccattgctgccagccaagttgagtctttttttttttttttttttgagacagagtctcactctgtcacccaggctggagtacagtgacacagtctcggctcactgcaacctctgcctcctgggttcaagtgattctcccgcctcagcctcccgagtagctgggactacaggcacatgccaccacacccagctaatttttgtatttttagtagagacaaggtttcaccatgctggtctcgaactcctgaccttgtgatccacccgcctcggcctcccaaagtcctgggattacaggcgtgagccactgtgcccagcccaaatagaaatactttaaacacaccaaagcaaatgtggcaacaataaaagtatctgaaaatctggatatgtgtacacagactcactatattatcatctatgctactgtttatgcctagaatattgtatgaagatttttctttaattaaggtggcttttatttgtctttctaccagtaagaaaataatgatgccgggcgcggtggctcaagcctgtaatcccagcactttgggaggccaaggcaggtggatcatgaggtcaggggtttgagaccagcctggccgacaggatgaaatcccgtctttactaaaaatacaaaaattagccagttgtggtggcatgtggcctgtagtcccagctacttgggaggctgaggcttgaatccaggatgcggaggctgcagcgagcctagattgcaccactgcactccagcctgggcaacagaataagactccatctcaaaaaaaaaaagacgaaagaaagaaaagaaggaaagaaagaaaataatgacaacaactagaaatcatttcagttctttaaatttaccattactggtattctcaaaatctcttcatgctcacggccattacctctaacaagaacactgaaaggtcttactatagcacactgaaatgtcatccacccacacctctctggattgttttcctgccttcttcagtggtttgtcgcttacccatgcggtttacactttgtcaaggcccagttcctccggagtggagattcccagttcatttaaagttggtctaagttcctggatgacataggggtagatttccttatgaggtcctgctttgtcctgatggcaaagagaatattcacatttaactctctcaaaagccatgtctattaattcatgaaatgaacttaaaaatgcctttaattacttatgcagaggcaggtaggacagaataatacaggtgatcagctgggcatggtggctcacacctgtaatcccagcactttgggaggctgaggcgggcggatcacttgaggtcaggagttcgagaccagcctggacaacatggtgaaatcccgtctctactaaaaatacaaaaatcagccaggtgtagtggcacatgcctgtaatctcagctactcgggaggctgaggcaggagaatcggcttgaacccgggaagcggaggttgcagtgagccaagatcacgccactgcactccagcctgggtgacagaacaagattctatctcaaaaaacgaaacaaaacaaaacaaaacaggtcatctacttttaagttaacacatttgttcggtaagtagggcaacttgctgggtgccgtggctcatgcctgtaattccagcactttgggaggccaaggcgggtggatcacaaggtcaggagttcgagaccatcctgaccaacatggtgaaaccccgtctctactaaaaatacaaaaatttgctgggtgtggtggcacgcccctgtaatcccagctactcgggaatgcttgaactagggaggcggaggttgcagtgagctgagatcatgacactacactccagcctaggggacagagcgagactctgtctcaaaaaaataataataattaaataaaaataaagagggcaacttatatatgtactgttcaaggtaggcttttgaaataccttgagaataactgcaattggactaaatccagaacatcttaaagtctagaattactggaaaagaaggtagtgatgacagaattttgtgaaggcaattagacatgcccagcaggcaacacgaataattaagttaacgggaaaagttttttcatttgcctccaatttgagaccttaactgaattaactaccagtgctgaatggattgatagcctacagaacccttaattatcttacccattatagataaagtaatgtcacacttttgctgttaacggaccttaagtttctttcttacagaccacagtatcttttcatggagagctgtactttgagaatacatatgtccagggctggagacttttcactgtaatatatagttacacctgtgctgtcacaaggttccttaggaacgaataagaagtcaaaagaactaagaaagtgccggccgggcgtggtggctcacgcctgtaatcccagcactttgggaggctgaggcgggcggatcaactgaggtcaggagtttgagatcagcctgaccaacatggagaaaccccgtctcttaaaatacaaaattagcctgtaatcccagctactcgggaggctgaggcagaagaattgcttgaacccaggagacctcggaggttgcagtgagctgagatcacgcaatgattgcactccagcttgggcgacagagtgagactctgtctcgaaaaaataaataaactcagaaattatgaccaaataagaaggaggaaaattagtatatatcctcctatgttttcatataatgtatatatatattttttgagatggagtttctctctcttgttgcccaggctggagtgcaatggtgccatcttggctcactgtaacctctgcctcccgggttcaagcaattcccctgcctcagcctcccgactagctgggattacaggcatgcacccccacgcccggctaattttttattttcagtagagatggggtttctccatcttggtcaggctggtctcgaactcttgacctcaggtgatccacctgcctcagtctcccaaagtgctgggattacaggcgtgagccaccgtgcccagccgacacaaatatgtttaaagtcaaacacatttctacagtatcaacagttgtgtagtataaccagttctgggaagctccctcttaagaattcctaacatttcgtatgacaaatagcaagaagatgaatacactttgtagttaaatctttatatatcctttattatttccttgataaattcctttctttttttttttagagacggagtttctctcttgttgcccaggctggagtgcaatggtgcgatctcagctcactgctacctccgcctcccgggttcaagcaattctcctgcctgggcctcccaagtagctgggattacaggcatgtgccaccatgcccagctaatttttttttttttttttttttttttgagacagagtcttgctctgtcacccaggctggagtgcagtggcgctgtcttggctcactgcaagctttgcctcccgggttcacgccattctcccgcctcagcctcctgagtagctgggactacaggcgcctgccaccacacccggctaatttttttgtatttttagtagagacagggtttcaccgtgttagccaggatggtttcgatctcctgacctcgtgatccgcccgcctcggcctcccaaagagctgggattacaggcgtgagccaccgcgcctggcctaatttttatatttttagtagagacagggtttcaccatgttggccaggctggtctcaaactcctgacattgcatgatccacccgccttagcctcctaaagtgctgggattacaggcatgagccatcacacacggccaagataaattcttaaaaaagaaagaaaaaaaaaaaagagagaaaaaagaaaaaagataaattcttaaatggaattgctgaacaaaagtgtatcatgtacaatttgtaaggccttgaataaatgctgccaaagtagcctctagaaagattttaactgcaatgtacattccttctagttatataaggactcattttaggcattttaacaaattcaaaaatacagaatattctgatacctcagcaatagcccactcatttacagaacaattttagcattattatttcactgaccttaacaacctctaggatacgaactgtactagcaaaatcatttaaccgtctgcatgcccgcaaagcagcatcaatgattttgggctctggaaccatatcataggtaacaagtgtgtttatccctgcaaaattaaaaagaagggccatgtcaacctcgaagagcctcacttaaactatgagttatttatatttttactgaatcactgatgtatgatcttatctgtctgggtctccattctcttacctataaaatgagagaaacctacctttaacaaattctagataataagatcacagtggatctcccttagtgaatcagtggaaagaaagaactatgcaacagcacgcagattgaaggaaaaaatcctgagttttttttttcccctttgagaacaagagggtcattttcaactcctaactttttttttggagatggagtcttgctctgtcacccaggctggagtacagtggtgccacctcagcttactgcaaccgctgccacctgggttcaagtgattctcctgcctcagcctaccaagtagctgggattacaggcgggtgccaccaagcccagctaattttagtatttttagtagagacggggtttcagcatcttggcctggctggccttgaactcctgacctcgtgatccacctgcctcggcctcccaaagtgctgggattacaggcatgagccaccacatccggccctcctatctttaactcttagtacaatgaacacattttggatgctttaaaagagattcaaggctgggctcaggtggatcacctgaggtcaggggttcaagaccagcctggtcaacatggagaaaccctgtctctattaaagatacaaaattggccgggcgtggtggcacatgcctgtaattccagctactctcgaggctgaggcaggagaatcacttgaacccaggtggtggaggttgcagtgagctgagatcgcgccattgcactctagcctgggcaataagagagaaactccatctcaaacaaaacaaaacaaacaaacaaaaaaaccaaaataaaagagattcaactggaaaacagcctaaaaacagccagagaaatgcgtagagttaatgaagcctaaatgaggacattaaggagatattatagagaaacattagtacacagactcataaacattcaaccagaaaatgattgggcatgattactttcagatctgcacaaaatgacacataataaaatttaagattctcttaatgggaatacataattgttctttttattacttctactccagattgttcagtaagaattctattggttgtagcaaaagggaatcattacatttctgcagagaagtttaaagcacttaggtttcttgcttttattactttaaaatatttaaacaaaggataccagtgaatacgatagtcattgagattgaatttttggtatgagataaattaccctacacctaattctattttttcatgttaagtgtgcatctgcaaatttaggaaagacaagttctaacttacttagatacttattcatggcaaaacaatgcaaaaataacaaaaaacccaaaccatcacccaaaggggaagggaaccaaatgactgctttgtgtaaattcttttttttttttctgagacagagtctcactctgttgcccaggctggagtgcagtggcgcgatctcggctcactgcaagctctgcctcccgggttcacgccattctcctgcctcagcctcccgagtagctgtgactacaggcgcccgccaccacgtccggctaatttttttgtatttttagtagagacggggtttcaccatgttagccagaatggtcttgatctcctgacctcgtgatccgcccaccctggcctcctaaagtgctgggattacaggcgtgagccaccgcgcccgtgctatgtaaattgtttgaaatgtacaaaactgttaccttttgctcatctagccttattgctatagcagtggttttcaattaagggtgacttcatccctcaggagacactgggtaatgcctagaaacatttttggttgtcatgatacgaatgtgtgcatactggctcctagcaggtagaggccaaaggtgatgctaaacaccctacagtgtaaaggacagtcccctacaacaaagaattatctggcccaaaatgtcaatagtgcctgccttaaaatcctgctttataggtagccataaactttcctaactgcaagttgcatgaagtaaccagtttaaacaacgcatgttttcgaaacagttgctctcaataaaggagcagaagcagttcatatttacacaccaaaatagacaaatatgtttatgttccaattacctttacgcaattcccaggcatctatatctggcttgttgaagtatgttacccagcgagcatcaaactcctcatctgtctcctgtgacccatgggaatagcagcgaactgactggatagctataatgtgaaagaaccataacttcaatgtacacaaatagtacttgatatattttgttcaatgcattaaattttgagttgactatatatgttgtggcagcaaaaatattgaacaggtcaaatgaaatacatcgtatacattgatacagaaagatatattttaaattaagcaaataaaatcaagtagaacaaaaagtattacataggcatgtttatacttttctccctaatgtataatactcgcttgaaattattaacagtggttccctctgattttaaattaacagtgattatcatgggacgtaaaaactactttatatacttccatattgtttgaatttttacacataaccagagtattaattcctaagtaaaaatgtcccaggtgggcatagtggggcacacacctgtagtgccagctactcagaggctgaggcaggaagattacccgagcccaggagttcaaggtcgtagggtgctaacaatatgacagaacctgataagatagccattgcattccagcctgggcaacacagcgacaccccacttctaaaaactaagaataggccaggcgcagtggctcacgcctgtaatcccagcactttgggaggccgaggcaggcggatcacgaggtcaggagatcaagaccatcctggctaacacggtgaaaccccgtctctactaaaaatacaaaaaattagccaggtgtggtggcgggcggctgtagtcccagctactcgggaggctgaggcaggagaatggcgtgaacctggacggcggaggttgcagtgagctgagatcacaccactgcactccagcctgggcgacagagcaagactccaactcaaaaaacaaacaaacaaacaaaaacaaaaacaaaaacaaaaactaaaaaactaagactaggccgggcgcagtggctcacgcctgtaatcccagcactttgggaggctgaggcgggtggatcaagaggtcaagagatcaaggccatcctggccaacatggtgaaaccccatctctactaaaagtataaaaattagctgggtgtggtggcgcgtgcctgtagtcccagcaactcgggaggatgaagcaggggaattgcttgaacccaggaggcggaggttgcagtgagccaagattgtgccactgcactccagcctggcgacagagcgagactccgcctcaaaaaaaaaaaaaaagacaataaacaacaacaacaaaaaaaaccaaaaaagcaacaaaaaaaaaaaactaagagcaatactaatgtccattcaagttcttttttttgagacaggctctcgctctgttgttgcctaggctggagtgtagtggcgcaatcacagctcactgcagcctcaaattctttgggctcaagcattccttcctcccttggctcccaaagtgctgggattacaggtgtgagccaccagccctggcaccattcaagttcttaaataaacttatatacttcattcacacattaaaaaaaaaaaaatctcgggccgggcttggtggctcacgcctgtaatcccagcactttgggaggccgagatgggcagatcaccaggtcaggatatcgaaaccatcctggctaacacggtgaaaccccgtctctactaaaaatacaaaaaattagccaggtgtggtggcgggcgcctgtggtcccacctagttgggaggctgaggcaggagaatggcgtgaacccaggaggcggagcttgcagtgagcagagatcacgccactgcactccagcctgggcaacagagcgagactctgtctcaaaaaaaaaaaaaaaaaaaaaaaaaaaaaattctcatgttattatattccaaaataaattacacatcctgacaaattacacatacaaattgctttatcaaactacagccccttcccaaaatattctgataaatcccctaagggaacgtacactctaatctacacctaatgcaaaataatactgttttactaggaatattttgggctgggcgcagtggctcacacctgtaatgccagcactttgggaggctgagactggtggatcacctgagttcaggagtttgtgaccagcctgatcaacattgtgaaactccgtctctactaaaaatacaaaaattagctgggcgtgatgacgggcgcctgtaatctcagctacgcgagagactgaggcaggagaatcactcgaacccaggaggcggaggttgaggtgaggtgagatgatgccattgtactccagcctgggcgacacagcaagactctgtctcaaagaaaaaaagaaatgatgtttacatagagtactgtatgaaaagcatttccattttttttttttttttttgagatcgagtctcactctgtcacccaggctgaaatgcagtggaacaatctcagctcactgcaacctctgcctcctggattcaagtgattctcctgcctcagccttctgagtagctgagactacaggcgagcgccactaagcttggctaagttttgtattttgagtagagacgggatttcaccacattgcccaggctggtctcgaactcctgacctccagtgatctgcccacctcagcctcccaaagtgctgggattacagacgcgagccactgcacccagccccattttttctttcttcttgtcaaatggacactgaattgagtttggaaatctgaattccttctgaacagcctctggaacaggtagggggataggcggaggcagaaaattttatctttgggtattgaatgcagcacaacctagcactcagatacctctaggctcttcgctctctctgtttgaccctggaaaattaacttaagtttattttccttatctgtaaaatggggacgctaccccccttagcagattatgaagattaaatgtgaaaacaggtaggttaacactatgcactggtaagtattaaacaaatggtagctataaactaacccttatctaaaaacgtcttagttgtctatttatagaaatcataacttaaagaaatgaaacctatctcaaatcacatttcctactacctgtattagataagtgtggtgtaacttccagttgtttaaggcttaacatatttttatttatttacttttagagatgggggtcttgatatgttgcccagggtggtcttaaactcctagcctcaagcaatcctaccactcccaaaatactagaattacaggtgtgagccaccatgcccagccttaacatacatatatatatatttttaaaaacttcacccagaaacctctcaacattgttgttctaagaacactgaaatttaaacattagtaatatcctatatatctttaatgcagtaactggcaggaggaagagtagcaaaaaaacgaagcagaaaagatcttcccagagacctaaattacctacataatccaagcccagaatgaagtggaacatgtacataaatggactagaagtgaacacgttttaatttctttttttttttttttgagacagagtctcaccctgtcgcccaggctggagtgcaatggcacgatttcggctcactgcaacctccacctcccgggttcaagtgattctcctgccttagcctcccaagtagctgggattacaggcatgcgccaccatgtcaggctaattttttgtatctttagtagacacaaagtttcaccatgttagtcaggctggtctcgaactcttgacctcatgatctgcctgcctcggcctcccaaagtgctgggataacaggcatgagccacggtgcccagccttaatttctacaacaagaaaaaaatggatctctacacctaaatatgtctggtaagtatgaacatttaatcaaaactacgtggatatttaataagtcttacaagactaatattcaaatttaatatatcagaaaacaaggccaggtgcggtggctcacacctgtaatcccagcactttgggaggctgaggcaggcagatcacttgaggccaggagttcaagaccagcctggccaacatggtgaaaccctgtctctactaaaatacaaaaaattagccaggcgtggtggcacacccctgtagtcccagctacttggaatgctgaaggaggagaatagcttgaacccagggaggttgcagtgagccaagatcgtgccactgcattccagcctgggcgacagagcaagactccgtctcaaaaaaaaaaatatctatctatctatctatctatctatctatctatctatctatctatgtaaaaacatagattagaacaaccatctaatgcactattatcaagaacttagggccagatgcagtggcactagcctcggagacagagtgagaccctgtctcaaaaaagaaaaaattataagccacctcttcaaaaactaaagctagccttaactgaatactgaaagtgcaagtataaaatgatacaatcactttggaagacggtttaagcagtttcttatcaagttaaacacaaacctaccatataacacagtaattccactcctaagtatttacccaatgaaaggtctatgtactccttccccagaggtaattacctgtcccatccacaacagtgcttcatgataagcaattcgttttgttcactgctgggcatggatttgactacatgagtgctaggctttgtttcctaactgtgaataagatgaccaccaacagcaaatccaagtcaaggagatcaccaccttcaaggatttgatcatatgtcttctggaagccaaattacaaactggttgtattccaaaaagtcttttataaaacagaactagaactttgagaggccaaggcaggatcgcttgatgccaggactgagagaccagcttgggcaacaaagacagacctccattctccacaaaaaacttaaaaaattagcggggtttggtggtcccagctactcaggaggctgaggcgggaggatcccttgagcccagggcaacaaggctgcagtgagctatgactgcgccactgcactctagcctaggtgatagagcaacactctatatcaaacaaattaaaataaataaaaatttaaaaacccatacatccctttctgaagggctaaaacagactctccccacgtgatttaaattttttttttttttttgagatggagtctcactctgtcgcccaggcgggagtgcagtggcgcaatctcagctcactgcaagctccgcctcccaggttcacgccattctcctatctcagccttcccagcagctgggactacaggcactcgccaccacgcccggctaatttttttgtatttttagtagagacggggtttcaccgcgttagccaggatggtctcgatctcctgacattgtgatccgcccgcctcagcctaccaaagtgctgggattacaggcgtgagccaccatgcccggccatgatttaaattatattgttaaatccaataatgggtaaagcaggatctattctattagctatggacacatcccccacatgcttaactttttttaggtaaactctactagcattctctgccccacacaccccaccccacttaagaacaggatctccacctagtattgaagcttgaaaggcaaattattttggaaaacaattactcagagcttttacgtaacctgaaagtcccaaagtaagaaaaaagaagcagctgtgaaaaatgaggacatttttagggcttcatcctaaaaagctatttctaacactgctttttggcattcagttaagcactccatttaaaaacaaaaaaggctaacatatatagaaaaataaaagggctcattgatcctttgggtttaaatttagttaaatcggatagttttccatttaataaataatcaaccctgacaggcccaaagaatgaacactttggtggtggtaactgtaggaatgagggcacattaacgagttactgaggctgggtgcagtggctctcgcttgtaatcccagcactttgggaggctgaggtggaaggatggcttgagcccaggaggttaaggctgcagtgagctgtgccaactgcactgcagcctgcatgacagagcgagaccctgtctcaaaaacaaaaacaaaaacaaaacaaaaccacaacaacagaagaagaaaaagaaaaatttggctgggcatggtggctcacacctgtaatcccagcactttggaaggtgggaggagggaggcactcctgagcccaggagtccccagaccagcctgtttctacggaaaataaaactggtggcgcacccttgtggtcccagctacttggaaggtggaggcaggaggatcagttgagtcccaggaggtcaaggctgcagtgagctgtgatggtgccactgcactccagcctaggcaacacagtgagactatcaccaaaaaaaaaaaataaataaataaataaataaaaaattttttttttgagatggcatgatttcggctcactgcaaacctctgcctcccgggttcaagcaattctaatgcctcagcctcccaagaagctgggaccacgtgtgcgtgccaccacacccggctaatttttgtatttttagtagatactgggtttcgccatgttcaggctggtctggaacttctgatctcaggtaatctacccgccacaacctcccaaagtgctgggattacaggcgtgagccaccgtgtccggctgaaaaatgtaaattgtactgttactttagcaaaacacaaaatctaaacaaacatcaggatggcccaaacataactataagaaacaaaaatggttccaccattaaaaaggagtcagtttcggccaggtgtggtgtctcacgcctgtaatcccagcactttgggaggctgaggcagacggatcacctgacctcacgagctcgaaaccagcatggccaacatggtgaaaccccatctctactaaaaacacaaaaagtagccgggcatggtggcaggtgcctgtaaccccagctactccggaggctgaggcaggagaatcgcttgagccaagaccgtgctattgcactccagcctgggcaacaagaacgaaactctgtctcaagaaaaaacaaaacaaaacaaaacaaaacaaaaacaaacaaacaaacaaaaaaaaacaaggagtcagtttcccaagatggactttggtttccttttctataaaataaaatggcttccacgatctctaaagtacactctaggttggctgcagtggctcatgcctataatcccaaactttgggaggctgaggtgggaggatcacctgagcccaggagttcaagcccagcctgggcaacatagggacactccgtctctaatttaaaaataaataaataaacaaaaataaagtaccctccagccttatggttctacgacaaatgataaaagtctaaaatgaatgaagcaaaacatattcttttttttttttttttttttttgagacggagtctcgctctgtcggccaggctggagtgcaatggcgcgatttcggctcactgcaacctccgcctctcaggttcaagcgattcttgtgcttcagcctcccgagtagctgggattacaggcgcccaccaccacacccagctaaattttttgtatttttagtacagacagggtttcaccatgttggccaggctggtcttgaactcctgacctcaggtgatccgcccgcctcggcctaccaaagtgctgggattacaggcatgagccaccgcgcccggctgagttctttttttaatttttaacttcagcataccctgaaacgagtttctgagttcttatgtttaaatacgcatgcatagttgccagtgatgcaggttcaaaaataaaatataatatgcatgcatagaagctaaatttcacggaccaagatcgaagtgcaattactgtaattattctatggtggtggactcaaaacctcccagcacacatataaagggaaggaaaatagacaaaaatcagaagcacgtctcatactccagcaatcaggcttctattacaaaggggaaaaaacacgaagcgttcctatgcttgtaaaacccagtattcctgtgtctgtgacattcagttttcaaaagagtgatatttttatcataagccctatcaaaactctggctatcttccggagatcaggaaacaaccacacacttccatctattttaaacgtggaagaattagaacgtggcacagcagaccctaaaaatgatggaaaaggctgtgaaggtgacacactaatcgctaaccgagaaatgcctgattgaaaagtataatcgtgtgtcccatacggaagtatattgtgtcctcggaccccaagcggcgtgcccggaggctcaatgtcaccttcgccgaggcgctgcaggccggcggcggccactctcggtcaggtggccgcagggtcggcgctggggcagggtcatggcccgggaaccgaaggggagcgctgcgtcccctcctcggcgcccacagcaggtccacatctgacctgtccgcggtggcacagccaggaagttgcgcggggggaggccccgggggcgcgctttcaggtcctccactactcgaggcggcgggcagggcggcccgcggtcaccgggttcagtaaccagggtagggcaagggctaggccggggagagcccgccccggagtggcagcggggacccaggtcaccgcaaggacacgagggcgcgggcagtggcaagcaggggccttacccacggcggggccgggggtccgggcggagtgcaggaggcctcgagggtcggcccgggtggttgcggccacagcgcagcggcggagagcggcgcccagcatgacggcgatggcggcgcgcgggctgaggacagagagaagccggtgtaagctcgcgggttgctccggagcgggcgggggccggacaggctcacagcgggcggagcacgtaggcccgcccactgcgactctggcgcgtgggcgggaggagccaccgcgcggccggcggcggcgggggctacggcggcgcgctgaggacaaactgttagcctcgcgtcccgccttgtctctggtcaggtgacgtgcagctgccatcctgtaagtaggaatggaggcgagggaggagcaaccgaccgtgatcttgttcgagtcaggcccaggagggcacttaatcacctcaaaataggaatgacagcaataacaacaaactataataaaaaatacgtactttgcgcccgggcgctgtggctcatgcctgtaatcccagcacttttgggaggccgaggcgggcggatcacctgcggtcgggagttcaagaccagcctgggcaacatggaggaacccccgtctctactaaaaatacaaaattagccaggcgtggtggcgcaacgcatgcccgcaatcccagctactcgggaggctgaggcaggagaatcgcttgaacccaggaggaggaggttgcggtgagccgagatggtgccattgcactccagcctgggcaacaagagcgaaactccgtctcaaaaaaaccaaacaaaacaaaaacctactttgcttagccccgccttctcattgtggcataaaataaaacagcgaatgggggaaagaatgccgctggacgcggttgctcacgcctgtaatcctagcactttgggagcccaaggcgggcggatcacctgaggtcgggagttcgagaccagcctgaccaacatggagaaacccctgtctctactaaaaatgcaaaattagccaggtgtggtggcgcatgcctgtaatcccagctatttgggaggctgaggcaggagaattgctggaacccaggaggcagaggttgcagtgagttgagatcgcaccattgcactccagcctgggcaacaagatcaaaactccatctcaaaaaaaaaaaaggcctatgcgtaagggattttattagtacatattcttatatcacaaaccagcttgcataaaaaatgagttaaactacttcatttcacagattaggaaagaggctcagaaattaggttgctgctggcagtcaaggatcttttcgccacatccccagttctgaggactctcacctgaatgtttcccatctcctacaggagggctcctgaatccacgatggctctgaaatagggttgatcaagttccacagttgttgcatcttatctcactagctacatcctaactttgagcccctgggcagtcaaggacacctctcccaggcctgaagtatctggatgctgcccagagttaatgagacattgtattctgtcttgctgtctcccattctctatccctgggcacactgaggaaagaaaaggtggccattcatgtgccacttcctcacttcaggccgactctccagggcctcagcatctgcccttctctttttcctccctagcagtgtggcttcagtgggtaggaacctggcggggaaaaggatttttaaaatgttttcaaagcacctgccctcaccgtttcccaccaacctagtgctggggcttagaaaacaataccacaaagtgaaggcctatgaagcagtttctctctgaccttctgccctcttgtctcttgccccttactctccctccaggcatgccacagaaactagaatccctcctccccaagagggggtctagaaagtagaacccctttgtcccaaagccagccataaagcctaaaaatattgctctaacctttctctttgcctttctatgtaacagctggccataaagaaattaaggccgagcacggtggttcacgcctgtaatcctagcactttgagccgccaaggccaggagatcacttgaggtcaggagtttgagaccagcctggccaacatggtgaaaccccatctctattaaaattactaacattagccagaaatcacttgaacccaggaggtggaggttgcggtgaggcgagatcacaccactgcactccagcctgggtgacagagctagactccgtctcaaaaataaaattttttaaaaaaaaggagaaaaggaaacatggccaggtatggtggctcatgcctgtaatcccagcactttgggaggctgaggtgggaagatcacctgaggtcgggagttcgagaccatcctggccaacatggtgaaaccccgtctctacgaaaaatacaaaaattagctgggtgtggtggcgcacgctactctggagcctgaggcaggagaatcacttgggcccgcgaggtggaggttgcagtgagccgagatcgcacaactgtactccagcctgggtgacagagtgcgactccgtctcaaaaaaagaaaaaaagaagttaaggctgggcgcgatggctcatgcctataatcccagcaatttgggaggctgaggtggggggatcacctgaggtctggagtttgagaccagcttgaccaacgtgaagaaaccccgtctctactgaaaatacaaaattagccgggcatggtggtgcatgcctgcaatcccagctactcaggaagctgaaacagtagaattgcttgaacctgggaggtggaggttgcagtggaccgagatcttgccactgcactccaacttgggcaacaagagtgaaactctatctccaaaaaaaagaaagaaaagacactcgttccagtagtagggaggacagggaggaagaaatgctacaaaagagaggccagaaggatttgaacagacaggctttgctgggttttcccactcaatccatttccgttagcttggaccctttttgtccaatcacaattctacatatgctttattgaacctaagcataaaggacgattttccttgtatctatgggtcttcagtctgaagcctcccatgtcacataaaactatgatcaagtaaacttgttatggttttttctttttaacctgtcttttgttatgggagtgtcagccatgacccttatgatggtgaggaaaaggatcacccctttctgcccctacactggccaaagggcaacggggaaacctttgacctctctgcagttcaattagtgttcatcaaatctccaaggctggaagcttaagatgaggtcagggtaagaaagtaagaaaagtaagaaaagcaagtaagaaagcactgggctatattgcttgaatcccagctggtctccctgctgtcagaatccctccactttgcctacagtcacttagattggctgctgaagtgtttttttttctttttaaaatacaattatgactataatttacaatgtgccactacatgccacaaactattatcccatttatgcctcataacaaccttgtgagataagtttttatccctattttcaaaatttattttattttattattattcttttttgaggtggagtctcgctccgtcgctcaggctggagtgcagtggtgtgatcctggcttactgcaacctccgcctgccaggttcaagtgattctcctgcgtcagcctcccgagtagctgggactacaggtgctcgccaccatgcccgtctaatttttgtatttttggtagagacgctgtttcaccatgttggccaggctggtcttgaactcctgacctcaggtgatcctctcaccttggcctcccaaaatgttgggattacaggcatgaaccactatgcccggcctagccctgatttattgataaaggaatagacttaaaggatacttgccaaaaatcatacagctaacaaatagtggtagttaggttttagtccccacttgtctgactccagaaattgttctttccctaccactgctgaaggtaggttttgcttgtctttcagtcagttctgaattctctgctaccttgagagcagtccacagccctaattgcctgcattcattttttgttgctgcctaacaatttatcaggtatagcataactgaattctctactggttatcacaagactgaaatcaagatcacggctaggttagacatctcatctggagctcagaggcctcttctaaggtcattcaggttgttggcagaattgatttcattgcagtggtgggacaaggtcctcatttcttctcggtagctgtcagccaaggacactctcaactcctagagagtgccctgatgtcctctccacttggctctctccataggcccttcttacaatcctggagcttatttattccaagcagcaggaaagtgtctctctgacactttacctgcttttaaagacttcatctcaaggtgggcggatcacttgaggtcaggagttcgagaccaacctggccaacatggtgaaaccccatctctactaaaaatacaaaaattagcagggcgtggtggtgggcacctgtaatctcagctacttgggaggctgaggcaggagaatcgcttgaacccgggaggcagaggttgcagtgagccaagatctcaccattgcactccagccaggggtacagaagactcagtcaaaagaaaaaaaaagacctcacctgattaggtcaagcccaccagggtaactttttgattcactcaaagtagactgactagtaaactagtcttgggaatgatatctaaagaaattcacagattctgccccctactcaagaggaggagattgtacaagggcatgtaaacagggggcatgaatcctggggctatctttgaattcagcctaccatatcactaaggcacgggggcccttgcttgtttcctagttggcccccagatgtgtccacaggttgaagcccatcccattgcttctggagggtaccccttccctgatgggctcagagcagacatcctggttcttactcaaggtcttcagggtcttttatctcttcctgccatttcctaccttgaaatccttcgctgtccctctggagaagccacacctggacttttgcttcttcttctttttttaaaacacaacagctggacttctgatggctcagaaatgtcatcgtcaccagtggatcagcctatcagctttctgctacagctcagggccttcattctggaaaagttgtgatgaggcagtccctctgatgtgtgtgggggatggaatgacattactgaggagtttgtgaggataaagacactgttccaccatgtgaatttctagtaacggttaagttcacgtgcaagaaaagctcttttttttgttttttcttctcttttctttttcttttcttttttatgtttttgagatagggtcatgctctgtcacccaggctacagtgcagtgacagaattatggctcactgcagctttgacctcctaggctaaagcaatcttcccccctcagcctcccaagtagctgggactacaggtacgcactaccattcccggctaatttttttaacatttttgttgagatagggtcttgttatgttgcccaggctggtctcaaactcctagcttcaagcaatcctcctgccttggtccctcaaattgccgggattataggcatgagccaccgcaccaggctagaaaagctcttattttctctggtgggaattaagcatgtgctcaggaaaaagagggggaaaaaaatgaaagaatcctaccattttaagactgaaagtgggggccgggtgcagtggctcaagcctgtaatcccggcactttgggaggccgagccgggcggatcacgaggtcaggagatcgagaccatcctggctaacacagtgaaaccccatctctactaaaaatacaaaaaattagccgggtgtggtggcaggcgcctgtagtcccagctacttgggaggctgaggcatgagaatggcgtgaacccggcaggcggagcttgcagtgagccgagatagcgccactgcactccagcctgggcgacagagtgagactctgtctcaaaaaaaaaaaagactgaaagtggcccccgaggccattagtctactgagtctacatggtttccatttcctcaggcccctacttgaggagcatctccagtgaacaggatctcaatactagactgcttcgaaaacagagcctaatgaaaaaagtcacccaagagaatgacaccctcaccgctattaaactacagttctgccttatgcccttgggcaaattattccaattccctgaaccactgtttccttgtctaaaaaatgggaatagccgggtgtggcagctcacgcctgtaatcccagcactttgggaggccgaggcaggaggatcacctgaggttgggagttcaagaccagcctaaccaacatggagaaccctgtctctactaagaatacaaaatccgcctcgcggcttcaagcgattctcctacctcagtctcccaagtatgccagcatgcctgtaattccagctactggggaggctgaggcaggcgaatcgcttgaatctgagaggtggaggttgtggtgagccaagattgcatcattgcactccagcctgggcaacaacaacaacaaaaaattagccaggcatggtggcacgcgcctttagtcccagctacttgggaggctgagacaggagaatcgcttgaacctgggaggcagaggttgcagtgagccgagatcacgccactgcacttcagcgtaggcgacagagcaagactccatctccaaaaaaacaaaaaacaaaacaaataaaaaatgggataataatggaacctacctaataggttaatagattgttgggacgattacctcagaaaatgcacataaaacactatgtcctggctggtatacagtaacagctcaataaatgcttactgttgctctctaaaagagcattttcttgttgtaaaattgtagcggggcagggcaagttgtgagatggggatgttttagtctgttttgtgttgctataacagaatacctgagactcggtaatttatttatttatttatttattgagacaggctcacccaggctggagtgcagtggtgagatcttggctcactgcagccttgacctcctgcgctcaagcaatcctcccatctcagcctcctgagtagctaggaccacaggcatgtgccacctcacccagctaatttttgtacaggtaatttataatgaccagaaatgtattggcttatatttctggaggctgagaagtccaatatcaaagtgctggcatcttgtgagggccttcttgctgcatcatcccatggcagaaggcatcacatggtggaagggcagagaatgcaagagggggtgaacccactcccttgatgaacaaatcattctttttttccccccacaggctggagtgcaatgactcgacctcggttcaccacaacccccacctcctgggttcaagtaattctcctgcctcagcctcccaagtagctgggattacaggcatctgccaccatgaccagctaattttgtatttgtagcagacacggtgtttctctatgttggccaggctcgtctcaaactcctgacctcaggtgatccgcccaccttggcctcccaaagtgctgggattacaggcatgagccaccgcgtctggccaagaactcattcttgcaataatggcactggtccattcatgagggtagagccctcatgacctaaaaacctcttaagggttccacctcccaacaccaacacaatgacaattaaatttcgagattagtttgattttttgtttctttgtcttgttttttttagagacagggtctcactctgttgcccaggctggagagtagtgacatgaccataggtcactgcagcttcgaactcctgggcttaagtgatcctcctgcctcagcctcctaagtagctgggactacaggtgaacactactacacctggacaattttttggacagggtcttgctatgttgccaggccgaccttggacttctgggctcaagcaatcctcccacctcagtctcccaaagtgctgggattatggaccacatccagcccagttgtttcttgtgagtggcttataaatagacatcttttttccctgttttcacatggtctttcgtctgtgtgaacacgtctgtatcctatatcctaatgcctttttttttcttgagatggagtctcactctgtcgcccaagctggagtgcagtggcatgatctcagctcactgcaagctccgcctcctgggttcacgccattctcctgcctcagcctcccaagtagctgggactacaggcgcctgccaccatgcctggctaatttttttgtatttttagtagagacagggtttcaccgtgttagccaggatggtctcgatctcctgacctcgtgatccgcctgcctcggcctcccaaagtgctgggattacaggcgtgagccaccgcgccctgcctgctttttattttttaagagactgggtctggctattttgcccaggctggtgttgaactcctggactcaagtgatcctcctgcctcagcctccccagtagctgggactacaggttgcgacaccaacccaggctgtggcagttatttaacagtgtttctctccagaaacatgttcaaaccattactgaaggtgaaaagcaaaagaaggggatttaattttgtgtctctcttaccactgtaaatgtggctacataacatctcagagaataaacaatcttgatgaaccatcaaaatcagctgaagatcttattacaatgtgtattcccaggtccctcctgggagaatctgatcctgttggtttagagtttagcccaggtaatctgttttttgtttgtttgtttcgttttcttttttggttttttgtttttgttttgcttttgagatggagtttccctctgttgcccaggctggactggggtggcatgatctctgctcactgcaacctccgcctccctggttcaaacgattctcctgcctcaacctcccaagtagctgggactacaggcggctgccagcacacccggctaatttttgtatttttagtagagtcagaatttcgccgtgttggccaggctggtctctcactcctgacctcaagtgattcgcccaccttggcctccccaaagttctgagattttaggcgtgagctaccacacctggcttgtttttgtttttttgagagggagtctagttttgtgcccaggctggagtgcagtgggcgatcttggctcactgcaacctctgcctcccgggttcaagtgattctcctgtctcagcctcccaagtagttgggactacagacactggccaccatgcccagctaatttttttttttgtatttttagtagagatagggtttcatcatgttagccaggctgctctcaaactcctagcttcaggtgatctgcctacctcggcctcccaaagtattgggattacaggcgtgagccattgtgctggctttttttttttttttgacacggtcttgttctgtcacctagactggagtgcagtagtgtgaacatggctcactgcagcctttaacccctgggctcaaggagtcctcctgtctcagccttcccagtagctgagactacaggtgcataccactatgcccagttaatttttgaaatccgtaatctgttttgttttgtttttttttttttaacatggagtctcactctgttgcccaggctggagtgcagtggtgcgatctcagcctactgcaccctccacctcctgggttcaagcaatcctcccacctcagcctcctgagtagctgggattacaggcccacgccaccaagtcccagctaatttttgtatttttagtaatgatgggttttcaccatgttggccaggttgaactcctgacctcaagtgatccgcccaccttggccttccaaagtgctgggattacaggcatgagccaccaagctcggccagtaatccgtatttttacacttgattttagccaaaaggtggagaagtgatagtaatctgtatttttaataactgtccaaagcgatcctgacaatgagccaaggttgagagttccggtagtattatctcccttttctccacagcaatctggtttattttgcaaacaagaaaactgaggctcagagaagaattaacttgcccaaagcctcaatcatactgacttcctccaaagcctatgatctcttccatacaacatcagacataacgtttgttggcacaaggctgcaaagtagagaccttcccaccacgcagggctggaaattctggtaacaggggccttggcaaacaacccacattcctcttccctattcccactgaaggctgtgagaacacttgttggattagagtcctagctgccataatgaagtactacaggctgggtggcttaaaacccagaggaggccgggcgcggtggctcacacctgtaatcccagaactttgggaggccgaggtgggcagatcacctgaggtcaggagttcgagaccagcctggccaacatggtgaaaccccatctctactacaaatacaaaaattagctgggcgtggtggcaggtgcctgtaatcccagctactcaggaggctgaggcaggagaatcacctgaacctgggagtggaggttgcagtgaaccaagatcgcgccattttactccagcctgggcaacaaaagcgaaactccatcgcagaaaaagaaaagaaaaaagcatagagaaaaaaaattattgtctaacagttctggagattagaagtctgagatcaagtggggcagggccatgctctctgaagactctagggaagtatctgttccatgcctttctcttagcttctgtcatttgcaaccttccttggcttgcaggtgtataaatccaacctctgcctccatattcacatggtattcttccctctgtgtaatcaatctctgtctcttctctattttataaggattcctcattgaattaaattgtattggattaagggcccattttacttaatatgacctcatcctaatttcttaatttagatctttattaaatctgctgaatctcttttctttttctttttttgagacagaatttcgctcttgttccccaggctggagtgcaatggcttgaccttggctcactgcaacctccacctcccaggttcaagggattctcctgcctcagcttcccgagtagctggaattacaggcatgcaccaccatgcccggctaattttgtatttttagtagagacagggtttctccatgttggttaggcgggtctcgaactcccagcctcaggtgatccacccgcctcggcctcccaaagtgctaggattacaggcgtgagccaccgtgcccagccttttttcctttttttttttcgagacagagtctcactgtcacccaggctggagtgcagtagcacaatctggtggctcactgcaacttccacctcctgggttcaagtcattctcctgccttagcctcttgaatagctgggattacaggcataagttaccacgcctggccaatttttgtatttttgaagagatggggtttcacaatgttggccaggctggtctcaaactcctgacctcaggtgatccacctgcctcggccttccaaagtgctgggattgattacaggcatgagccaccatgccaagccagagtttccaaataaggtatcagggattaggacttcaacatgtcttggtgggggggcacgaaattcaattcatagcacctataatattcaggtgtcagaaacaacactggaatcctcaagctgaatatacaaacccaattgccatggtgaccctagcttctccaaaggcaggggtacccaagggctcagatgggatgagaagctgtggaagagataggggcagctttggccattggttggatggttaagaattgtaatgtgacatcagaacagttcagaaacctggctcagaaagtcttttgttggtttgaaagagtggagtgatcatggctcactgcagactggacctcccagactcaagcaatcctcccacctcagtctcctgagtaactgaactgcaggcacacaccaccacatccaactatttaattttttttttttttttttttttttttttttgtagagatggtatctcactatgttgccagggctagactcggaactcctgggctcaagtgatcagcgctcctaccttggcctcccaaaatgctgagattacaggcatgacccactgtgcctggccagcggcaagtccattcaatcaacaactctctaagagcttctcatgtgccaggagctgggcaaggagcaaggcaggcaggatccagtcaatcacgggctcatgggttagtagggtgaccaatagccaaaagataagactaatgaggacacacttataaaccagtatctgtgctctgaaaggaagaaacttgatgcctttgaggagaccctcctgtggctgcattttcctcctctttcattctccttcccttccttcctttcctttgcctttctaactaccattctcttggagacctgcgagtgtttcaacatctcagtgaaatagagggacgagagcatcacctagtggtcagtgtgggcatagcaatgaccaaaactgaactaatcagcttgggagatgaagggcaaggggtggtgggggtaggcagtgtgtgtgtctggcccaggtatgcacctaacagtgaagtgaatacactctggcagattcatggcaatggacaacagctcttaaagatttaccaatttgaagctgggtactcccacctcccacaaaaaataatcactccattgtttggtcctgacatagcacgtcccctggggtgccagaaaggcagaccaagtcctggccaggcagggttaatgctcaaggagaaccctcccatttcctggctgtaatagcagtgaaatcctacctagcctgggtagctctcacatctgctcccatctccctccgcattgccgatgtctcatctcttatccctgcattgtctctagggtctaatcagacccccttccaatccactcccacttacacaggtgtcagagggatccttctcaaacaccagtcagatctgggctcagagcactccctggctcccagtggctccctcacttccctgtgacctggctcccaccggctccctcacttccctgtgacctggctcccacctagcactctagttcacctgcatctctacacgttaccctctgccatctcctctatccatcagacacctgtggcagcctcagcatcatacacacccgctctctatgctctgcctggagctccctgtccagtcttggtcagctggctaactcctgatccttggagaaccagctccatcagcacctctgggcaaggtaagttccccttctcagagctcccatcttctatcatcacactgtgctagatgggcccaggctggagtgcgatggcacatctcagctcactgcaacctccacctcctgggttcaagcgattctcctgcctcagcctcccaagtaggtgggatcacaggcgcccgccaccatgcccggctaattttgtattcatcatattggtcaggctggtctcaagctcctgacctcaggtgacccccccccccccgtctctgcctcccaaagtgctgggattacaggcgtgagtcaccacacctggccaagactcggccctctttgaggtacagtgtctgattatgctgtgattctatacccagccccagcccatttctagactgggtcccggtacaacagtgaacacttgttgaatgaatgaaggctcaggtggaagtccatcactcattcgaccatgagctctgggccttgcattatatacttttatgtttccaaatggattttgtttttgtgacctaagttttctaggtgtgagacttcactgccgctcctagtctggaagtatcccaaggcggggccaaggcaagcaccaggctgggtccaggaagctcctgggtagagaccactattggaaaaatggggtttcacaaaagggactctcccactctgccactagtcggctcctgaaatgggccttgtctctgaggtgctcccctagccacccctccctttatcccaggacttctgaggttcccacttcagccttggtggtggggagcgggtagaggaacatctgtcaccttcttttggagcctgctcctaggtcagtggggccagaaatcagtagggcagagatggagtgctcatgcgtgctgggttccattggtgagtcagcacacctactgaaagcctgggaaccaaacttgccggggtggggcgggagtgcagaaaagaaagtgtttcatgacctgcttgggggaaggttaatgctctgatgctggataaacatgttcctctcttctctaccccccaggataggtttctgggctggaagggaacttttctgacccatcaagagaaatccactgcaggccgggggcagtggctcacccctataatcccagcactttgggaggccgaggcgggtggatcagttgaggtcaggagttcaagaccagcctggctaacacggtgaaaccccgtttctaataaaaatacaaaaattagctgctcatggttgcccacgactgtaatcccagctactcaggaggctaaggctggaggattgcttgaacctgggaggcggaggcggcagtgagccaagactgtgccactgcactccagcctgggcaacagagtgagactccgtctcaaaataaaaaataaaataaaaaaataaaaagagtccgggagcagtgactcatgcctgtaatcccagcactccaggaggctgaggcgggtggatcacctgaggtcaggagtttgagaccagcctggccaacatggtgaaaccccatctctactaataataaaaaaattagccgggcgtggtagtgcacacctataatcccagctactccggaggctgaggcaggagaatcacttgaacctgggaggcagaggttgcggtgagctgagattgtgccattgcactacagccgggcgaaaaaatatatatatatataaaatcgtggtggctcacacctctaatcccagcactttgggaagccaaggcaggtggatcacaaggtcaagagattgagaccatcctggccaacatggtgaaatgccgtctctactaaaaatacaaaaattagctgggcgtggtggcacatgcctgtaatcccagctacttgggaggctgaggcagaagaatcgcttaaacccaggaggtggaggttgcagtgagctgagattgcaccactgcactccagcctagtgacagagcaagactccttctcaaaataataataataataattaaaataaaaaaaataaaaaagagaggccgggtgtggtggctcatgcctgtaatcccagcactgtgggaggccgaggcgggtggatcacctgagatcaggtgtttgagaccagcctggccaacatggtgagaccccttctctactaaaaatacaaaaactagccgagtgtggggatacacgcctgtaatcccagctactcaggaggctgaggcaggagaatcgcttgaacccaggaggcagaggttgcagtgagccgagatcgcaccacagcactccagcccgggcgacagagagatactccgtttcaaaaaaaataataaaaaaaaatccattgcagccttatctccgtgacaagactagcagaccctgctttctttttttttttttcgagacggagtctcacactgtcgcccaggctggagtgcagtgatgcaatctcggctcactgcaacctccgcctcccaggttcaagcgattctcctgcctcagcctcctgagtagctgggattacaggcgcccgccaccatgcctgactaatttttgtatttttagtggagacggggtttcaccatgttggccaggctggtctcaagctcctgacctcgtgatttgcccgccttggccccccaaagtgctgggattacaggattacaggcatgaaccaccatgcccggcctcaggccctgctttcatagtcctggtaacccggctatcagtcacttgttgtcttggaaagttggacccttttcagaaccaagaccagtctcccttaagcttctaccatgcaggaccttgtccaagttttatcactgcctttagatgctgaagtccaggagaagctaggccatcttgtcaggacagtttacattctttccatgcttcttgggccacccctgagagggtcagacaagcaaacccaaaccccttggccctctccagggactcatcaagagcaggaatttggggagagcaacgagggacaaagtctggatgacaaagctcactccaaagctcaagcagagatactgcaggggagggaaacctccctaagagcccctccagtcagccacagaacgtatctcttgtcaccagcaggatttatttcagggttctgccagcaaaatgacttataaatacattcttccgcatctccccctttccaggggtgctgctgagttgcatgggatgagatctgcttctgagatcctggggctgtatgccacccccaactcaccagagctcttccagcacacagcagcacccccaccccccagctggcttggagttgggcagagaagcttatgaggctgttatctctcaacagacagctgtgcagggctggaggcagcagcttatcaggaggcctgcagtgattcacagcccaagacccagcttctctgctgaatagtaatttccagcagtggatttgtgctcagtctctctcctccccctttcccaagggtgtgctgtcctttctcagagagagggcagtgaaggggagatcctacccacagagctgggggctttgtgccagccttctgggtaaggttcagtttattgtctggaggctgcagattcagggacctcagcagggtctgccaccctttgcagtgacctccaggagagttcatcgatgctgtccttccactccttccttcccctcccagaaaaacaatgtgccgctccctttcccttagtggcgatgtacaggggtacacgggcccccatttgcaacagcctctgaggccagggccagcccgggagggcggagtgggggaggagagaggaagaagccagggactgggcagtgccttgcaccattttgaagctgttcagtctctgtgcctgaccctgaagactccaaagactcaggacgcaaggctggaggggaggggagacacaaggggccaggcgagagctgtctctgcacaggcgggtggttagaaaaaaaatgggggacacagccatttttgtgcttgttttattggaagcaagactccagccagctgcagggctcaggggaggaggcctggagagttcagtcctgggtctccctctgggccagcagggggaaaaggggtgttaaaagagctagaaccctcagagatgctcctctgaagcaggggaaagaaaactagaaaggaaaactgtcccagggcggggagcggaatagggcccccacatctcagactctcctaccctcaagcagttaattctcaccccctgccttcctctgtcaacggtgggggtgattccaataactcttctcagcttccatacttcaggtgctcttcgtgaatgctgggtggctttaacccttgggggtcccaaacaagtttccagaatcccactgtccaccattctcccccaaagaaggtcccagaaaaggtgaagttccgtgtcttcacgcaacacgggcataagcagcaattatcgcacgaagtttccctagggtggtcggggatcctctcctgccactcctggggcccctctcttgtcgccttaaggtccatgctacctgtcttgaggagctgtgtccaggttgtgggctccggaggaccgaggagtgaaaggctggaggtacatctgaaggtggaggcgctggcggaagatcctgccggactaggtggcccacagtccggagtttcaggccgtctgatcctcgtccgcaacccctggctcgggttgcgatcgcttcgcggagccttctccagctgcgggttcccctaggctcctcttggacgctggcgcggctggcggggacgagggaccaggatggggattcgggggctggtagccgggctgtcgcggatccagcgcgtccttggaaagtaggatggcgaggccgggcacgttcttaagtacgctgagactagcggccggctcgccaggcgtctgaccctgcgtgggcccaggcgggaggctctgccacacctcgcgtacgctccggtagcgcagccgcgtgacctggtgcaggcccgccaggcggcgcttgaggatctcggcgcacgtgacggttttggtggtggcccggccgcagccgctgaagacgatggcgcgcgtggctggctgcgccatgctggcggtggcgaaggccatcaggttccggatcttgctgccttccttgacccgcatgtgcaccgcgcccggcgccaggtctgcgaaggggccggagcccgggccgcctccctcggccccgcaccccgctggcgcctcttcggagcgcaccttacggaagttctccatgcgccgtcgtcgccgggaccgccggctttgccatggggcggcctcagccccggggctgcatggccgccggtcgcgccttgcaagggccagcaggggtaagggcgccggagcagcgcagacgccggcgggcgggctgggacggcgcgatctcggccccacttctctcgagcgggcgccgctctactcagcgctctcggcgccgggtgctccgcgcctttagctgaggccccgcccctgccgccaggcccctcccctgacccggcccggccgggcccgcccgggccccagcctcactagcctttcctggcgagtctgggtcctcagctacgcgggcgtgggagcgggcgcgctgcggggcgcatgagcaggtgaaggtgaagttccactataatcgccatcagcgctctgagagccaaccctcacaaaccggcagtctaaataaaagctgcgcttgccgtgcaaacactgcttcaaatccggtatccgagcccttcccatttgcaactgaaggccgcccctcgtcccctcccagggagagatttccaagaggcttgctggggccttgcccctcctcccccgccccggggaacacccccaccttttttccgctcccaagtattcttgcctcaaggacagctagtgcgcggtcagcagagtgcgggaggagctggctgcggctccactccgcgcctccccgcgggcgattacgtcgcggcgtggtcctcgcggggcgcggaagacccagacttcagcctcgccacgcctgcccggagctcgaggctcccggacccccgtccacccctgggacgtgaggagtgaggctttgggccaggctgttccccgaggcgcgtggggaagcgggcgtgacctcttctgaaaaggcggtaggctcgctccacccaggccctagagcccacccttagagctgcgcgctttagggtgagccaggcacgatgccttgccaacgtggccgcccccttcctcccaggcggaattcgctcaggcaacattggccccttgagatccagtggggtccttttcgaaaggaggctaggtgaacgcaggttttaaaaaagagaagggaggggccgggcgcggtgtctcacgcttttaatcccagcactttgggaggcagaggtgggcggattacttgacgtcaggagttcgagaccagcctggtcaacatggtgaaaccccgtctccattaaacgtacaaaaatcagctcggcgttgtggcacgctcctgtaatcctagctgctcgggaggctgaggcaggacaagcgcttgaacccgggagctgaaggctgcagtgagccgagatcatgccactgcactccagccggggcgacagagcaaagctctgtctcgaaaaatgaataaattaattaattaaataaaatacaaaagagaagggagggataccccattctccaggatgtgattattatgcattgcatgcctgtatcaaaacgtctcatgtaccctctaaatatagacacctattgtatacccacaaaaattaaaaagacttaaaaaaaaataaaagagagaaagaagggaggaagatggggagttgaagccctgggggcattatggaactactggatgcctctccggcggaaactccacgggaccgaaagagaggcccggggtctcctgccgggtgagagaagcattagagaaagatgagattgggggctgtcaggactactgatggaagggagggggtctgagaaggggcccgaccctccctaaaactgctctcgggattcccccgtcctccttccacccgccctacgcagtcaggactgagagagggcggcagatctggtcctagccaggggactgtgacggggcgtggcggggagggacacagagagctggggcgggcgggccaccgggaaagtgctgggggcatgacagtgccttggattgctgggcctcagttggagatggggctgccagatgctgttctccctcctcccgctgttctcgccctctgggcatctgcagcagctctcagtccctgctgttcaaaaccagggtttacttccttgtcacttcttgggagcggccctcggtccctgctgttcagaaccgggatttaccctcttaccacttcctgggagtggctgcggcgactggaccttggcaccgcaatgtgtgaatggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtggaaggagcgagctctccgtccccgggagtatgcaagtttgggctgcacgatcacttggaagggattgggcggagttctgtcatttggagaaagggtcctgggagcttcaggtttgtgtagggcgaggacggggcggttctgcgtccggccaggttggccctcgaggacccagccgtccccaacctcctaaactgctgtcggatgtagaagactcgcattcactgctctccacagtcggtgaagggagaacgccgaaaagggccgcattccctcctgccggtcccctccccttcccgcgctccctctgcagcacttaaaatgtaaatgtacatcgtgattagccgcggggtcgctaattacagctgaagccattcattacactgtcagcgcgcgtcgcagcccgccggctgtgcgctccctcctagccgtgaaggggtgtagggggtgggggcgggagatgcggggagtgagggaggaaggatggggtgctgtgaattagggtaatgtggcaggcctggaggaagctggagtgggagagagcgggcagcgagcggggaaaacagggtgggcggtgaaggacggggcggggtggcgaggagagaggagaaacgcgagaggcaggaaggaattggggcatgaagtagtgaggacacagggaaaggggctgtatgaggggggaaacagcgtaggggacagggcgaagggagaaaaagctgagaagagggtgggaaccccagggtggggccagagtcagaggaggggagcacagggctcaacttcagaaaggctggtaaattttaaagtagagcatcagtggtgcacaccacacaatggttagaaaagtggagtcagtgaagacgttgtgttaaaggagctgggtgccagccatacacagagtaggggggcatttatttccgtgtgtgtttatagatgtaaatgtatttttaaaatatctgcaagaaaacagcacactgacctcttgttaccgcatgaagttttcattaccttctttaagaaaaggacaattaaatatgaatacagagtcttggagcagcttgcataaatgagctactgaccctgaagcttcagcttctattagcttctttctgcctctgtgtgaccttggacaatttacttaacccatttgctttggctttgtcatctgtaaaatggggctaattatagtaatctacctcacagagtgattatgagacacagccgtcttggaaccttggctgctaagttctcaggaaatgttggctgttattatttttcatatattatttgtgaatttaaaaaaattgtaaagggattgggggaaagaaaactggtgaaaaggaaaagaaattgggaaagactcagaaataatagcagttttcactcacagtgaactggtgagtggcaagctagactcctttcaccctgggaggaggtgttggggtagctgggctagaggccaagcctagccaatacatatctgttaaggttccctgggacctttccagcagcacaccctacttcctgtggacaaatctctcatgttcacactggagggggatcgctggtacagcccctctcctctgtctcttgttgcaggaggaggatgaggagctcttaaaacccctgatcctagtcccagcctctttgggcagggtcttgggagcatgcaagtagagtcaggaattagaaagttagcagggccaggccgggcgcagtcgctcactcctgtaatcccagcactttgggaggcagaggcgggcggatcacgaggtcaggagatcgagaccatcctggctaacacagtgaaaccctgtctctactaaaaatacaaaaaattagctgggcgtggtggtgggcgcctgtagtccctgctactcgggaggctgaggcaggagaatggcctgaacccgggaggcggagcttacagtgagccgagattgtgccactgcaccccagcctgggcgacagagcgagactccgtctcaaaaacaaaacaaaacaaaaacaacaacaacaaaaaagaaaattagcagggccagagggaactcagatttagcaggcacccaccgagtgcccagcattgggtcagatgtgtttaatctccacactcttctttccaggaaggtatcatcattgtttgacagatgtgaaactgagacccagagaggttaaataacttgccttatgtaccacagctagaaagaagcaaccacagatgtttgaactcagagttctgactccctttactatctcagccgaatgtatgagaaaaataaacttttaagtgactcaaactgcccaaaggggttagctttgggagatgagggtgttccatagtggaaaagatgtgttggtgatctgttgctgcataaaaattaccccacagctcagcagcttaaaacagcaaacatttggccaggtgcagtggctccaggaagtttagactgcagtaagctgtgattgtaccactgcattccagcctgggcaacagagcgagacactgtctcaaaacaaacaaacaaaaaaaaacccaacaacaatcatttattattgtgagatcacacaatttctgagggtcagaaatccaagaacagcttgaagaggtctcatctagctcagggtctgtcatgaggctgcagtcaagatgtcagctgggcatggaggatctactcccaaacttacttcacatatctgttggtcagaggcctctgtttctccactggtctgatcatgacctggcagctggcttcccctagagcaagtgatcagaaagagacaaagaaagagagggacagagaaaataagcaggaagctgcagtgcctgttatgggccagcctcctctgaagttgcacgccatcatttccagtttattatattagttggaaggtagcccagcctacattcaaaaggaggggtttcagacttcatttcctgaagggaagggtatcaaagaactgtaggcatttcaaaaatcacaacagagccgggcgcggtggctcacgcctgtaatcccagaactttgggaggctaaggcgggtggatcacaaggtcaggagatcgagaccatcctggctaacacagtgaaacccggtctgtactaaaaatataaaaaattagccgggcatggtggtgagtgcctgtagtcccagctatttgggaggctgaggcaggagaatcgcaggaacccggaaggcagaggttgcagtgagccgagattgcgccactgcactttagcctgggtgacagaatgagactccgtctcaaaaaaaaaaaatcgcaacagaaggcgagtgtttgggaggcaaatttaggaggagacggaagaaggaatcaacatattgaagcaaacacgtggaaagaacactgaccttgaatcaggagagctaggtttatttcccggcatacagcaagcacttaatagatgtttaagtgaatgcatgattgacaatttttctgagattgttttcacagacgtaacagcagttaccaccccacatgctctcctgaggattgagtgggattatgggtatcagagctctctgtaaatgtaatagtgctggttgatgatgcctggaagtgaatgtggtctgggagacagggagagggctctgccatacaagagcctctgcccaggccaggcatctcttctgtcagactgagtcccaggccctggggtagtgctctgattccagctctccttctcagctctctatctcaccctcggtccaacctcctcaccatggctcagctctaggtattgcttttctccttcagccagtcaggacaggacccaggagacttaccattggccaagcctcttgcctgcaggccactctacctcttgtgctggctctggccccacagatggggaatgggggtttgcattgcagacccagtgagtgatgccatttgaggacaagaaccattaatcttgcatgaaattcaattgctctcctagcagataggccaagtcaccggagtcctgagaggaagaggggtgtgtggggcctagaatgaatgaggagtggtgtctgtggaaggggaaaggagaggagaggcaaaagcatccatgggacctccttctcgttctccttaagacgggatgctgccagtagttcccctatcttccttccagactctagaggcaagtgcagcgaaaagccactcacctgggcaacattagtgttcccaggagagctcctattcctgaaagacttcccaagagcctgctgtgatgcccagaatcctccattattgcttccccccttaggatcagttttgtcctctgaagataaggtccctccaaaatgggaattggtcaaaacaaaataatccggatgcttgagaacgttgggatgggaggaagatatagagctgataaagtgaggaatcattatcaattacagctgacatttagttagcacgtactatgtgccagacactatcctaagcactttacatgtacaaactcatcacatacaacaagcactatgaggtagctgctacccacttcatacgtaaattagagccagatccagagacagatggtctggctccagtgtctgctcttaaccatggcactagaccattgcaggaggaagggaaggcagggcagaaagccaccagctatcaagacctccctggctatccataatgaagggcacagcactccagggcgtgttctgctttgcatttgcctggtgtggaaggcatcagggctggtccttctccagcactgacctggggcagagatagggagcttggttgggtctgcttccctagaaatatatcatatgcccttcagggtgcactgaagtttgtctgtttttgagacggagtttcgctctgtcaccaggctggagtgcagtggtgtgatctctgctcactgcaacctccacctcctgggttcaagtgattcttctgcctcagcctcctcagtagctgggacaacaggcgcatgccaccacgcccagctaatttttgtattttcagtagagatggggtttcaccatgttggccaggatggtctccatctcttgatctcgtgatccacctgcctcggcctcccaaagtgctgggattacaggtgtgagccacttcgcccgaccgaggtttttgtttacaactcagaaaatgcttgcccatctgacacccagaagcagctaatggggtggttacgagtttggactctagagctccactgcctgtgttggaatcccaggtctgccacttaccagctgtgcccttggtcaagctatggaacgtctctgtgcctcgatttctttccctgtgaaatagaaacaatgacaatagtacttatctcttagaattggctcaggttaggccgggcgtggtggtttatgcctgtaatcccagcaattcgggaggccgaggcggacagatcacttgaggtcagaagtttgagacgggtctggccaacatggtgaaaccccatctctactaaaaatataaaaattagctgggcatgatggcgcacacctgtaatcccagctactccggaggctgaggcagcagaatcgcttaaacctgggaggcagagtttgcagtgagccgagattgggccactacactccagagcgagtgtagtgtcacctgggtgacagagcgagacagagcacaaacaaaacaaaacaaaaaaccgaaaaacaaaaaacaaaaaaatgattgtcttaggttataccccagtacttccatggagttgtcaccccagatttcagagataggctaaatcccttgtctatagattcagctactgagcattaaagcttgtagggaaacccgtggtggtggggggatggggtaaaaaaacacagggaggcagaagggggatgttgacttccatgtggcagccagcactgctgggcctcagctgttcattgacaggcaggactgcaggcccagtggttttattttgattgtgtgtgattgaacattttctgcttcatttcaatgagagttgtctgtgtcagcttttctgaatgttacatagatagaacccttcttccttcacatccggttgagtcaggctcatgacaaacaatgtaatttccttgctgtagagtcccctagggtctggagtactgggaagaagccaggaaattgttccctttttcctgggtcgcctctcttcctgacagttgttcctttcccaccttcccatggtggtgagagtggaaacagcatttttcacatgctacccttgatacctccatcccccagcctgccagcctggaacagagcccccaaatcaagctggatgaattggggttcctctcaattccaggagacacttagtcaaattccctttatggccacgaggataattacaaccagataattgtcttccttctcttgaacgaacgatgaagtaaatcaagtgtgcctgccttctactctgaagtaaatcacaaagcaccctgtatgtattctcccagaagataaattttatacatttcaacaaggaaagagaacatattttgtttgcaaaattcctgggagaactctctatctctctctgcccagaaattatgtgtacctgctgatgaatgacctgcctgatgaacctgccttgggaaagataatagagttatgattggatgtcaccagctctcatcatttctgctgtgggagaagtcacaggagcaggcagaactcttccctctgatgaagcagttgtcttcttgtaaccacagatcttcttcgttcactggggttgtgggcacacctttaagattctgccctgcgccgggcgcggtggctcacgcctgtaatcccagcactttgggaggccgaggcgggtggatcacgaggtcaggagatcaagaccatcctggctaacatggtgaaaccccgtctctactaaaagcacaaaaaattagccgggcctggtggcgggcgcctgtagtcccagttgctcaggaggctgaggcagaagaatggcgtgaacccgggaggcggagcttgcagtgagccgagatcacgccactgtactccagcctgggcgacagagccagattccgtctcaaaaaaaaaaaaaaaagaaaagaaaaagattctgccctgaagtccaagtgagctacacaggtccagtgttttcaaaaaagaagtccccaaactcatgtttttatgtgacagtttcaggtttttattttttatttttttatgtttaattgtttttagacagagtctcactctgttgcccaggctggagggcagtggcacgaccttggctcactgcaacctctccgcctcctgggttcaggcgattctcctgcctcagcctcccgagtagctgggactacaggcttatgccaccacgccctgctgatttttgtgtttttagtaaagatgcggtttcaccaggatggtctccatctcttgaccttgtgatccgcccacctcggcctcccaaagtgctgggattacaggagtgagccactgcgcccagcctattttttatttttaaatttcttttagagacaaggtctcattttgttgaccagagctggagtgcactggtgcagtcatagctcactgcagacctgaacccctgggctcaagggattcgcaggcacatgccatgtgggccagtttcaggtttttaaatgttgtcgactgtttcagttatctattgctgagtaacaaatcaccttaaaatcacaaatcaccaggccaggcgcggtggctcacgcctgcaatcccagcactttgggaggctgaggcgggcggatcacgaggtcaggagattgagaccatcctggctaacacggtgaaaccccgtctctactaaaaatacaaaaaattagccgggcgtggtggtggccggtgcctgtagtcccagctactcaggaggctgaggcaggagaatggtgtgaacccaggaggcggagcttgcagtgagtggagattgcgccattgccctccagcctgggcaacacagcgagactcccatcacacacacacacacacaaaaatcacacatccccttaattagtggctaaaatagcaatgatgtattatttatgtttttttactattatatattttttaaaaatagagatgggctgggtgcagtggctcacgcctataatcccagcactttgggaggccgaggagggtagatctcctaaggtcaggagttctagaccagcctggtcaacatagtggaccctgtctctactaaaaacacaaaattagccaggcatggtggtgggcacctgtaatcccagctactcgggaggctgaggcaggagaattgcttgaacccaggaggcggaagttccagtgagctgagatcagtgtagcctgggcagcagagcaagactccatctcacacaaaaaaaagagatggggtctcactatgttgcccaggctggtcttgaactcctgggctcaagtgatctgctcacctatgcctcccaaagggctgagattataggcatgacgcaccatgtccagccaatgatgtattatttctaatgacttcgttttggctgggttcagctgggcagttagttcttctgctccacttaatactggctgtggtcactcacatggcttcattcagctgggagcttgacagaggtcagaacactcaagatggcttcattcataagtctagtgcctctgctggggtggctggaaggctgggggtgttggctgggcctctcttttcatggactctagcctaagcttctttcttgagtggcttgatcccaaaacagtgaaaatgggagctgtcaggctttgtaaggcctagacctagatgtcacacattatcatgtcctctacattccattggtcaaaccaagatacatgtctagaccagattcaagggataaggaaataaactgtacctcttggtgaaaggcctgacatgtatatacaggaatgggaggaactgttgacagccatctctgcagacaatctaccacatgaactaactcatgtgtttttgttttttgtttttgagatggagtctcgccctgtcgcctaggttggagtgcaatggcacgatctcggctcactgcaacctccgcctcccaggttcaagcgattcttcttcctcagcctcccaaggagctgagattgcaggtgcccgccaccacgcctggctaattttttttttttttttttttttttttttttttgagacggagtctcgctctgtcgcccaggctggagtgcagtggtggagtcttggctcactgcaagctccgcctcctgggttcacgccattctcctgcctcagcctccagagtagctggaactacaggtgcctgccaccacgcctggctaatttttttttgtatttttagtagagatggggtttcatcatgttggccaggctggtctcaaacgcctgaccttgtgatctgctggcctcagcctcccaaagtgctgggattacaggcgtgagacactgcgcctggcctagctcatgcttttaaataacgtatctgtagctcagtttagcccaaggttgcaacttcctttttttttttttttgagacagagtatctctctgtcgccagcctggagtgcagtgacctgatctcagctcactgcaacttccatctcctgggttcaagcaattccctgcctcagcctcccaagtagctaggattacaggcgcccaccaccatgcctggctaatttttgtatatatatattttttagtagagacggggtttcaccatcttggccaggctagtcttgaactcctgaccttgtgatccacctgcctcagcctcccaaagtgctgggattacaggcgtgagccaccacacccagcctccttttatttttttaatttaaattttatttttttgagacagaatcttgctgtgacgcccaggctggagtgtagtggagcaatcagggctcactgcaaactctgcctcctgagttcaagcaattctcctgtctcagcctcccgagtaactgggattgcaagtgcccaccaccacaccagctaattttttgtattttttgtattttttttttttttagtagagtaggggttttaccatgttggccaggctggtctcgaactcctgacctcaggagatttgcccgcctcggcctcccaaagtgctgggattacaggtgtgagccaccgtgcccggccatgcccaactaatttttgtgttttgtttgtagagacggggttttgccatgttgaccagtctggtcacaaactcctggcctcaagtgatccacccgcctcagcctcccaaagtgttgggattacaggcatgagtaaccatgcccagcacaactttttttttttttttttaagacaaggtctcactgctgtcacccaggcaggtgtgcagtggcactatcacagctcattgcagactcaacctctcaggctcaggtgatcctcccacctcatttttagattttttttttttttttttgtagggatggggtcttactatgttgcccaggctggtctggaactcctgggctcaagcaatactcctgcctcggtctcttaaagtgttgggattacaggcgtgagccactgctctgggccaaggttgcaacttctacttgaaactttcagggaattcacctggaaatgcaggggctttttttttttttttttttttttttttttttttgagacagagtctcactttgctgcccaggctggagtgcggtggtgcgatcttggctcactgaaacctctgcctcccaggttcaagcgattctcctgcctcagcctcccaagtagctgggactataggtgtgcaccaccatgcctggctaattttgtatttttagtagagacgaggtttcaccatgttggccaggctggtctcgacctcttgacctcaggtgatcctactttgggattgtttccacccatcagcctgaatcccaaagctgcctagttcctaacctgaagggaagaaggccaggtgattggctgggtgcagtgactcacacttgtaatcccagcactttgggaggccaaggcaggcggatcacctgaggtcaggagttcgagaccagcctggccaacatggcgaaaccccccatctctactaataataataaaaaaaattagccagaaaagaagaccaggtgattaatgagatctctttattttatttttagagggagtctcactttgtcacccaggctggagtgcagtggtgcaatctcggctcactgcaacctctgcctcctgggttcaactgattcttctgccacagcctccctagtagctgggattacaggcacatgccaccacagccttttagtagagacagggtttccccatgttggccaggctggtctcaaacttctgacctcaagtgatctgccctcctcggcctcccaaagtgctgggaatacaggcgtgagcaccgcgcctggcctattttattttattttatttttttgagacagagtcttgctcagttgcccaggctggagtacagtggcatgatctcagctcactgcaacctccctggttcaagcaattcccctgcctcagcttcccaagtagctgggattacgggcacatgccgccacgcgtggctaccttttttgtatttttagtagagacagggtttcaccatgttggccagactggtcttgaactcctgacctcaagtgatctgccctcctctgcctcccaaagtgctgggattacaggcgtgacccactacgccccgcccattttattttttggagacagagtctcactctgttgcccacgctgatgtgcagtggcacaatcatagctcactgcagccttgattgcctgggctcaagggatcctcctgactcagcctcctgagtaactgggactacaaatatgagccaccatgctggctaatttttgaatttttttgtagagacaggggcttgctatgttgcccaggctggtatcgaacttttggcctcaagtgattctcccaccttggcctcctaaagctctggaattatagctgtgaggcactgtgcttggtctgaaatctcttttatttatttatttatttattatttttttgagacagagtcttgctctgttgcccaggctggagtgcagtggtacaatctcagctcaccgcaacctccgcttcctgggttcaagtgattctgctgcctcagccccctgagtagctgggattacaggcgtgtgccaccacgtccagctggcttatttttgtatttttggtagagacggggtttcaccatgttggccaggctagtctcgaactcctgacctcaggtgatctgcccaccttggcctcccaaagtgatgggattactggcgtgacccaccacacctggccctgagatctctttttttttttttttttttgagacggagtctcgctctgttgcccaggctgaagtgcagtggcaccatctcggctcactgcaagctcaacctcccgggttcacgccattctcctgcctcagcctccctagtagctgggactacaggcacccgccaccacacccagctaaatttttttgtattttcttagtagagacggtttcaccgtgttagccaggatggtctcgatctcctgaccttgtgatccgcctgcctcggcctcccaaagttctaggattacaggtgtgagccacagcgcccggcccctaagatctcttttaatatcctgtagtgctcaccagctttgactttagcctgaggagtcattgcaggattttaatcaggcctatcttgattagattagtactttagaatgttcacataggatgctaagaggcctttgttccagttagcaaccgctgcgtaacaaattatcagaaatctagttgtgtaaaacatttatttatttatttatttatttatttatttattgagacagaggttcactcttgttgcgcaggctggagtgcaatgacacgatctcggctcactgcaacctccacctcccgggttcaagcaattctcctgcctcggcttcccatgtagctgggattacaggtctgtgccagaacgcctggttaatttttttgtatttttggtagaaatggggtttcactatgttggccaggctggtctcaagctcctgacctcaggtgatccacccacctcggcctcccaagtgctgggattacaggtgtgagccaccacacctggccaaaacaattatttattatgctcacagattctgtgggtcaggaatttaggcagggcacattggagatggctttgtttcttctccataatgtctgaggtttcagcttgaatgctgaggctgaattaatggcaaaaccttatctctaaaaaaaataaaagttaaaaaaattttaaaaaatgaccacagcaatggtcccaagtgctaggattacagctgtgagccaccacactcagcctattattattattatttttttttattattattattttttaatgatttaatgctgggcatagtagctcatgcttgcaatcccagcatttgggaggccaaagtgggcagattacttgagctcagtttaagactagcctgagcaacatggtgaagccccatctctataaaaaatacaaaaaccagccaggtatggtggtgcacgcctgtaatcccagctactcaggaggctaaggtaggagaatcacttgaatccaagagacagaggttgcagttagccaagatcgtgccactgcactctagcctgggtgacagagcaagactctgtctcaaaaaaaaaaaagtaataataaagcgaagcattaattcaatgaaatcatcaatagcctttcaaagtatacccagaacttgagcactcctccctcctccggcctcattccccacacctttcccgtcatccattctgcctgagccgcaccagcttccttgcgttccctcaaatgtgatgaacacgcttctgcagggcctttgcgctggctgctccttccactaggaatgtgggtccccctggtatttccctgactgtctcccttgtagccttcagtctctgctcagatgtctcctgctcagagagcccacccgaccatcctaatataacagtcccctccttccatctcttttcctttctttggttttctttttcttcatggcatttaccatcatctggcataactgtaattgcttattgtttattatctgtctcctcccactagaatgtcagctgtccaggaggatagggaccttgttttgttcctagcttcatttccagcacccagaacgtgtctggtactcagtaagtgctcaaatcaatgtttgtggagtgaatgaaggataggcttctttgggtgagaaaagtcagtaacccatgcctaggacatgatctagaacagtggttataaagtgtggtccttcaagtgtgatccaggatctttgagggtccccaagacccttttgtgtgagaggatctgcaaggtcaaaactatttttttttttttttgagatggggtcttgctcttcttgcccaggctggagtgcaatggcacaatcttggctcaccgcaacctccacctcctgggttcaagcaattctcttgtctcagcctcccgagtagctgggactacaggcatgtaccaccatgcctggctaattttgtatttttagtagagacggggtttctccatgttggtcaggctggtcttgaactcccgacctcaggtgatccacctgcctcagcctcccaaagtgggtcaagactatttttataaatatacggaaatatcatttgcctttttcattcttattttttcatgagtgtactgtggagtttttcaaaggctgtagagcatgtgatgtttcaacagatcgaatgcagaagcagatatggtccaggcacagtggttcatgcctataatcccagcactttgggaggctgagatgggaggattgcttgagtccaggagttcaattcagtctgggcaacatagcagaacttcatctcttttatttttattttttgagatgaagtctcactccatcacccaggctggagtgcagtgtcgtgatctcggctcactgcaaactccgcctcccgggtttaagcaattcttcagtttcagcctcctgagtagctgggactacaggtgcctgccaccacccccagctaatttttatacttttagtagagacagggtttcaccttgttggtcagactggtctcgaagtcctgacctcagatgatccacccagcttggcctcccaaagtgctgggattacaggcatgagccactgcgccccagctcatctcttttattaaacaaagaaaggaaaagaaaaggaagggaggaaggggaggagaagaagggagggagaagaggagagaggcagaaaggaaaggagggaaaggaaaggagcagatatgggaatccagctgtcttctattaagccagacattaaagagatctgcaaaattataaaatgatgccactcttctcactgttttttttttaatgtaactaatttaaataaaatgttttttatgttaacgtgtaatgagtttattaatttttttgtttgtttgtttggtttttttttggagacagagtcttactctgttgcctacgctagattgcagtggcatgatctcagctcactgcaacctccacctccttggttcaagcgattctcctgccttagcctcccgagtaactgggcttagaggggtgcaccaccacacccagctgatttttgtatttttagtagagatagggtttcaccatgttgcccaggctggtctcaagctcctgacctcaagtgatccgcctgcctcggcctcccaaaatgctgagattatgggccacctcacctggctgagtttattaattttaaaaaatgaattaataataaatgttttccgtgggtgtggtggctcacgcttgtaatcctagcactttgggaggctgaggcaggcagatgcttgaggccaggagttaaagagcagcctgggcgacaaagtaagacctcgtctctacaaaaaaatacaaaaattaaccgagtgtgatggttcacgcctgtggtccaagctactaggaaggctgaagtgggaggattgcttgaacccagaagatcaaggctgcagtgagccgtgatcatgtcactgtactccagccagcctgggcaacagagcaagaccctgtctcaaaaaaaaaaaaaaaaaaaaaaaaaaaaaagaaagaaaagaaaaagaaaaaaaaacctccacaaaaacaaaacaaaaatgaatgaattaataataaatatttctgcggggtggtggctcacacctgtagtcctagcactttgggaggctgaggcaggaggtctgattgaagccaggagttcaagatcagccaggcagcatagtgaaaccccctctctataaaaaataaaaaaattggccaggcacagtggttcatgcctgtaatcccagaactttgggagactgaggtaggtggattgcttgagcccaggggttcaagaccagcctgggcaacatggtgaaaccctgtctctataaaaaatgcaaaaattagctgggtgtggtggaacatgcctatagttcccagctacttggaaggctgaagcctgagaatcactttaactctggaggcagaggttgcagtgagccgagatcacgccactgcactccaacctgggtgacagagcaagaccctgtctcaaaaaaaaaaaaaaaaaattgccaggcacggtgatctgggtctgtagtactgggtactcgggaggctgaggtgggaggattgtttgagcccaggagttcaagaccagcctgggcaacatgataagatcccatctctgcaaaaaatcagaaattagctggatatggtggcatgcgcctgtgttcccagctacttggaaggctgaagtgggagaatcgcttgaacctgggaggcagaggttgcagtgagctcagatcatgctattccagcctgggcaatagagtgagactctgtctaaaaaatatatataaaagaggtgaggattgaaaggaggctgagagactcggacccagggaagagttgatgtatgcaaaggagtccaacaacacgatgcctgtgcactcattgaggaataatctcagtgcagcaatctctcggttcagagatgaccaaaaatgctccaggaacagtcatgcttaatattgactgtttgttgttttatttttattttttgactgtcctagattgtttattaggtatgaattttataaactttagttataccagtggtaacggtggagctggagagtattgtgccttctccaagcttcaggggaagaaccaccaatagtgtggtggaacttatggccctttccaaggccatggctctttcagcctgcaggtgtcagcccatgcatttccctgtgcttgtggactggtttggtgatccactgggtgtcaagatttcttctgatagctttatggaatggatcaatgaggataacatcaaaaaatgtttatgtggaatcttcatcaacccagtaagaattcaggactcttagagccccacagtggcatccagcttgctgctctgcaaaggactgaaggctttgagcaaactttacaaatatatatatataatattatatataacatagataacatataatattatatataacatagataacatataatattatatataacatagataacatataatattatatataacatagataacatataatattatatataacatagataacatatattatatataacatagataacatataatattatatataacatagataacatataatattatatataacatagataacatataatattatatataacatagataacatataatattatatataacatagataacatataatattatatataacatagataacatataatattatatataacatagataacatataatatatataacatagataacatataatatatataacatatataacatataatatatataacatataacataatattatatatcatataacatatataacatatataatattatatataacatataatattatatataacatatataatatatataacatatataatatatataacatataatgtatataacatatataacatatataaatatataacatatataacatatataacatatataatatatataacatatataatattatataacatatataatattatatataacatatataatatatataacatatataatattatatataacatataatattatatataacatatataatatatataacatatataatatatataacatatataatatatataacatatataatattatatataacatatataatatatataacatatataatatataacacattatatatgttatataatattatataacatatataatatataacacattatatatgttatatatattatatataacatatataatatgtatattttatatatatctttctcccccacaagaacacatattcaaagagtaagttgcatgtaataataatagaatacagcatccagatccttgaaataaaaaaatgaaaaatataacactggtgaatattagcttcagtttctaaaattgaaagccaagcagggaaagtaaattttttttcttattaaagtatgaaggtcacaaaattaacaactcacaaaagagaggctgatgtatagccaattagcgcacaagagacagatggataaaccagacacaaactgttaaagggcctggcaatcacatcctctgagtgattacagacctaggcaagggccatgggaggccacgtaacgaccagagttatgactaatggatcttgagtcagaatgggagagctagttttatattttctaaataccatttctgctcacgttagctagaggtggcttcttcacatttaataaccaagaactctgatttatcaaacaatctttagcacatggtgggtacttactgccttgggaatggctgaaatattccaggcgtaggagttaaagaatgacttgggtgaacagagggataacagttttttgtgtttctattgggagatgcttgaaggatgaataaaagaaacaaggagaagttgatagcactgaggaaaaagggtaattgatagatcaaaacccctgaggagataagaagtgatgagaatcagagcacagttgtggggctggcctgagcctgtgaggagggagtggagacatctcttcctctgagacaggtaggaaggaggaagggatacaggagtacattagtaaatgcatctccctgaagaggctgaggttgcctgcagagagtgaacagaatgggcaatactggggaagaattatccctagcgggctttttgcaggttccacattgaaggacagtaggtgataggagtttattaagaggatgcatagggtacaatgtggaatacaataatgaatcattattcatttattttgtttgttttaaagccctgagcttaattttctatattaattcattcaaaatattaattgtctgtatcacatgacaggcattgttgtgggtgctggggatatggcagtgaacagcacaaaagttgtttctgcttgtggaggtcacatttcagtgagacgaaaacaacaaagtgtgtgtgtgcatccctgccccccctcccccaccgtggcactgagtcacccggggagctgaactctcctttgcctctacagccagcacatgaaatgcagctcaaagccacttgaaagcactcacttggtaacaggctgctccctagtgtggcagacaccactggtgccctactcagcatccattctccttttcttccttactaatacaaccctgattttattggcagaggcaatgtgcccagctaaaaggtattttccagccttccatgccaaataggagtgactgtatgacagtttaggccaatgggagataaacagaaatggttggatagggctttttggagctaattaaatggggatgcagactcggctggcatgcccattgtccctttgcccttccttcttccagcttcttgcaatgcagccatgatggctggagttgagaagccctctcaaaactcttgagggcagctgggcacagtggctcacacctgtaatcccagtgctttgggaggccgtggcgagctgattgcttgagctcaggagtctgagaccatcctgggcaaaatggtgaaacccggtctctacaaaaaatacaaaaattagccgagcttgatggcatgagcatgtagtcccagctacttggggtgttgaggtggaagaatcgcttgatgcctgggaggtggaggttgcagtgagccgagatcacgccactgcactccagcctggatgacagagtgagactctgtctccccgcgcccccaccgcccccccaaaaaaaacttctcaggaaaaggccaagagaatttcagagacctctaccctgtatcttaaagtcactgagccaagtcacttatttggatttctcattatgtgagaacaagcagaggtatcttgtttaaggcattgctatttaatatttgcattttctgttatatgcagccaagcttaagccatacttgagatgcaaagaatcagccgtgtttgttacctgtggcagccatgagaatggcttctcaaatctctgactgcaggaagtataattaaccaaggactccagctgctgcctctgaaatgcatcactgcatttatgccaaggccagattttccatggactgctcccggctaatgactgagcatggatgggatactaaggcagtctcattcttgggagaagggtgaaagatgggtgactttaagtgaggatgccgcagtggacttgctgaaaactttccttagagctgcactgcagtttaagaggtgtccattaacttctttccttccctctcttctgcactcaagagtcagacttctatcatgctctgatgtctctcccaacctttcttagctccctcctcattctctctctctttttaaaatagagatgggcactttgggaagccgagttgggtggatcacttgaagcctggagttcaagaccagcctggccaacatggcaaaaccccatctctactaaaaatacaaaaattagctgggcatggtggggctcgcctgtaatcccagcaactcgggaggctggggaacgagaatcgcttgaacccaaaaggcggaggttgcagtgagctgagatcacgccagtgcactctagcctggatgagagagtgagactttgtctcaaaataaataaaataaaataaaataaataaaatagagattggatcttgctatggctaaatagagattggatcttgcccaggctaatatggaactcctgcctcaagcaatcctgcctcagcctgtcagtgttgggaatacaagtatgagccaccatgcccagcccctcctcattttctctaacagttggtttcctaataaatttcttgcatatttaattttattctgggatcccaccttctctgaggacctggactaacacatccccaaatctgtttatgcctgttgcaggtgctactgtaattacataatttaactaagccataactaaaccatagaaatatggacacagaaggaaagtgagttgttatttctatgaaaaccaagtagactgctttagaaagttttgaaaagggtatttgcttaaaagaaaaaaaaaagctgttcacaaaaagacaaacgaggtctttttacaaaaagacaaataagggtgtggtggctcattcctgtaatcctaagactttgggaggctgaagcgggcagatcatttaagctaaggagttcaagaccagcctgggcaacatggcgaaaccccatctccacaaaaatacaaaaatttgctgggtgtggtggagtgagcatgtagtcccagctactcaggaggctggggtgtgaggatcgcttgagcccaggagatttcagctgcagtgagccgtgattgtgctactgcactccagcctgggcaacagtgcaagggactggagggagggagaaatgggagttgtttaatggatatggagtttcagttttgcaggatgaaaaagttgtggagatctgttgtaaaacaatgtgaatatacttaatactactgaatcatacacttaaaaatggttaagatggtacgtttggcacacctgtactctcagcactttggaaggataaggcaggagctcaggagtttgagaccagcctgggcaacctgcagtgagccatgataatgcctctacactccagcctgggcaacaagagcaagaccctgtctttaaaataaaataaaataaaataaaataaaaataggctgggcgcggtggctcatgcctgtaatcccagcactttgggaggccgaggcaggcagatcacctgaggtcaggagtttgagaccagcctgcccaacatggtgaaaccccatctctactgaaaatacaaaaatttgccaggtgtggtggtgggtgcctgtaatcccagctacttgggaggctgaggctggagaatcgcttgaacccgggaggtggaggttgcagtgagccaagatggcgccactgcactccagcctaggcgacagagcaagactgcatctcaaaaaacaaaaacaggccgggtgcggtggctcacgcctgtaatcccggcactttgggaggcctaggcaggcagatcacgaggtcaggagatcgacactatcttggctaacatggtgaaaccccatctccactaaaaatacaaaaatttagccaggcgtggtggtgtgcgcctgcagtcccaactactcgggaggctgtggcaggagaatggcgtgaacccgggaggcggagcttgcagttagccgagattgcgccactgtactccagcctgggcgacagagtgagactccatctcaaacaaacaaacaaaaaacaaaaattagctgggtgtggtggcacgtgcctgtaatcccatctactcaggaggctgaggtaggagaatcgcttgaactcaggaggtagaggttgcactgagccgagattacaccactgcactccagcagcctgggcgacagagcgagactccatctcaaaaaaaaaaaaaaaaaaaaaaaagtaaaacataaaaacttacaaagtagctgtttggtttggaaagactaccggaaaaggttggggaaacgctatagtaacccgagtctgcactcacactggatcttgagtgtagatccagtagaaggaaaaggaaggcagggcaaagggatgttccagggatcaggaggaagctgataaagagaccatttgaggattgagaaatggtgttcttcaaggccattctcagtcttgctttgcaagcatcctaaagcacttaggcactttataggatgtggaaatctagacaatttgtcatgggtattgttatgcaagaaaagaaatacgccaggaggctgaggcagggggattacttgaacctaggagtttgacacggcagtgagctatgattgcaccactgcactccagcctggatgacagaacaagaccccatctcaagaaaaaaaaaaaaaaaaagggccagatgtggtggctcatgcttgtaatcccagcactttgggaggccgaggcgggtggatcacctgaggttgggagtttgagaccagcctgaccaacatggagaaaccctgtctctactaaaaacacaaaattagccgggcatagtgccgcatgcctgtaatcccagtcactcaggaggctgaggcaggagaatcgcttgaacctgggaggcggagactccagcctgggcgacaagagcgaaactccgtctcaaaaaaaaaaaaaaagacaagtgcagtggctcatgtctgtaatttcagcactttgggaggccaaggccgtagaattgcttgagcccagtagttcaagacgctggagtgagaccccctctctataaaaaataaaaacttggtcaggcatggtggcggcacccctaggctcagctactcaggatgctgaggtgggaggattgcttgagcctgggagttcgaggctccagtgagccatggtcctgccactccagcctgggcaacagagggagaccctctcaaaaaaaaaaaaaaagaaagaaatacggaattccaatcagcaaacccgtactcaaagaaaaagccttggcgttacatcaaaagattggcgagttagtatatatttctatgttttaccttaaagcaaaatgtacaaatacatataacttttttttaggccagtcaagtgaggcagtgggagtggagaaggaaacaaagaaatctgtaactagttataatcaaatacttgtaaacaccactgcactcggaccagcccacatatcttttttgttgttgttgttgaaacagagtctcgctctgtcacccaggctggagttcagtggcttgttctttgctcactgcaagctccacctcccgggttctcctgcctcagcctcccaagtagctgggactacaggcgcctgccaccacgcccggctaattttttgtatttttagtaagagacgggggtttcactgtgtgagccaggatggtctcaatctcctgacctcgtgatccgcctgcctcggactcacatatcatttttaatgatccttttaaacttactgtttttttttttgtttaattgaccaacttctggtctcaattgcatcaaataagaaagcttctactgaaataatagtaagtgtgaattgctttattgtgtaattactatacatctgggtgaaaagtctcgagtgtcaagtgtcagtccagtagaagaaaggcagggaggagggacgttccaggaatcaggaggaagtcaataataaacagagactaagtgaggggttggagaccggtgttcttcaaggtggaaggacatgcatgggggtattgagagggctggaacaagaggaggctgtagtcaagaagcaagagaggaaactgtgattcagtgggtgaaacagtttttggtgatgacaaacctctgttgaggccaggggagcaggtgggtgactgaaggagagacaaaggtcaccagagttgaggaggaatcacaaaccccgggtattgggtgagtcatcctatgaactcagaagtctactagactggcagcaagattgggcttggagaggaaattgggggcaggtgtccaagcagtagtgtggtagaagcagcttgtatagggtcaggaaaaccaactgttaaattttcaattttgtgggcttgttgttacacattgtcattattaaaatgtaattataaaggccaggtgcagttgttcatgcctgtaatcctggcactttgagaggccaaggcaagcagatctcttgagcccacaagtttgagaccagcctgggcaacatagtgaagcccaacctctacaacaacaacaacaaccaaaacaaaacaaaaaaaaaaaaacaaaattagccgaatgtggtggtgggcactgtaatcccagctactcaggaggttgaggtgggaggatcgctttagcctgggaggcggaggttgcagtgaactgagatcacgtcactgccctccaacttgggtaacaaagtgagaccctgtctcaaaaaaaaaaaaagtaattatataaacttacaattaagtaaagtatattaaaacaaaggtaatgaaaattcaaaactcattactttctaataactttcctacatcttactactattcatgctcttggagttaatttctgcttcttgcatctgtatggtggaaatactgtataatggtgtgctatggtgcatctctgcccagctctgcattcagtggcatcgtgttattaactcaaaatcagctccggtggaaatatttacgccatggaaattagccaacactacagatacagagcttgagttactgagttttttttttttttgagacagagtttcgctctgtcgtccaagttggagtgcagtggcgcaatctcagctcactgaaacctccacctcctgggttcaagtgattctcctgcctcagcttcctgagtagctgggactataggcgtgcatcaccatgcccggctaatttttttgtatttttagtagagacggggtttcaccgtgttagccaggatggtctgtatctcctgacctcatgatccacctgcctcggcctcccatagtgctgggattacaggcatgagcccctgtgcccggcccactgagttattgttttgtgaaatacctatactcattcatcaactgcaatcatagatatgagttcagcaaaaaacgacagcattctgtgagaatcaattggttatatggaatttacaataaagggagttgtatattatgtgtaagttctgtgttaagcatcctttctatcagtaaaatttatagtaaatatatttgcacattatatatatatacacatatatatgtaaatacacacacacacacacacatacacacacacatttttccctaaagagctggttgttaaacatttacaaacacatcactcagctaaggactcctttcccggagactggcattggggtgatggtaagcaataccatcatggtggggctgattctccttcctgcccctgagctcacatctcacggggagtcaggaaccgaggtaacaatacagcactgggtggcagggagggaaggaactgagaccaagtagaggtagggaggtgttcaaagcaagtgagatttatgtagacactcaaaggatgagtaggaatcagccagccaaaggaaaaacatgagcaaaggcccagctgtcgtcagaaacaatgggaggcaggctgggtgcggtggctcatgcctgtaatcgcagcactttgggaactgaggcagatggatcaccaaaggtcaggagttcaagacaagcctggtcaacatggcaaaatgctgtctctactattaacacaaaaattagccaggcatggtagtgcacgcctgtaattccatctacttgggaggctgaggcacgagattcacttgaacccaggaggcagaggctgcagtgagccaagatcatatcactgcactccagtctgggcaacagagcgagcctccatctcaaaaacaaaaacaaaaacaaaaacaaaccaaaaacaaaacaaaacaaaaaacccacaacaggttatgatgtgcctgagggcagtggccatgggttgctcctcctggagcacctggagagtggagaaagagcagcctgtactggaaagggttttctgaaccctcgatctaagaagagtaaacatttctggacaaagggacaaagatgggagtcaggtgatgggaagagagggtattctaggcagaaggaaccgcatgagcaaaagcaaggaggtgaaagagaatctgaatacatagatctgcaggcagttctgggtggctggagtgcctgtcggggagagtgtgcaaaagacaaggctggagaagtggccgtggctgaggccaggagggctgagagccaagcccaggagagggtgtgagttcttaggagctgtggggagccttaggaggggcctgagtagggagtgacatgattaagatccccgcggctgcttgaaggagaatggcttcagtgggtgtcaggtagggaaagactggagaatgtgatacttttgggaagatactgcagtcacgtaggtgagagatgatgaaataaggtagtggatgtggagaaggaaaaaaggaaaattgattccaaagatatgggggagcggaattgaaaggacttaacttcaaggagtctggcatgggtgattgagggctgatgcagtcgttttcgaagagcactgatccgttattttgtagaatgtccctccactggagtttgtctgatgttttctcatgattagactgagtttggccgggcatggtggctcacgcctttaatcccaacactgtgggaggccgaggtgggcagatcacttgaggtcagaagttcgagaccagcctggccaacgtggtgaaaccccatctctactaaaaatacaaaaattatctgggcatggtggtgggctcctataatcccaggtacttgggaggctgaggcaggagaatcacttgaacccaggaggtggaggttgcagtgagccaagattataccactgcactccagtctgatgacaaagtgagactctgtcaaaaaaaaaaaaaaaaagattgaggttacacattttatgcacaaatatcacacagatcagtgaatcctactaggaggtacatgatatacccatgtcttattactgatgatagagtcatctttgggggcagggtcacagaaggaggtacacttatagggaaaagacctagcgttctggtttgggatggggctggagtgcagaagagaatccagatcagagacacggctttgggaacactcagcaccacggaggtagctgaggacttgggagggggggcaaggttgccagggcagagggtgtcagaaggaagagaaacagtggaagtggaagcaagactggctttgcattgtatccaagtggtcaggtgggcgaggatgggaatgcgtcctgtggatttggtatccagaggcttggccagtgctggggttagtgctcaccagggccaggcccaggctgggacttgtggagggcattttttctttctgggcagttaattggagcagatttggatgggcactcctggccgtgtgtgtttttttgtttttgtttttgttgttgttgtttgtttttttaagacagggtcttactctgttgcccaggcttgagtgcagtgcacgatcatggctcactgcacccttgacctccctggctcaagtgatcctcccccttcagcctcccgagtagctgggactacaggtgtgcaccaccacacccagctaatttttgtatttttagtagagatggggtttgccatgttgcccaggctggtctcgaactcctgggctcaagtgatccaccaacctaggcctcccaaagtcctgggattacaggtgtgagccactgagcccagctcactacttctgatttaactcaacccatgagaagtgggcagtgttctggattctgtgttaagaactcctggctaagctgcaagaggtgacaatgaaattggcttgtgtgcaggccagcaggctgcctagcccccagcacttccagctgtggacagagccacctagctggtggagaactaactctgtgggcgtgggtgcccccaggtgttcaattggaggccctgctgttggaagggaagcagtgaagggtggccatttgtaaatctttggagaaatttctattcagatcctttgtgcatttttaagtggattatttgtctttttattattgagttgtaagaattcttcgtatattctaaatgcaagtctttttttagatatattgcaagaggtagaaggtggggtccttattccctagactcaggctgccccagggatccacatatatatattttgagacagggtctcactctatcacccaggctggagtgcggtggtgtcatcacagctcactgcagtcttgactgctggggctcaagcgatcctcccacctcagcttcccagtagctgggagtactggcatgtggcaccatgccagaatgatttttttttttttttgtagagatggggtttcaccatgttgcccaggctcatcctgaattcttgggctcaagtgatctgcttgcctcaacctcccaaagtgctgggctttcaggcatgagccacatcacctggcctccccccaatttttaaaaatgacattactttactgagttctagttcacatacaataaattgcacctatcttaagttttcagtttgatgagttctgttttttttttttttttttgagccaagtcttgctctgtcacctaggctagagtgcagtggtacgaccttggctcaccacaacctctgcctcctggggtcaaacaattctcttgcctcagccttccaaatagctgggattacaggtgtctgccaccacagccagctaatttttgtatttgtagtagacatagggtttcaccatgttggtcaagctgctctcgaactcctgacctcaggtgatccacctgcctcagcctcccaaagtgctgggattacaggcatgagccaccatgcccagctgagttctgataatttcatacagttgtaactatcaccctaaacaagatctagaatttttttttttttgagacggagtctcgctctgtcacccaggctggagtgcagtggcacgatctcagctcactgcgacctctgcctcccaggttcaagtggtccctctcagtctcccaagtagctgggagtacaggtgcacgtcaccacacctggctaatttttgtattttcagtagagatggggtttcaccatgttagccaggctggtctcaaactcctagcctcaagcaatcagcctgcctcggcctcccacaatgttgggattacaggcatgagccaccgcacccagccaagatcaagaatatttctatcaccccccactctccccacaacttttatttttgcccctttccattcaatccacacacctccccaaccagcaaccactattctgacttccatcacattaattttcctgttcttgaactttatataagtggaatcatatagtttgcatttttttggtctggcttattttgctcaacataatgttttgagatttatccatgtgctgtatcagcagtttattcattttaattgttaagtcatattccattgtatgaatatgcaatgatttctctattcattctgttgttgatggttgtttccagtttttagctactaggaataaaatcataataaatattcttggccattttgtgaatatgttttcatttctcttgggtatatacctaggagtagaattgcagggtcaaatgataacttgtttaaaaatgtttaaattttggccgggcgtggtggctcactcctgtaatcccagccctttgggaggctgaggcgggcggatcacgagatcaggagatcgagaccatcttggctaacacggagaaaccccgtctctactaaaaatacaaaaaattagccgggcgtggtggtgggcgcctgtagtcccagctactcaggaggctgaggcaggagaatggcgtgaacccgggaggcagaggttgcagtgagctgagatagcgccactgtactccagcctgggcgacagagcgagactccatctcaaaaaaaaaaaagtttaaattttttagcaactgccaaactgttttcccaagtggctgcactatcttactttctaccagcagtgtatgaaagttctgatttccctacatccctgaaaatatttattattatctatcttttaaattatagtaatcctagtacatatagagtggtatctcattgtggttttgatttgcatttccctgatgactaataatgttgaacatgttttcacatgattattggccatttgtaaatcttctttggagaaatttcttttcagatcttttgtacatttttaagtgggttatttgtctttttattattgagttgtaagaattcttcatatattctgggcgcaagtctcttttcatatatatgatttgcaagtatcttcttgcaatctgtggattgtcttggggagcttccagtctgtttgggcgagaagggacaaacacagggacagggcagtgtggagcagtgtaaggaggagaagcactgttcagggaggtctagggtgagctctctgagcctcagggttgctcactgctggatgagctgatctgacatttctgtggctctgtagcaagtatgtgtgtccctgtatgctcggtgctgtgcaatcaagcacacatgctaagtgtcagggaggtggcatctcacaagaccaggagcatgggggagactgggggaagcaggaagttctttctcttctttctttctcttctttctttctttttttctctttctctctctttctttctttctttctttctttctttctttctttctttctttctttctttctttctttctttctttctttctttctttctttctttctttctttctttctttctttctttctttctttctttctttctttctttctttctttctttctttctttctttctttctttctttctttcttttttggcagggtctcactttgttgcccaggctggagtgcagtggttgaagaacatggtttactgtagcctcaatatctcaggcttaatgtggtccttccacctcagcctcccaactaaccaagactacaggagcatgctaccatgtcaagctaatttaaaaaactttttttttttctttgagatgaagtctcactcttgtcccccaggctggagtgcaatggcacaatctcggctcactgcaacctctgctttccgggttcaagcgatttccctgcttcagcctcccaagtagctgggattacaggcgcccgccaccacacccggctaatttttgtatctttagtagagacggggttttaccatgttggccaggctagtctcgaactcctgacctcaggtgatccacccaccttggcttcccaaagtgttgggattacaggcatgagccaccgcgccagtcaggggaggctctttgttaagaaagaagactccatattgtaaacttccacaggactaacagcatggatgataacgtgattaacaggattatcatggaggtgacataagatggctcaggagccaggctgatgggtttaggtcctggctgtggtagatgtcacaacacagtgcccttcccatacccctttagccactcctgatgtttttttactataagcccctgggattttctgcctgagggtgctctctgctcagaaggcactccggcaggctggaggtgccaggaacagctctcaactaatgaagaaatcatcagtgtcatcactccttcagtgggatgagtaccttgtcttcttcactctcccagagatgcccaatacagtcaagccccatttgtccacagtggtaatctgctgattattgcaccctatattgcttttcttcatttgtttgtttcactccccctctctcctactagtgctccacggaatcatctctcaaatggaccatttatatgaacatccttatctcagtgtctgcctctggggatacccagcctaaagatagtggttcttttatttcttagatctatccatccaatttccttgggcagatcactttacctctctgaatttcacttggctcatctatagaatatggatagtatcacttctttctttctttctttttttttttttttgagaccgagtctcgctctgtcgcccaggctggagtgcagtggcgggatctcggctcactgcaagctccgcctcctgggttcatgccattctcctgcctcagcctcccagcagctgggactacaggcacacgctctcatgctcggctaattttttgtattttcagtagagaccgggtttcaccgtattagccaggatggtctcgatctcttgaccttgtgattcacccgccttggcctcccaaagtgctgggattagaggtgtgagccactgcgcccggcccaatagcacttatttcttaggatggtcatgcagtttagcatttcactcagacattaaaagttcagtaaatacttctatttttattcgtttactggcctgtaacataaatattctcccagagactcttggatggacatgcctcattcaggcatagctaggcagggaaagataagcagcctggagctggccctgtgggacattgattgattgggttcctgttcccagttacttgctccctctgcaatgggattaaatgtccccaccatttgtcatgtgacttatctggcatcctgtatgggtagcatacctccctgacccccatgaattaattttgggcttacccatgtgacttgctttgagtaatggcatatgagcagatgtgacattctccacatctgcaaagaagcttgaaatgtgttactgcatggtttggcacaggctctctcacccctgccctccactacaacaaagacatgtctccagtgcctgccacgcagtttgagctagcacctttaaatactttatttatttatttttttgagaggaagtcttggtctgtcgcctaggctggagtgcagtggcgtcatctaggctcactgcaacctccacctcctgggttcaagggattcttgtgcctcagcctcctgagtagctgggattacaggtgcacaccaccatggctggctatttctgtatttttagcagagatgaagtttcaccatgttggccaggctggtctcgaactcctgacctcaagtgattcgcctgccttggcctcccaaagtgctgggattataggcgtgacccaccgtgcctggcttaaatactttatttttaatttttaaaaattgttttatccatctatttacagatcattaaatacttactgtgtaccaggcagtcccatatgttacatgtgtctgcatgtattaattcatttcatccttgcaggaaccctaagacacgggtcccattatcaccatccttattttacatatgtggaaaactaaggttcagtgaggattagtaccttctcaaattcacactgcagggaaggggcaaggtctgccttctaggttgatattcttaaccactgctgtatgcttcttctcatggtaggtaaccagcaaatgcctattaagtaaacgtttgtttaagtgatcattgttcccttccatttacctgaataggaaaggtacaatctactgggacaaaggtgggcttctgactttggacctgctcactcttcctacgttagttgtttatcaaataggagacccttctgattcttctgagtggagaaaaattgtccgtggtcatcagacgggaaccccaatatttcccttgtaggacctacatgaaccacaagatatctcctataaattccatgtggtttccagacatcttccttgtggatcccagtgtggacctcagatctctctcctaaaggcctatgtgaacccctatatctttcctgaggcccacatggactcccaacattttccctgtagcagccacacttgataacttcgacaggttcccagttgtcatctcattggctgctctccacagctctgtaaatcagccttggcttgcattatagcagggagagacagcatgtgggtcaaccagggacaggactgacacagaacccagttgtcctgccccgaagcccaggacccttccttcctggttggcctggtggcaggatgatgcttcctgctcagcccttcccaggcaccgaggctctctccctccttttcccctctgccacactagttcttgtctgccttttttcactgccacccccttttcatgccagctgtgggagtgaggccccactcctggcaggatggagccagacaatgggcccttattctaggcaaagaatccctgcagtgtctcccacccactgaggcccccttccaggcctaggatggtgtgggtggggggtggagggtgggtgtatggtgtaggggaaggagcaattggctggcaggacagacagtggccctggccctgcctgtagagatcccacggaggtttactatgtaaacaccaatcacaataaaatcctgtcttcactcccagcccatctctccaagtgggtctctctcaaccctccaaagctctgggtttttaaacatttacccttgcctctactctctcttggtattcatctctgcatatcactgtctctttcattcctttttctgagtctctttctttttctaagcctctcctctctctctctctctctctctgctcctttgcgtaatttgtctctatttcttgcctctttcttgcttcattatgctcccttacctatcttatctttccatgtcttttttctctccaggccttgagctctcatctcagtctctctctccgtgtgtctctgtctctgtttgcagctcttctttctcgtcctcctatgtcgtctttccgtggatctgtgtccttgcctctctgaatatcatctccgatcttccgtcctctgttctctctttccccctgcgcctgcagatctgaaggaccttccgcagtcaccacactctcctgctttcagctctttctcactcctttctggcacgtcccagaggctcctggcataggtataggaggttattctccccagtttacagatatggaagctgaggctctggctgctggtgccaggctcccatctctgggtctcttccttccacctacacgccaggctcttgtccctgaggtgcccgtcaaccacctgatccggccggggcccgggaactagcacctcggacagctcctggaagatgccggggcggccgggtcgtccttctcgcgagctcaggaggagcagccttaggagcagagcggaagtctcgcgagagtgactgctgcaggcagtggcggcgcgggcgcgcgcagagacggcctcgggcgcgcgcgcgcgcgcgcgcgctccccgcccccagccccggagcggctcgcggccggctccgcgccgcatcgctcgggtgcagcgcagctcagcgcagcgctgcggcctttcggcagccgaacggccgcggcaggtgagtctgggcatgaaggctgggaggagagctttgaagggaagctgggcgcggggcgagaggtgtgggggtcgctggctgcagctttgttcctcctacacttcacctttggatgcaggaagaaggccgaactgctggagaggtgggagtggaggtgacctttactgtttggggctgggggagagcgctcagggcgcacccaggccccccgagccccccaagcccccccattcccatctgtggctcccgcagagggaactgggcctttgggtgacgtcagaccctggatctggagcctgagctttgggccctccatcccccccgccagccccacctggcgttccctggaaaccggccttctggagatggcgtgcgcagccggggatgggggcgactggaagggggtgcccgtggcttcctttgggcctttccttccaactagcgcctgcaggtggacccgggttgacttccctcacctccctcgggcggccgacctttggatggcggacctcagccgccccagggttgcgaggcgacgggcgcgctggcccaggccaccaggcgggctccatcagggctttgggtggtgagttgggggcgccggatttggctcatttcaacgctggccggaggtcacgaggatggaggtgaggtgtttgtgaaccgatccttgtcctccgcctcggggagctcctggtctgtgggttgggggaaccaagtagagactcggactgagcattcactgtcacaggcggcttaaacaagtaatgtcccagcttcccgatggggagatcagtgagggcctggcagactttcccagggacacagagagaaagggaggcgacagctagcgaataggagacttccagaggtgatgggatttgggtgggaggagaggcaagagagggcattccaggagaatgtatgggcaaaggcacagggatgaaaacgagcacagctgttgggggctgagcctgggagctcagccatgtgactgcccatggggtggtggagtctggagaaatttgcaacctgtcccctacatgttctgcctcacggagcagggctctgaaagagggagatggttcttgcaggggcatgattggcagagagattttgtttggggctacacaggtcttgctaacttaggtttgttctgggcttggtgagccttagggcaaagtctctagagctgagagggggctgtctctggtgaatgggcccctgaaagagggtcttaggtttagcaaaccccttggagagttagtggggtcccaggaggggagttctagagagagaccttgggctctgtggctgtttctttaaccgtttcctgagtggccacctccaagcaagttccccaagtcacctcccctctctgggcatctctttctagcacctttctctagagatgaaataataggactaagtagtgacctcccttgaggatgctccttgttctagtttagagcatcccccctttcttctccctcttccttttcctttcctcccctatccctctgcctccctgtccctatccccaccccttgccccccacagcatttcctttacaggctgcacttccttccctgctgccagccaggagtttcggaaggtttcctggaggaagtgtgatacagcaggtttgacagcagctttgggcttaatctgattgggggagggcgttaattgcctccctcccacccattgggaaagtgtccaagtcttaagcaagtatatggattgactgtgctctgtgctgggtccctcctggaaactccatccaggagggagtgaggagattatgggagaagacgtgaacacttagtgcccaatgactgactcaaaatgtatgcagcgggatgcagagcagcgatttttggaaaggcttcccagaaggggtgggatgtgagaaggtagcaggacttagaggagctgatagtgctgccaatttaggggcactggaagcagagggggcggctagagatgatctcctgcatgaggctgggagtgtaggaggcaggtcaacctgtgagcagccaaaggtggtgggagggaggtttgtagctgactggcacaaagccttgaatgccaggcaaagatctgtaggaggctactgaatagtcatcagtaggacagggacagcatggccaggagactgctgttttctgaggattattcatagttctgggatttcagggcagaagatggggctaggagtgggatgaggggattggaggtagagcaggagggggaaacttccatcttagcaggttggctctgggcagcaaaaaggaatcaccatttctgtgccagggatgaggggcccatactggtgagcagggagccctggagttagccccaggactctggcctgatctgaagccaggcttgaccctcgtctgctgccagaggcctcagtctccccactgtgggggcttctgtcctagcttcacaataaggaatggaatacattatagttagggtttcatgaacaaaattcaggtagtaactgctatcttattgataattaaggtgtttccctaggcctacatctttggagggatatgtagcccttatccccattataaaagattatcagttgagcagattgctaattcttctgttttgtagtctaagaactttggtttggccggcgcggtggctcatgcctgtaatcccagcacttggggaggccgaggcgggtggatcacctgaggtcaggagttcgagaccagcctggccaacatggtgaaaccgtgtctctagtaaaaatacaaaaattagccaggcatggtggtgcacgcctgtaatcccagttactagggaagctgaggcaggagaatagttcgaacttgggtggaggaggttgtagttagctgagatcgtgccactgcactccagcctgggcaacagagtgaaactccatctcaaaaaaaaaaaaaaaaagaactttggtttgcagaggccagtgattgctgtcttcccctccaaccccccaccccccatttcaaaggcttcccagaaacaagggcagagaagcctggagccttccatttctgtgaccctagtcttttaccaccctctcaagccccagattctctctgccctaacctttatatacaaacaaggcagctttgccctctgctctggtttctgctctgaattattcatactttgctgcactgacttctctggaactgtaagcagacttttgggagattgtctgggaccagggacaggggttaggctggagcccggttagggagaagactcctcctttgaggcccctatgttctagttgttttctcctctccctctgcttccttgttttcctggaggtctttagtgctggaccacagtctcccactccatgtcccattgtctcaggggaggtagtgcctctttcagtcaccattttaaccaactacatctgaatgtggtcctcattggcatgtggccacctctgaaatcttaaactctagtatttctctctgaccacagtctaactaatgctttatgtgctctgacctcaaggagacctctagttctcagacacctccattttctccatctcatgaattgcctcttccgtgttctttctgaactccatgccctcaaccactttgccactttgcctgtgtgtcacccgagctgccaggaagggtctccagtctcagccatcccttcatcacttatagaaacccctctcctcattcccatcagttcccctttctattccatgggaggagtattccaaactggactactctccccaggccctttgctcatgtagagggtggttggggtgtgtgtgggggaggtggaaccacccccatgttttcccgaggcggagcttgcagtgagccgagatcgcaccactgccctccagcctgggcgacagagcgagactccatctcaaaacaaaaacaaaaacaaaaacaaaccaaacaaaaacaaaaataaaaaaacacaaaagttagccaggcatggtggtgcgcacctgtagtcccagctactcgggaggctgaggcaggggaattgcttgaacccaggagacggaggttgcagtgggccgagatcgcgccactgcactccagcctgctgacagagagagacgctgtctcaaaaataaataaataaaataaaacacttcctgattgccatatcaacttgtcacctgactgcttcatggccatggatattgttgacccagtcgaccagtcattaaaaagattgagatagatctgtattcattaacatgaaaaactttcacgagatattgttgagtggaaaaaaacaggttataaaacaggatgtgtggaatgatctcatttttgtcatatatgattctatatacgttaaaaatgaaagccaacaaaatccaccaaacctaaagatcagactgttaaaggggtggcatctgagaaagtggattttgggaagacttttctactttatgcacttagattttttttttaattgcatatatttttacagatagctaaaaagcaacatattaattaactaattagtttagagatgaggtctcactatgttgtccaggctgtagtgcagtgactattcacaggtgcaatcatagctcattgtagcatccaactcctgggctcacaatcctcccacctcagcctcctgagtagctgggactacaggcacatgccaccgggctaggcatatttaaaaaacctttaaggccatttttttttttgagagggagtcttgttctgtcccccaggctggagtgcagtggcacaatctcggctcactgcaagctctgcctcctgggttcatgccattctcctgcctcagcatcccgagtagctgggactacgggcccgccaccaagcctggctaattttttgtattttttaagtagagacgaggtttcaccgtgttagccaggatggtctcaatttcctgacctcgtgatccgcccacctcggcctcccagagtgctaggattacaggcgtgagccatcgcacccagcctttttttttttttttttttgaagagaagaagaataaaatccttcagtggctcccgtgacactgaggacaaagtccaaatactgcccatggtcttcaaggccaggatgacctagccccatttacctttcaactccattttgcctttcctttgctcccttcactttgagattcatccttcctctgcctctttcgttccttaagtatgccgtgctattgctcttctgactttcacacctgctttcctgattctctttccctggccaactccctattccttgttaaaaattcagctccaggccgggcgcggtggctcacgcctgtaatcccagcactttgggaggctgaggcgggcggatcacgaggtcaggagatcgatactagccgagaccatcctggctaacacggtgaaaccccgtctctactaaaagtacaaaaacaaaattagccgggggtggtggcgggtgtctgtagtcccagctactcgggaggctgaggcgggagaatggcgtgaacccgggaggcggagcttgcaagtgagccgagatcgcgtcactgcactccagcctgggcgacacagcgagactccaaaaaaaaaaaaaaaaaaaaaagattcagatccaatatctatgaagccatccttgactcctgtaagacagaccagggaggtgttctgtgttaccacagctttctgagtctgctctcccagagtgctcaggctgtgtcagaattgctccttgatttagctgggtcctgtacgcttatctcctccctctcaccttcatcttgtctcctctatcacagagaaaattgggctaggtgcagtggctcatatctgtaatcccagcactttgggaggctgaggcgggtggatctcttgagtccaggagttcaagacaaacctaggcggccaggcaccctggctcatggctgtaatcccagcactttgggaggttgaggtgggtggatcacgaggtcaggagttggacaccagcctggccaacgtggtgaaaccccgtctctattaaagatacaaaaaatttgccaggtgcgatggcacgtgcctgtaattccagctactcgggatgctgaggcaggagaatcgcttgaacccaggaggcggaggttgcagtgagctgagatcatgccattgcactccagcctgggcaacagggcaagactcggtctcaaaaaaaaaaaaaaaaaaaaaaaaaaaaagagactaacctgggcaacatggtgaaaccccatctctaccaataaacaaaacaaaaaattagctaggcatggtggcacgcatctgtagtcccagctacttgggtggctgaggtggaaggatggattgagtgtaggaggttgaggctgcagtgagctgtgattgcaccaccgcactccaggctgggcaatagagtgagaccctgtctcaaataaaaaataaaacaaaattgaatgcctgtgaaaataaaataataaaacagaaaattgaagcagacatccaagatgctctcactgcccatctaagacctcaaacctgcctgcatctgcttggatcctgttcggcttcccacctgttaggatcaaggcttgtccacctccttgcactggtgcccctgtgtctccctcttcacgggctttgtctatcaggtaacatctgtctctactgtaattgcaacctttctatgtatcctacacatctctggcttatttccacctaaaatgacccccagctgcagccctccctgggccctctccctacccccatatcctacccaggtggtaccctatctctattctctctgtatattgtcagccaggcttctttatcactgctgtcaccaccaaaacgattcttgctggattcacagctgactcgatgctgttagtgtcatgaacgcgttagtcccggtagtgccatcctttcacatgggagccctcagtggcattatcacatttgtccaatctctgcccctggctatggagactccacgctctctgggctttcctcgtgtctcatcagctgctccttctcattcttccccaactatcctattctgcttgccttttttttttctgcttaactttcttgactttttatttttttgaataggtagtgcatttatatatgatttacagttcacaaagatgttccaaattttgtcagttctaagatgaacattttgatatttctgaaaacattttcatgtctgtgttttaaaatttctggcatcttacagttacaaattggcatttttatttttattttttggagattgagtctggctctgtcactcaggctagagtgcagtgtggcacgatctcagctcactgcaacctctgcctcctgggctcaagcgattctcctgcctcagcctcctgtgtagctgggattacaggcgcacgccgtcacacccggcttatttttagtagagacagagtttcactgtgttggccaggctggtctcgaactcctgacctcaagtgatccgtccatctcggcctctcaaagtgctgggattacaggcgtgagccatggtgcccagcctgcaaattggcaatgttttttcttacttttggtcaataaaataatggtctgtcttaaaactgatgatgtcatcaattatatggaaatggtataaagttatatagtaaatattctgcttcccacctactctatatccattcagttcctttgttccccagagagccacaattaccatatttttttcttgatatccttccagagattctttgtgcatatattgtcaaatacagatatgtatatttccccccactttttattttgaaaaatttcaaagctacaaaaaagtttaaagaatagggcaatgggctgggcacagtgacctcatgcctgtaatctcagcacgttgggaagccagggcgggtagatcgcttgagcccaggggtttgagaacagcttgggcaatgtagcgagacctcgtctctacaaaaaataaaaaaattagctgggcatggtggcgcacacctgtattcccagctacttgggaagctgaggtgggaggattgcttgagcccaggagttcgaggctgcagtgagctatgattgcaccgctgcactccagcctgggtgacaaagtgagaccctatctaaaataaataaataaataaaataatgcagtgaacaactgtatacccttctcccatcaattattaacattttgcaacatttgctttatcttttatttttactttttttttttttgagatggagtttcgctcttgttgcccaggctgcagagcaatggcgtgatctccgctcaccgcaacctccgcttccggggttcaagcgattctcctgcgtcagcctcctgagtagctgggattacaggcatgcaccaccatgcccggctaattttgtatttttaatagagacagggtttctccatgttggtcaggctggtcttgaactcccgacctcaggtgatccgcccgcctcggtctcccaaagtgctggtattacaggcgtgagccaccacgtctggcctatttttactttttagagacaggatcttgcgttattgctcactgaaggctcgaacacctgggcacaagtgatcatcttgccttagctcctcatgtagctgagactacaggcacacaccaccatgcttgtttctgctttatgtatatgtataaaattttttcgcagaaccgtttgaaaggacgttacagaccagacactgcttctaaagaccagcgtgtgtcttctaagaacaaaggtgttctacaggccggcatggtggctcacgcctgtaatcccagcactttgggaggccaaggcgggtggatctcttaagcccagaacttcaagatcagcctaggcaacatggcgaaaccttctctctgcaaaaaatacaaaaattagctgggcatgatggcacacacctgtagtcccagctactcaggagactgagactggaggatctcttgagcctgggaggttgagactgcagtgagctgtgattgtgctgctgcactcctccagcctgggtgacagagtgagaccctgtctcaaaaaaaaaaaaagaaagagagaaagaaacaaaaacatgcacacatacaatacccaagaaatttaatagtgaatagtagtatctactatgcagcctatattcaagtttctctagttgtcctaaaaatgtcctttatagctgtgattttaaaatccaggacctggttgggcgcggtggctcacgcctgtaatcccagtactttggaaggcggagttgggcggatcacgaagtcaagagatggagaccatcctgcccaacatggtgaaacccagtctctactaaaaatacaaaaattagctgggtgtggtggcgtgcgcctgtagtcccagctacttgggaggctgaggcaggagaatcgcttaaatctgggaggcagagcttgcagtgagccgagatcgtgccactgcactccagcctgggtgacagagtgaggctcttgtctcaaaaaaaaaaaaatccaagatccgggcctgtaatcccagcactttgggaggccaatgcaggcagatcacctgaggtcgggagtttgagaccagcctgaccaacatggagaaacgccatctctactaaaactacaaaattagctgggcgtggtggtgcatgcctgtaatcccagctactccaggctgaggcaggagaatcgcttgaacttgggaggcggaggttgcggcgagccacgattgcaccattgcactccatcctaggcaataagagcgaaactccgtttcaaaaaaaaaaaaaaaaattctgccaggcttccccattgcatttggttgcatgcctcttttgtctccattaatttagataaattccccctgccaatttctgtctttcatgacattaacatttgtctcgtagaatttcccacaatctgaatttgtcggattgttttttcataattattttcagattaaacctttttttggcaacagtattcatacatgaccttgagtccttctgtgcacagcatagcaggaggcacatgatgttctttctttctttctttttttgagacggagtctcactctgtcgcccaggctggagtgcagtggcgcgatctcgtcttactgcaacctccgcctcccgggttcaagcaattctcctgcctcagcctcccgagtagttgggactacaagcacgtgctaccatgcctggttattttttgtattttttggtggagacaaggtttcaccatgttggccaggctggtctggaactcctgacctcaagtgatccgcctcggcctccctttttttttttttttttttttgctttgtttttttgagatggagtctagctctgtcacccgggctggagtagagtggcgtgctctcggctcactgaaacctccgcctcccgggttcaagctattctcctgccccagcctctggagtagctgggattacaggcgcccgccaccacacccagttaattttttgtatttttagtatagacagggtttcactgtgttggccaggctggtctcgaactcctgaccttgtgatcctcctgcctcggcctcccaaagtgctaggattacagatgtgagccactgagccaggccctccctctcttttaaaaaataaaataataatgtcactttggactcatggattaataataaaaaaaatctatgtgggccgggcactgtggctcatacctgtaatcccagcactttgggaggctgaggtgggtggatggcttgaggccaggagttcaagactagcctggccaacatggtgaaaccctgtctctactaaaaatacaacaattggccgggcactgtggctcatgcctgtaatcccagcactttgggaggccaaggcaggtggatcacgaggtcaagagatcgagactatcctggctaacacggtgaaaccccgtttctactaaaaaaatacaaaaaaattcgccaggtgtggtggcgggcacctgtagtcccagctactggggaggctgaggcaggagagaggcagagcttgcagtgagccgagatcacgccgctgcactctggcctgggtgacagagcgagactccatctcaaaaaaaaaaaaaaacaattagctgggtgtggtggcgggtgcctgtaatcccagctactcgggaggctgaagcaaaagaatcacttgaacccaggaggcggaggttgcagtgagctgagatcatgctgctgcactccagcctgggcaacagagcgcgactctgtctcaagaaaaaaaagagagaaaaaaatccacgtggttattacttttgatagtctaattgtcccaaatttggttggtggtagccctttcagactggttcttgtgtccttttgacttgcctccattagttattgagtactttcttctttatgataccacaagatgttccaggctaaccttgtatttccttttcctggcttgggaccagccatatatatttttaaaattctgtgttcatactgatacctccgctttgaatccaacaccacaaggctctttcttacctttccgcggtctgaattgtatctcctacagtgagaaaccaccttccccaaataatcagcacactgattcatttgccctctcctgtagtatacgggcaaagctttagagtcgtcacagcagtaccagcagtaagagtaaacttgctaaaattcatgacttgtttgcagtttctttttctttttttgagacagggtcttgctctgccgcccgggctggagtgcagtggcgcaatcacacttcattgcagcctcgacttcctgagctcaagtgatcctcccacctcagcctcatgagaagctgggactacaggcgcacatcaccatgtcccgctaatgtttttttttgttttgtttttgtttttttgagacggagtcttgctctgtcgccgggctggagggcagtggcacgatctcggctcactgcaacctctgcctcccaggttcaatcaattctcctgcttcaacctcccgagtagctggaactacaggcacatgccaccacgcccaggtaatttttgtatttttagtagagaacagggtttcaccatattggccaggatggtcttgatctcttgacctggtgatctacccgcctcggcttcccaaagtgctgggattacaggcgtgagctaccatgcctggccatgtttgtattttttgtagagacgggggtcttgctgtgttacccaggctggtctcgaactcctgggcccaagcgatccatctgccttggtgtctcaaagtgctggaattccagtcatgaaccactgcacccggcctgtttgcagttatttttgcccttgaggtttatctttctaggagaacataggagaacccagaattactgtgatcaaaagttacttgggctcttttttttttcttgtctgtgagattgttatcaatttaaagtatagttagcttgatttgtttttgtttcagttttagagtttgcttttctttttggtttaagtttttgaaatatggaagtcattttatgtgtacaagtatattaaaaaaacttattaataagtatataaagaatggaagtctctctactcatcgtagcccttccgttatgtaggtgactatttcattactttctggttgattcttcctgtgtttcttttgcaaaaataagcaaattcatatgtgcattcttacttcccctttcttacataaggggtagcatatgatttacactttttgtgctctgcttttttttttttacttaatatatcctggaaagcattccacagcagtttactgagctcatctttattcttttttttttttttttgagacatggtttcactctgtcacccaggctggagtgcagcagcgaaatcttggctcactgcaacctccgcctcctgggttcaagcgattctcccacctcagcctcctgagtagttgggattacaggcttatgccatcatgcctggctaatttttgtatttttttggtagagatggggtttcaccatgttggccaggctggtctcaaactcctgacctcaagtgatcctcctgccttcgcctctgaaagtgctgggattacaggtgtgagtcaccatggctggcatcttttttacatctgtgtaatactctattgtatgatgcacctcgtatattcaaatagtcacatttaggttgctttaagcattttgctaatgcaaatagtgtcatgtcgaataacgtgtgtgtttgtcatttcttatatctgggtaaatgactaacaggagcaggattattaggttaaaaggaaaatatattcttattatcttctcttccttttttttaatatgaaaagtataacatacagactgttgtacatcttgctttttttaactactcatctttttggagacttttgcatatcagtacccagagaactgcttcctctttttaaaatttttaacagctgcaaagcatttttaaaaatagctgcggaacagtccattgtatgactaccattggtttaatcagtcccctattgatggtttctaatcctttgttattcaaaacagtgccgcaattaatgcacctgtgtatgggtatcatttcctgattgtctctatcatacccttctcttctctttttgtggtagatgttactgggtttttgtatctgtatttgatcccatatcacaaaagagtccgaagattgtaattgcccgatcttttaatcaggtccagaagaatttgactggaatgctagaagtttgtgtgtgtgtgtgtgtgtgtgtgtgtgtgtgtgtgtgtgtgctttttttcctttgagacagtcttgctctgttgcccaggctggagtgcagtggtgcaatcatggctcactgcagcctctacctcctggactcaagcaatcctcccacttcagcctcctgaggaactgggactacaggcacgcaccatcgtgcctgcctaattttttattttttgtagagatggagtctcactgtgttggccagactggtcttgaactactgggctcaagtgatcctcctgcctcggactcccaaaatgctgggattacaggtgtgagccactatgcccagcctgaagtttttattttaaagcaaacttctcatggaagtctaacacacaggagattgcacaagttgtaactgtatgcttggagaatgttcacaaaatccatacctttgtgtatccagaaccccgaccaagaacagatgccgggcccccagtcgctgccccatcaagggtaatactatcttgacttctaacaccatagatttagtttttcctgttccaaaactttaagcaaatttctgcccagcttttaaatgttgcattgccttagcacttggttgtggaccattttctgctgttgactatataaatgtccaccaaagtcactgttctaacaaggtgattgctgcttggtttccttggccttaacttgccagtgattacttagcatgggtcagccaggcctcctgctgaactcccaggagcagagcatgtttgtaccctccagattcctataagacgccctgtccaggtgtcccccagcgtctctaccctgtatgtccctagcacagctgctcgtcctcccctggaacctccgcctcatctcacacaggcttgtcatgatgggtctccaccatccactcggggttaagtgggcagggagtcttccaattgctccctttcccctactccttaaaaccaagaccccttcaaacttgtctcctaagggtctcaggaagcacatcctgcccaccttgcctttccagcctcatctgctgccccctcatttgcactctgctttggccatagtggctttctttcccttatgatgggtggctcatgcctataatcccagtgctttgggagtccaaagcgggaagattgcttgaggccaggaatttgagaccagctgtgcaacacagcaagacctcctctctacaaaatattaaaaaattagcatggtagtctgtccctgtagtctagctactcaagaggctgaggcaggaggatggcttgagcccaggagtgccactttactccagcctgggtgacagagtgagaccctgtctaagaaaaaaaaaaatgtgaagctccttcctagtaaggaactgtccctgtacgatgctttcccatctgcctagaaggctgttttgcccggggaactcctcttcatgcttcaggtttttactaccacttgtatttaatttccctgaggctgggtgcagtggctcatgcctgtaatcctaccactttgggaggctgaagcaggtggattgcttgagcctaggaattcaaattagcctgggcgatatggcgaaacttaatctctacaaaaaaatataaaaattagctgggcctggtggtgcatgcctgtagttccagctactcaggaggctgcgcttggaggatcacctgagcctggggaggctgaggctgccgtgagctgggattataccactgcactccagcctgggcaacagagagagaccctgtctcaaaaaaagttttttaattaaaaaaatttaatttccctgcctctccagaccagattagatcaccaggacatgatgtgtatgttttcacggtggctgtgcttgccttttgtatgatttactgcagaggtgattgactgtttcatggggagagcagggaccacatctgtctcactcattcttccagcaccatataagtgtcctaataaatgaacaaaggcaaaaggagcaaagggaggctagcctgtgaccaaggccgaggctcagtctgtaattcaaggtcaaggaatagaatgtcacttggctttccctgtatgggatcccctcccaggttcctttcctacccttggatggggttttcagagagtagattttgtgccttgaagcagagggcgggagcagctggtaagatgcagctggtggaagggtggctctgggaggaggggagctgcctccattgcattcacggcactgtgggagtatgtgctgggtcctgtcctggggagcttgcagcccagatgaggagtagagagggactgggttgggtgtggccctgatctcatccttctctggcttttctttccttgcagttcaggacaaagaggtgtgggcaggccactgggccagctggtaacatcatggcaggtaaggagaggggcaggctgtgtgggtaggacatgacagtgagcatagcgtggatggccctcttcctggttcccttatctcccctagtctttggaggccaggttctttccatcttactgtccccaagctttccccactctctccactgaggcctgtctgagaacttcaacatgacattgtctagccctctgtcagatctttggtcctatggaccaggaattgagcaccttgatgtccttgtcttactgtccatctgcctgattagctgcatgagtggctcagccctcctcccctctgtctctattgctttctaatactctgaggccttttttatctggttcagaaggctcagaggtgtagaatgccagagctggagggaactttagggaccgtgtagcccagcccccactccagcaaataaactgaggtctagagaggggcgatgatttgccccagagcacaaatgctgagtggaggctggaacccacgtctgtagattctcacacatccgcttcttctgcctggagctgcccccactgagagggtggtaccttgaggccctgagacagtgtcactcagaattaaaaaataataaatgctgtctgtcaaggtgacattgttttttattctgagtgacactgtctcagggcctttggctactttgggatcatcacagctgacccggggaggtagggacggctgggtggggaaagcagagtggccggtggccacaggggccaatggggcagcacagccaggggaaggatgggcgtcttggattgtcgggtggaagactggaggtgatgttgtgcaatgtgtctcatccacagagaaagtgaacaacttcccaccattgcccaaattcatcccgctgaagccatgtttctaccaagacttcgaggcagatattcctccccagcatgtcagcatgaccaagcgcctctactacctctggatgtgtgagtgccatgggatgggggtgggccagggtggctggaggaggcaggaagactgggcgtgctgggcagcggggtggggtgcccacaggcctgactgtccttcagtcccacttgtggcatatgcatggaccataagtcttcccctgccaggctcccagaggcttcttccatgggccacctccccgactgggcctcagtttccctcaacctcccccatctaggcctctcttcccttccttcccctccaccctcctttcacagagcatctggacaggggtccctctctgcagtgtaatccctgtcttcttgcttcccctttcccttccactggagtaactttccagggaacctctggggactgtcaggacctcaggattctggatttggagaggaatccttccctcaaagccttatttgtcttgctttctctggaagattgctcaaagagaggaggattcagctgggagttgggagctgtgggatcaagtttgcctggtcactgtgcttgccaagcagcaggttcctcatttgtaggaagaaagtattggcttggcgattgctgtggttccatgcagctctgtgttgggtggtctatacctgtaagagtctaatgtcaggcacagtggttcacacctgtgatcccggcactttgggaggctgagccaggaggatcacttgaggtaaggagtttaagaccagcctaggcaacacagcaagacccctgtctctacagaaaataaaaaaattaggcctgtgtggtggctcacacttgtagtcccagctattcaggaggccaaggcaggaggatccaatgagcctaggagtttgagaccagtatgggcaacatagcaataccccatctctttaaaaaaactagctgggaatagtggcacatgcctgtagtcctagctactcaggggactaaggtgggaggatcacttgagcccaggagttcaaggctgcagtgagctatgatcatgctactgcactccaccctgggtgacagagtaagagcctgcctctaaaaaaataattaaataatctagaattctttatttagaaaaccttagcatcaatgttctaaggttttaaggctgagagtgtaaaggcctcatttctggtgatctgtagcagggggtgggaaaggtgtcttcttggggggatgggacttggctgtgctgaggctagttagaaggtacctcttaggcatgtgagggggaggcaagctggctatcctgtgctgggtgtgagccccaggatcccaagatacccgcaatgtaactgcagttgggttctgctatatgtgacactgccctgagtgaggcctgcacttagctgcctacctgggcagatgcttgcatgtgccgacaaggtggtaaaatatactgtctttgcagcaggtccctcatggcatggtaggaagaggatggggcagacagactcagtttcaaggcctggcttggcctttgagtgaagaagggatctcccaccatgtaacctgagagaaggggggatgggacaggtgtgggtaagtctgtagatgttgggaagcaaatgaagaagttacctctgatggcttccattttttccatcaaatatgatgtagtgtggagagtgggctcacaacgaggccatgtttgtcgacggatagtgaggacactctccaaagaaacccggcccctaagatttctgggccacacacaaggttcatttgacattggctgatgtgaatttacagtcttcctcatggggtccccttttttcttagcaacattcagctcaggtacagatgagaattatgttcatctagggtgagtgtggccagaaggcagggcaggggagggaataagaaaatgagtaatgaattatggaatctaagctggataaggagaagagtgaagacagaaagaagctgatggctagagagagagaggggctgagctcatgggtatccattccagagaggaagcagaataattgcagcagaggtgtttgagcaagggagctggggcaggttggactggggagagatgtgaaccaatataataggttagtgtcttttctatataaagagcaaataaaatcagttttaacaccaagcctccaggagattttggggcaatgaacagggatagaggaaatacagctgaaatgtacaggaagaaatgcccacccatgaggggccctgagatgggtgacacggtggtcaggccaggcttgtaggtcactgtgtctgacctgggctctgggaactcaacttctgggaacatctcatccagaagctggatttaagggctataaatatctccttaagtcctcactaggcacccgcaggtgctttactcccaaggaaatgtatataacccttgaggtgcttaagggttctattcagaagacaggaccacagatgcctggctgtttgaggccacggttgagccctccttcctttgtttattcagcaggtctttgtggacttagctttgttttcaaggaagggagtgccctgatgttagataatgatgtgctgcacagacccgcatgtgtgttagtaccagcatcacttttatctgtaaatctttgaggtccctgctggccgtgactcagtgacactgtgcctcctagttcagctagatgaggtggggacagaggggggggggcctgggtcctgttcttggggaacttttagtctggttgatgggctgggatttatatctggggaaccttgagagcagcccaggtctgtagaaggtcagagggatgggagatgatgaggttgcagtagcaaaggaagacttcttcaaggagctggcatgagtgttatctaagaaatagattagatagctgggcactgtgactcacacctataatccggcactgtgggaggccaaggcgggtggatcacctgaggtcaggagttcgagaccagcctggccaacttggcgaaaaaccatctctgctaaaaatacaaaaattagctgggcgtgatggcaggcacctgtaatcccagctactcaggaggctgaagcaggagaatcgcttgaacctgagaagtggaggttgcagtgagctgagatcgcgccactgcactccagcctgggcgacagagtgaaattccatctcaaaaaaaaaaaaaaaaaaaaagaaatagattagataaagactgagattccagccgccaatgcctgccccatttaagtgcaaggtagatggcacaatggctagaagagatgtttccacaaggccttttatttttccctttccatgcccatatctcgaaagagaaagtgtaaggtcggtttcccatgtcttgggcttggtgattgctgtgagtctgggagggtcaggggctgaagccattcttgacaaggacaagagcatttctaccaccctgaggctttggggcccttcaaaggggcttgctgggcagaagctctgggttctggaggctgtgctctccagatttctcaggagtgggtgctggggttgaggggtgggggttggttcgagctcccagcttgcgttcttacagtctttactcctctgcgtgtgtatgtgtgtctcctgtgtctctgtatgtatttgttggtacgggttgtgggtcttttgtgtgggtgtgaatctgtgaatgtgtctgcatctctctgtgcttgtctgcgctgttggcctggcttgattgtgggtctctgttgcgttactggtgtgtgtgtgcccatgtccgggtgctcatgtgtctctctatgggcctgggtgtctgtctctatgtgtgcatgtgctcctgggcctgcagtgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagtaagtggttggtgctatccgcagtgcctagccgtctctgcccatctcccctgtctcttctccatatcttttctcacttctttttttttttttttaccctcccccaaactcactttcccttgctcacctttggctcagattgctaggtagggcctgggctttctgggggtgccaagttgaggtgagagggctgagagttagtttctttcctcctcactctacccttgggtgggggaaatatagacagaccaggcctattttttcttctgtcatccccttcctcaggcagctgcatgttaaattttgcctgtggggctgcctgtcttggtggagctgcccatcctagtacctgtggggctagccgacttggtgccaaggacaccatctatccatgtgccaatgggaccagccagccatgtaccattgacactgttcatgtgcaatgaggtcatccaactgtgtgccaaagggaacacccatccacatatcagtggggcttgctgtcttggtgccagtgggtgtctacctagtgccaaatggcattttcaatctttgtgccaatgtgactattcatcaatgtaccaaggctatctgtcttggtgccagtagaatatccatctcaatgctaatggggccttaaatctctttgtgccaatcaggccatccatctaagtgccaattagctactgttttggtgccaatagggtgtccattctagttccaatgagactttctatctctgagcctatgagaccatccatccatgtaccagtggagctagctgtcttggtgtcattgtccatccccttgacaatgagactatttattcctgcctcagtggagccatctatttctatgccaatgaggccgtccatccatgtaccagtgggtggtctgttcatgggaaatccctccctgtgtaatgttgcaacacacaggtctaccacgtggaaacttgcaaagatgtatgggtagaactaaccccttctgacctctcaattaaggcctttaaatgtcttctgtccattatgcacttaaacttggaagggcttgggggccttgaaggcagggaagccctggccctctgcccaggtgacgggagccacctcctctgccgcaggactgacagctccttcagtttcatggcattcttctttaccttcatggctcagttggtcatcagcatcatccaggccgtgggcatcccaggctggggcgtctggtaagaggcaggggtgtggcctggggctggcaggggtggcgttgtgggtgtatcttttgcttacctttgtgtgctaagctgtctagcctatggggcctgagtgatgggttgttgggagagtgagaggattcgggatagtgtagtagtacaaccatagcatcagagggaaggagaacctggcagtggtttcttgggggctgaggggtgtcagggattataggaaaacctgggggaagaaagtgttgtatctgaagagcacctctgagccacagggatggggtcttcttgagccactggcacaggttctttgggtatcagtaagatggtccctctgcatccagtgatatgtttcctccctgtggcaatgagacggtcccttcctctagcggggggctcctgggcacctcttatcctgcccgcagccccacactggcctcttcctgcagcggctggattgctaccatctccttcttcggaacgaacattggctcggcggtggtgatgctaattcccactgtcatgttcacagtgatggccgtcttttccttcatcgccctcagcatggtacgtggtcccctcaagggtgagaaggtggctttgggaaggggccatgttctgaaacaagccctcctccaagttgcaagaggatcccgaggtcttccaagggactcactctggaatggcctgcaggactctcctacagaggcattcatggggagggagcactgttttttttttacagatgggtcccatctatttcctggatgggctgccttttctctttgattaacccttctttacgctctttttcctacaggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtgtgttctgctgtgtcatgtgtcttcctgtggacttgcgtggagcctcacagcgggctgtggggcaggggcatgaaagtatggggggtgggtggatctgtggtctgtcattccccgagacctagagctatacgaccctgtgtggctccttctctgaggcagccttcagtaggtgatgaaattgccacctaggccccctgccttgggaggaggaagtagaagaagcaggctggatcggccgggcgtggtggctcacacctgtaatcctagcactttgggaggctgaggcgggtggatcacgaggtcaggagatcgagaccatcctggctaacacggtgaaaccccatctctactaaaaatacaaaaaattaggcgggcgaggtggcaggcacctgtagtcccagctactcgggaggctgaggcgggagaatggcgtgaacacaggaggcggagcttgcagtgagccgagatcgcaccactgcactccagcctgggcgacacagcaagactccatctcaaaaaaaaaagacacggctggatccctgcgtaagggatggtttggcccagatggtccactgcggctaagggcgggggtagagcagaggccccacctcagctcagggcaggggacccgcagctggttcagccacctcaatgaatacagaggttcctggggcctgtgaaggctagaaaatgaagggggcagggaagcatgccagtgtgtgttcttctgccgccttccctttgcccatttgatgccttccacctggatcgctattgggatcctctatctaacctcctggctgtccttcaagattcatttcaagtcactccttcaagaaggctttcctgcctagaggtgttgcttcctcatggaggatcttaccctgtcattttctgtgtccctgtttgtctcaagaacagggacgcatctgatttatctctgtatcctgtgcacctaaaatagaagaggcttggtaaatattaagtgccacgagccctcttttactaaggacctgccaacatgggccccattcacactaataccatgaagatagcccttttctatacttcgtcataaaaaagtaatacacacacccgggcagcaacttccacacaaacaacacatgtgcaaggagatcaccattatttccagcaaaatgctccccagggccgagcgtggtggctcactcctgtagtcccagcactttgggaggccaaggtgggcggattgtttgagcctaggagtttgagaccagcctgggcaatagagtgagaacccgtctctacaaaaaatacaaacattagtctggcatgatggtgcactcctgtagtcctggctactccataggctgagataggaggatggcttaagcccaaaaggtggaggttgcagtgagtggagatagcaccactgcgcactccagtctgggtgacagagccagaccctgtctcaaaaaaaaaaaaaaaaacaaaaaaaaaaacagctccccaacaagatagcaggctacaacatgcatgtgatgaagctgatttgaagcgctcagtgagaggtatctgcatcaagttgcaggaggagaagagagaaaggagagataatcatgttcctgaggtctcagccctggatcaggaaatcattgaagtattaacatatcctgacattaaggaaatgctgatgtttttggactttggcagtctgtccaacctgcaggtcactcagccaacagtggggatgaatttcaaaacgccacgtggaagctgtttgaatctttttgagatactgtaatattttcaataaacctgggacaacagcaaaaaaaaaaaaaaaaaaaaaaaggccccaagcaacaagcagtgtgtgtggggctgataggagtgaggaaaggaggtcggacagttatgccagcccctatcgagagtcccagcaatacaaagaacagggccagggtttgctccaggatttccccagtggactacaactcccggaaggcagagaagtggactacagctcccagaaggctgcgcgacatacagccagcccggtgctctcgtgaggcgtgccagtcagattccgcgggagagcggcagagataccgcgatatttgggagcggccccgagacgcgcctggcgcgggtgagcagtggaagggggctgggaagctgggttctcgcggcggcgcgggaggggaggttcggggagctgtgtccgcgagcgtgggtccacggctgtctgtgtgtgtccttattttcccctgtgtgcccatgaagctctgtttgcgactgtgcgtgggtaggcggccgtccatctgtgcgacctcactttcccggctgtacgggtggggccgcctggagcaggagggacccccgagccctgagtggagggtttgcatctgtacccgtccagcccgactttgtgctgctctgcgattatttgtccagtgtcgtttaatctagtttaaatgatggccgtgtcagctcctcacactgaacgcttacccgggctgcccaaagtacaaagtgtatttaaaaagttggtaaaattaaaaaaggaaagccatgggatgttggaagtagccctaggcctgccaaaaagtgctgagtgctatttaaaaattaggccaaatcttgtcagaaaagaacttcctgctgtccttgaagtatttggaagcaggtgctagatggtgagcaggagaggttgccaagttggggaagtggtggttgtcctggagcaggggtttccacatctctcacagtggctgggaagtagcaattcgcagtcactgcctttctagtagcccacgtgtgtgagtgtgtgtgttagatacatttatccctcagtatccgcaggggattgctgtatactttttttttttgagacaaggtctcattctgtgacccaggctggagtgcagtggcaggaacatggctcactgcagcctcgacctcctgggctcaagggatcctcctgcctcagcctcctgtgtagctggaaccacaggcataaacaaccatacccggctaatttttattttatttcatttttgtagagacagggtctcaccatgttgcccaggctggtctcaaactcctggctcaagctatcctccttccttggcctctcaaaatgctgggattacaggtgtgagccaccacatcaccctcctgtatactcttttttcttttctttttttttttttgagtcagggtctcactcttgtctcccaggctggagtgtagtggtgcaatcatagctcactgcatcttcgaactccctgggctcagataatcctcccacctcagcctcccaggtagctgggactgcaggcacgtgccaccacgccctccatataatttaaataatctctagattacttataaaacctgatacagtgtaaatgctatgtaaatagctacacacttttttttttttgtggtactattattatattttgaaatggtctctctctgtcacccaggctggagtgcagtggcacaaacatggctcactgcagccttctaggctcaagcgatcctcctgcctcagcctcccaagtagttgagaccacaggcatgtgccaccacacctcactaacttttaaattttttgtatggggtcttgctatgttacccaggctggtctcgagtacctgggtttgctcaatcctcccaccttgccctcttaaattgctgggattacaggtgtaagctggagcagaagcctgggcagccggtagtgaggggctttgatgttaggctaaaggattcaggctcataatggatcttggatccctgcctacccaccacccacttcccttgtttggttctgctttgtcttaggctcagttctcatccttcctgtattgagcttgaacgtataccctgtctggccttgctttccttgctctgtctttagtctggttctgtgccagctccacctttgcccatatagggactggcaggtatccctgaaacctaaaactctgccctgaattaaactcatcagaggagacttaaacatcacaagctgaggctctttgctctgtctgtccctgtctttctggaggatagagaagctgccatttttctggctgtggcttacctgcttggctagtgccctgggatcttgaggctcagtaatcaaagcgtgtagccctataacctgcccacttgccaactctttttgctgctcaggagttcctgtgaattcagcagagcccggggaagtcaggtactacagctacctgtgcaaataggtgactccaacaggttctggttacagtaatagacttactggtttggaatttgatcctctttgcaagcaaatgaaggaatcctgccagccatcacccttcctggaattctcaggttgaactgattggacctcgcctccaaatgttggttaaatgatccactttctattcttcaagtatattaagcacacacatacacacacacaccctcttttttaggaaggtaggtaggtttgatccttagcacagctttgctaagcaggctaagtactgtatttcggactatagtgcctgctgtggggaagcagttgaagtcactaatacagattcctgccccaagtttaactgactgctttctgtaacctgtttcctaggaatgagatcagcttgatgtggaggaggttcaggggcctcagagataaaatttggcttctggttttgcaggaatctacctatcctagcaccagttggctagggtgggacagggtcagggtttgcgatctggcaggtaggtttccctggagaataaagaatgtgcctccatcacctaccaatgatgtgttctgggaagaagctggctggtagcccttctgtaccttgtcagattctaacagggctccccactccctggggtaaactcagttctccaactctggccaagcattgccctggttggggccctgcagtggagcagacattgagattactggcaaatcaaactttgggtgatcttgccctagggaaccagcctgtgcttaacccctgctgagaagtgggataatgcagccaaacatgatcctcagcccacgtgggttgtgctcaagtgctgaaggcaaatcctgggcagagaggctagagagccaaggggcctgtgagtgaagaggagataggcccctgtggatgctcagccatggaggtagccattggacaactcaccagcgctgcttcctgggcagctgcctgggtttcccttgccatgctgattcttttttgagtgcatcttctaggaccttctgtcttggaaggagagccccttactgctctctttcatgtattgactcaaagtttctgctggaaggagcttcagagatcatctggtcctacctctgcatttttcagatgaagggacaggtccagggagggaatgaccctggaccagggtcactccaggtcaggagcacaccatggtcagggcccagggcttctgcttcacaggctaggtatctgtcttctgctcacactgccttggagggtatagttattcattcagcacctgttcaggactgccggctagtggactgctggttggcaattagacccggtcacacattcagggagcttgctggtggagggagaggcaaggaaactgatgtgttaattgagtctgtgatcaccaaaaaggtgcatcccagggaaggactgatctcaaataatttcagacaggtgtcattcctgtcttctcaaactcaacctacagattccccagaggcagctactgtgttttccacaattcctttgcatggtgttctttgtaatcggtcctcagtgatggttgctgatgaagcacgttctgctggcccaacccgccacgtgtaggttttggtgtccatcagccatattatcatgagtgcacacttctagcaacgtctgagagccagaggaagaagcaaaccagctaatctcctggggtggcctgcatcccctttatgctggtttcttcctgggctttgatttgtacggtggtgcccatcttgattaacagggacagggacagagaggcaaatctcttggctccctggagcacccaaacctccctgttgcccagggttccacctcatgagcatctttggaacccatcccttcctgccgcttcctttcaccagtcagcccagtccaccgcagcagctcctctcgccctccagtctctccactaacagggtccctttgacactgtcaccaggtgccagcaccgtctttctaaaaccaaaactcctcaccctggccctcgctgcccacggcattctggcctcaccctgactttcagtctcactttctgcccctctaccaccccccatcacagtccggcctcactagtaagccactccctgttccccaacctgccaccctcctcaggaccttcaccttggcaagattgttccttcctttgaagtgatttcttcctgtctctgaaaaactaactcatccttcaggactcaaccccaatgtcattttttctgggatgcaatctctgacttctagagatggtcaccctgagcagccacgcacctggtacagcccttccccacagcactgcatcattcccttgtgactggcccatgtgtggggaaggtgtctcactttcttatcaaactgtgtgctccctgaagccaggactgctgatcccttccgctgcctcagcctctggcctggggcctaatacgtggtgctccatacattctggtcgactgtatgaatgaagggggtggcccttgttctccttttagatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctggggtgagtatcctcaccagataagcatggcagcctccggcatgggaggccggtgctcccggggatggcccattgctctgcagtacatgcaattttctttttctttatcatgttaatcatgcttgtggaggtcctgtgtgtgtggtgctctgtggaggattcaggagacagagaccagtgcccagtgtaaccaggggctagattagatagtacagacagggcatgaggggagactgggaaaggacccagtgaacggagggtttgggctcccatacattaaccctgagaatccgtgaagtcctgtgtgggaggagggctggctggagaagtgcagcaagttctcagtatcccctcctgccttgggcttccccatccctgctttcattccgccttgaacactgcggctgtgttctccctcctcgtgagacctcatggttgtcttgtcagtcaaatgctctgaaaccccattgtctgaagctctaggttcaaactttgctccttcaggtgttcagagctgccccaggggcccccgactgtgtgctggggtgagggactctagcccccgtccttggccagaccctcaacttggatctattttctatattggggttctggtgcagaagttcaaggctttaaacagcgtgaaatctaacagggagtggccccacttcctagttccacctccagggcccttagttggtctgtcttatcccccttggtctttgcgtggctgggccctgctaggctggctgccctctctgctcctctctcgccttttcacattctgtgcaaagccttccctgtctgccccagcccagcccctgtggttttggccccttcttttaaacttatttgacatagaactataggttgccttagacactgctggtgttactggcccctagtttttggtggggtcttgtgaagttgctgggccccaggcctggcttttccctcttgttatcagctgagcacccaaggtgcagtggccgtatctggcatgtccagcagggggcggtgcttactcacagatgaccacgtggtcacatcagctggggctgggctgggaagtgtttcacttttttactttccaccaacttccacccagaaagtcaccccatcaccccacccccagggctgggataagccatgaagctgccagccagggatgacagccaggccagagtgggggagggaggagagtctcgtggcactctgacactgggtgctgcacttttagggcagtgctgcttaggcccagccacccgctgtgtacccagaagcattggtaggagctgcccagctagagccgtgagggtgggaggcctctgccaccaccccctggggagggagggagccatgcagttcccttttcccatagccccagggcaagtgagtttccggactaggggtggataggggcggggagtcctatcccaggaaacagatgggcagcctcagagcggagggaaatggcaaccctaccgcttcctcccatcccacgcagccagcgtttggtgggaggggggttgtgaggaaagggttgcctggagcagggaggtgctccagcccaccccagggccttttagcctgggccccatgggatggcaggccatgtctggaacaggacttggcttcccctctctggttggagttgatgccaaaagtgaggcagccagagggcactgaactgggagggagggctccccgactcagcctcttggagcttgcctttcccatttgaaaatagggctgattcctgctgcccatcccccagactcttgtcaggctccctgagatgttggctggggtgggaggggtcacagatgaaaatggtcctgtgccagtgactcagcacagagcctggcatgttgaagcactcggttgtgtgtgtttcctggccatcaccctgtcctttccccttgttcatgtcctttgggccagccacatggtgtggggcaaccccactgggaagagccatggaagccacagttcacctgctcttgtggagggcccatgcctttcatctgcagggagacagctctccaagcctggccttgcttattagggccctcgtgaggtgttgggatccaaaggtaatccctggattgccttgtgttggccccagtggtggcgtctatccctgcacactccccttcactccctgatggccctgatctccacattgcctcctgctggatctcctgcaggagcatcattgtcccttggagcagtcactttcagctcttcacctgctgagtcgtgggttcaggtgctcaaggctttccggaacttccttaggtacatccagattttgtctagcacatgaacagctggggtgtgggctgcagggagctgggggattctacagatctggcccatcactgttcctgattgaccagtatgtccagacatcccgggaaagccgctaatgtcaaggtagccaaatcagggagactgtgaggggtggtggagagacatggattagccacaagccacacacaccagcagtcagggagagtagtcactagcagagatgaccttgagtatgttggggcaggtgggcaaccgtgtcacaagagaggcagctgagcacatttctgacgctgggaccctgggcaagtccgttctttttggccataattttcttatccacacagtgaaggaggggcaggttctcaaatgatccatctccagggcctcttctggcactggtgttagaagattctagatgtgagggcaaaaaggactaggacccaaaggcagcctgagagaaggtcctggggctcaggagcttcaggatgccgggggttttgtagttccgtagttgtcatgtaattgagtggcagtaaaatccgggttgtcagctcaggcagtttcttccctggggttggcagcctggcccatgcaggggagcaaaaatggctttcctccatcttgctaggctgcttggctgggctatgagttcaactgacttataaacaaaattaacagggccgggcgcggtggctcactttgggaggctgaggcgggcggatcacttgaggccagttcgagaccaccctagccaacatggtaaaaccccagctctactaaaaatacaaaaattacccggttgtggtgggcgcctataatcccagttactcaggaggcggaggcaggagaatcgcttgaacccagaaggcagaggttgcagtgagctgagatcatgccactgcactccagtctgggtaacagagcaagactccatctcaaaacaataacaacaaaaaacaagatcaacaggagaaaaccatatttagttacatatctgcacatgggtgtaccacaaaatatgagattcccagaagggtgagatggctgaagcctgtatagcagcctgagctacagaaggaaataggggcttggggcttctgggggtggtggcgacacaagttatgggagggtgaggggaggaattatacggtcttgttaggcagataaaaacctctcagataataaaagatgcctcagcagattgtcaataagtcagtcttcctttctcagggagggggactcaggacaaggggaatccctctttaggcagataagagaagttcagagaaagttcctccctgcatttgtttttcccccagtgccttcaggtttgaaataatcagcataccaaagccgcatattatggggtggcatttcctgaactccttcatccacacccttcaaacttgggaggagaagacagacatcgccctagcttttgccagggcaggtgtcagcagaattcagagccaaaaggggatttctaaagatagagaaaacccccaactcaaggagtcagcaggcctcgggctcagagaaggatacatttctagggtgtctgtcaggacatccaggtctgtcgagggtgaggaaaagaaggctctgctcatatgcagtgtggagtaaattctgactttctggaggaccacttgacaatattgagagaaattaaaacatcttcatagtccttgatttacccacaggattaaactctgtggggtgtatttacaaagtgaaaggatgtccattatagcattatttataatttcaaagcaaaactggaagcaaacaaaatatccagcagtagagagctgtggtgcccttatgatttatgggacaatctctcagtggattacttggcaatgattcagaaaaatggggtggctctctctgtgctgaagggagcaatcatcaagatggaagcggaataagcagggtgtaggagctagcaaactggacccccccccccaaggccaaattcggctctgcctgtttttgtatagcctacagctaagaatgatttttacattttaatttttattatttatttttgagacagggtcttgttctgttgctcaggctggagtgcagtggtgtgatcactgctcactgtagccttgacctcccaggctcaagcagtcctcccacctcagcctcccaaatagttgggactgcaggcgtgccatcacactctgctaatttttttgcattctttttgtagatacaggattttgctatgttgcccaggctggtctcaaactcctgggctcaagtgatctgtctgcctccacctcccaaagtgctgggattacaagcatgtgccactgtgcctggcctgatttttacatttttaaatgattaagtcaaaagaaaaatagtattttatgactcggaaaaaaagtgatatgaaattcagatttcatgtccaagacaatttattggaacacagccatacccattcatttacgtattgcctatggctgcattcgtgctactacagagttaaatcattacgacaaagcctaaaatatcatctggccctttatagagaaggtttgccgacccctggtatgcagcctgattccttctgtgtgttcttatactgagttactgcacacagttttttcctctggaggtggttacccttgtgaagggggaccagtggaggaagggaaacttgcatttttcatttttgtatcattctgttcagttttaatttgtaacctatgtgtatatttgtgtgtgtgtgtttttttgtttgtttgtttgttttaagtcagtggggcttttggtgggaatattggggaacattcttgataagtttgtgctttttttttttaaagtgctcactgaggaaagagcagaagacataaggcctggtttgaggatttctctttttttctgggtgggggccacctgcccgctctgtgtcctgatgtggaaactctgagacctttatttgtgcctctgcctgcttggctggccccttcctcctctggcctgcagccctgtcacctgctcctctagggacagagctctgtcggcctctgggcagagggtcccgcaccccagggtccttccctgattgcccagaacaacgttcctgtgcagagcctccctagaccacctccctggtttccttcttgagaattttctgaagttggggaagcacacagaagggttggcatgaggagctgacacaaccagaacaccagctcccccaggggcagatgagagcacgactgtttcctgcagagccaggtgggaaaggtcagggtcacagaagggctggggtggtacggtgagctagatggagccctaccatgtggtctaaatggcccatgcatgggtcataaggggaaaccaggcacagaggaagagggtctcgcccacggccttccagggagtgagtgagttagcagaactgggggcttgaggccaggtttcctgggtcctatcagtgagtgaattgaagagctcagacctggagctcattctctgctcaagctcaccaatgcttgaggatggtggaatttgtggattcctatcttggtctgccttgcagttaggggttacctgtaccccacctatctgttagactgagccctaggagaggccagagcttggatcttatcagccctgcccccaccatataagaggcttagtaaatgtttgccgagtagaggcatcatcatgagccatggaacccactgagccaaccggaactcccttgggggttttgttaaggaggccacctccttcacagctcccgcgcctcatgtgccaaccgcactgggccccaagaatcctttgtcctagaatgtacccaccaactcccctgctcaggttagtgtcagcttcttagctggccgctaggacctgggcacagatctggagcatgccatcgtcaacactggtagacccaatgtcagagtcctctgctgtgcgtcctggcccagaggactgggccaccaaagccctgggttccttgtcttgtcacagattaagtgcggggctaccacttcctctttagaatcctccttggtctccagtggaggcatcatcacgccctactagaaacgcctgctctccagccactcagctgctagttccagttgggctcttctccttttcttgtatatgccagagctgtgctatctgatatatttaaattttcttgtatattccagagctgtgctatccgataaatgtaaatttgaatgtggcagccgcttgccacattcaaatttaaatttaaattaattagaatttaataaaaaattcagttcttcagtcacagcagtcacacctcagatgctcagtggccacatgtggccagtgctgccacaccctacggcacaggtagggccgttcccatcattgcagagatggaaatgctcttcacggataatgctgtagagttgtggttctcaacgggggtgattttccctcccaggggacattggataatgtccagagacatttttggttgtcctaacttagggatggtggtgctactggctcttggttctagtgggtagaggccaggaatgggcttggcggtggagactcaggccatgggatttgtctcatcctgtggctgcgaagtgcctctccacgagttcctttgataatctgccccagacgtagcctggccacactaggggcctgaagtagaaacgggaggtatcactctaaatcctcattccatttctcctgaccagacccaaatcaggattcctgatgtctcttcagcaaagaaaaggaaactagacttgccaactggtttcgggaaggaatctctatacatgctagataaaatgcaggcagcttatgtaatagggtctgtccaagcctcagtcacatacacaaagagatttagcttaaaactattagctgtaaaaacttttctcaggtaggctgagcgtggtggttcacacctgtaatcccagcactttgggaggctgaggtgggcagatcacctgaggccaggactttgaaaccagcctggccaacatggtgaaacactctttctactagaaatacaaaaattagctgggcgtggtggcgcacaactgtaatcccagctactctggaggctgaggcaggagaatctctggaacccaggaggcagaggttgcagtgagccgagatagtgtcattgcactccagcctgcacagagcaagactgtgtctcaaaaaaaaaaaaaaaaaaaaggaaaaaaacttttttctaagtggtgtcagcaggggactaagccgggagctgcctttcaggaattctgtagcatatgggggattcttttttaatgcccagcgctgcttctaccaggacccacaaaggtgtaagagaaagccaaggaaggctcctgccctcagggagtttctgccctgccagggctccttggcatttgctgggaaaaggtcaaggtaaatgagtaaacggtcagaattatttagtatcatagaagataacacatggttttatttatttatttatttattttaatgtgtacagggcccagcccttggctcccaggaccttttggtggagtgaatgaaaataaaagaacaaagcccatagggctgatgaatcagatcaagtgacatccctctaaaaccagaaaaactagtctgggcctgctagacagcactggggtcagtcagggtcacctccaaggagagtcagctgcttcagtgggtcagaggtggggcatcaggaaagacccgcccatcacatactcttcgcattactccttagtgaagaccttgaccccaggaggctccctaacaatgtgactgtaacctgggagggtggctagagagtggagcctctgagaggttaggcaaagagcttagagggaagatctcaagcagggtgagaggcttaacaggaccccgggtggagctccccaggggacagtgggggcctaaaggctctgagaccttgagtgacggtgtagggaaggaagaaagggtagagttgagagggaggcgagaacccctgaatcaagggcattaccaatttggggatgattctttttatttttttattgatggatgattgattgattattttttttttgtagagaaggagttttgccctgttgcccaggctcatcccaaacttctgagctcaagcaatccgcccgtctctgcctcccaaagtgctgggatgacaggcatgagccaccatgcctggcgcccaatttggggatgattctgaaggccagcactaggcaaggttctccgctttgcaaactggaagatggttttgggagctggggagagtggaggacctagaccttcaggaagtagctttccaaatttcagaatagaggcgatgaacctgggacattcttaagtagcaaatggttcaggatggttgggaagctcttagaaatgaaagatggtggtcccatgagcagaagcaggcagtgtattagcagagatgtggtctctggctacctgaagccttctgttgaaggagctggaaaacagttaagtggaagggaggacatgtaaccagagatgaaggaagaatgtggtccagagccccccagggtgagctgaagcttatggcaaaactcaggaggctcgagagggctgttttatgtatttggaagaagaacaatgaagcagtgtctggtgctggaggccagtggtaacattagcagaggataagaagaaatgggaggggctgggcgcggtggctcatgcctgtaatcccagcactttgggaggcagaggcatgtggattgccctagctcaggagttcgagaccagcctggccaacatggtgaaatcctgtctctagtaaaaattcaaaaattagctgggcatggtggcgcatgcctgtaatcccagctacttgggaggctgaggcaggagaattccttgaacctgggaggttgcagtgagccgagattgcgccgctgcactccagcctagatgacaaagtgagactctgttgttgttgttgttgttgtttttaacaaagaaatggggggattctttgatctcattttgttcatcttctcttttgagcttgtggtggtaggagggacctgaaccgaggctgggtgattcatctcctgtcctgggcaagttctctcctggggtgctagggtactgtggttggtgacctacaggaagtgtgggaaacgtcaaaggggccaggggcaggagatggctagtatccatttatcaaaaaggtgaaggaggtgagctccacaaattgctacagatgaggcttgtaagtgctaagaaaagctagattgggatcactaggaacaaggcatatcgattttagtttatgttttggatagtagacaaagtatttttcgatttagatgaggcctttgatggaatcctaggacctctccctagaccacctggggatgttgtcagcatgttatagccagtgaaagatccaacttggaaagagtttcttcttggttctttctcaccccttgctctgctgccacacccacgcccgtggacattgtgggtggcctctgcccttgactttgttctgttcataatttggattagtgtctctgggggctactgatggtggtgctggctgagaggaggagcaacaggattgagctctcaggagctctctgtaggctgagcaaacagcagaccaactctggtgaggggaagtttaccagggacatgtgagggacagcatttgggaccagaaaaataactgctcagatacagcctggcgcttgtggcttagtagcagcatgaatgagaataatttttttgagtttttgctgattgcaaactccatacatcagcagagggatgtggccaccagaagagctgctgtgggctcaggctgcaccaatagacatgacgctctaatttcttcatgaacctaacagtggggttgccttctccgacccctggaggcagagtaaatggctctcacctgtgggttcgtcacttctgggaaatttaatttaattttttttttgtaattttctcctatttttctgttctctctggaactctttaatcgtcagattttttaacctactgaattgattcaattttctcatcttttttctactattatccgtttctttatctttttttttctcctttctggaagatttcttttagacttgtgttgaattttttatttcactgtttataatgttaatttctaagagttcttttttgttccttgaatactcattttaaaaagtgttatgttcttgtttcttgggtgtagtctctcatctttaagttttcttctccctctattgtctctgggtttctattttctgtttgtttgtgtaatctctttcttgctagaggactctcctcagatatctgatactccttggctgttcttatttgggtgccaaaagttgattggaaactctgtcttcactgccagggacttggtactcatctggtattgaaatgttttgttggtggacctctgaattccatatctgaaggtttccttccctaccacatctccctactgccagggttatttgttttttccagaaggaccctatcagtagtctcctgcctggttgaccttgcgttcttagggtcaagtaggggaagcaggcttgggtctctgtttggtctgtagatactcacttctgctccaggactcctttgacctctgttgtgctaactctgcaagggtagtatgtttggctgccttgggtgggaagaagacctggggggactttagctgttccttctacaggtcaggaagtcctcctgtattcagctatctgcctcatgctcacctttgtggtactcactgcctcaagtcctaggctcctgggctctaattggcttgtgtctcagttactgtgtaggctttggatattttcttttctcatctaatctaatcttatcttgtaggatctgctctgctagtgcttcctttcgcttccatcttctgaaagcgcattggcacgtcttaactgctgttggttcctcttctttttgttcttgagaatttacttcttttctttctttgtttttttttttttgagatggagtttcactcttgttgcccaggctggagtgcaatggtgcgatctcagctcactgcaacctccacctcccaggttcaagcgattctcctgcctcagcctcccgagtagctgggattacaggcatgcgccaccacacccggctaattttgtatttttagtagagatggggtttctccttgttggtcaggctgatctcgacctccccacctcaggtgatctgcccaccttagcctcccaaagtgggattacaggcgtgagacaccatgcccagccgttctcttctcttctattccttgacaaggtctcactttgtcacccaggctggagtgcagtggcatgatcttggctcactgcagcctcgacttcctgggctcaactgatcctcccaccttggcctccagagtagctgggactataggtgtgtgccacgatgctggctaatttttttgtattagagatgtggtttcaccacgttgcccaggctggtcttgaactcctggcctcaagcaatctgcctgcctcagtctcccaaagtgctgggattacaggcgtgagccactgagtttagatcgttttaaaaaaaattactttacttttattttaatgggcttctgggagggagcagagtttaccttatttaactaaaagctttttcttctatttaacctttatatgttcttttgctttaaatttatctttttatacaagatattgatggattaaacaatatccaagataagaatctgaattttaatacagaagatgagcctgttatatatttactataattattattatattaggatttacctatgctgtcttatttaatgcttgcttgctttttatttttttatttttttattttttttggagttagggtctcaccctttcacccaggctggagtgcagtaacttgatctctgctcactgcagcctctgccttcccaggctcaagggctccgcccacttcagcttcccgaatatagctgggactacaggcgcacaccaccatgcctggctaatttttgtattttttgtagagatgggggtctcaccatgttgcccaggctggtgttgaactcctgggctcaagcagtctgcctgtctcggccttccaaagtgctgggattacaggcatgagcgtaatcccattactgctcccggccaaatgctttatcatatattctctctgcttctttttctcctttcgtatcctttatgtgtagattgaatttccttctgtgggtttgaaaggtaaaggttattcttcttatggttaccataacttattgtgccctcttctttacctcatcactatcttgtgtcttccccacgaaagagacagggccttcagcatggccccgccctgccctgctctcccaacctgtgctggcccagtggcatctccaggactgggttccggggagggataatgcagccctgctcatttgccatcttactcagaactgggcaaggcttattcagggccatcctagggagactccagcattcagtgggagtttggtttaaatgacctctaggctgggcatggtggttcatgcttgtaatcctagcactttgagaggccaaggtgggtggattgcttgagcctaggagtttgagataattctgggcaacatggtgaaacactgtctctaccgaaaatacaaaaaattagctgggcatggtgacatgcacctgtagtcccagctactcaagaggctgagatgggaggatcacctgagcccagggcagttgaggctgcagtgagccatgatcacacaactgcactctatcctgggcaatggagtaagactctgtaaataaataaataagtgatggacctctgaaaaggtccttgaggtttttttgcaggttctgggcatggtagatcctaagggggagtgagatggagaatggacaagtcaatagaactcagaacgccagactttctgaagttcttcctcagtcttcttctctgagacttctactccttggtcctagctttgttcctaggcgctgtgccgctgtgtcatccaccctgccctgtacaatatgcaggaagcaagcgaggagggggtgcctcagagagacagtaaggaggaatgaggacaaggtggaattggcatgggcacgtcctacagagtgagaggcaggccttagggcaccacgtcgctctcacgtaggaatgtgtgtccagcagcgcctagccttcagcttttcacaagaactcaggaaattgaattttctatgcgaaatcttccaacttggacatgttggctcaaaaatgttaataatcttgtgtaggccaaacagcatgtctataggctgggtctggcccagacatggcccatgactatagctctggctggttgatggttctgtccttgtcacccttgacttttctttcttctggataaatgtccagagaaacaaatgtcctctcctgattcattggtttcccccaaagatgtggttccctatacacccctctccccaacagctacttcctctgggcccctgtactttgccagctcgttagtctaaaatcttgttttacaggctgggtgcggtggctcacgcctgtaacactagcactttgggagactggggcgggtggatcacctgaggtcaggagtttgagaccagcttggccaacatggtgaaaaacctcgtctctactaaaaacacaaaaattagccaggcgtggtggtgtgcacctgtaatcccagctactcgggaggctgaggcaggagaatggcttgaacctgggaggcggaggttgcggtgagccgagatcataccactgcactccagcctgggcgacaaagtaagactccatctcaaaaaaaaaaaaaaaaaaaaatcttgttttacaaatgatagccaacccatctagtgcccttcacactcctgggtgctgtttttcacagccatgtgttctgttaagcagattgcaggcagccctggtttgcgttagtaatttcttagtgaatgggtagtgtacaccaggtaaacctcattctcaccccatgagtgtagggcacacacaggctgggttctccaggagcctgtctgcagcctgtgcccacgaggacttgttcctagaagtacgtgaagggatactgtctgctttctcttcgggtcatgcatgcacagaggacatgccgcgccccagcccccagcgccttggcctgcagagggcagagctgctgtgtggcacagaactcaggacctatgagcctccttgggtggcccctcctgcctgctgtggcctctgcggccctggccttgacttcctttcctgtcacttgcgtgcctctgccactgggcctacctctgcccgagtggcaggagcttgcagctttgtatatacgggcagttggtgactcattcctcagcagcccctcagatagggaagtgaaacagccacacctgatagggcctgacctttgggtgacagcagaagtagctaagcagacatgaggcttgcagctaaggagggaagtcctctctcaagccagcctgtgaagacagcacctgcctgccctgaccctcctgtggcctccaggcctgtggctctggtaacagtttcttcctccctccccgccacccccttcttcttggtgacagctggaagtagcagtggtcacaactgagagagccaaacatttctacagcccccaggacattcctgtcaccctctacagcgacgctgatgaatgggaggtcagtgctggggcccctgggctgagttccattgagtttccaccagcaggacagaacagtcctccctacggcctatggtctggcagctggaacagacaggctgggctcaagtctgtggtcagggccctctgggcagaggcaatgaagaaaacatctgtctagcttctggcctgcaggaggccctagtctcctcccggcccaggcagagctgggctttggcctggtgcctgaggttgagtgtccttgtacttatctgggctgatgaaaccacagaggagctctgttcccaccacccttgtccacgtggttcctggcgtcagggctgaagagaacgcctcacttcccacggccgccgggctctgctgcatctcccctgcggatgggtgggcactggctgattcaccagacgctgagtgtgggcctcacaggggttccctgccaggcattttcaaacattcttagcctagaacatttccggctggcctgtcttccccgcccccaccccctccatttctcactgccccggagctttccactggcttggacaacccaagcatccgcctcaagcagacaggccgggagctccctgccagatgtcagttctcttgaaagccaaaccatgaagggaatagctcagagagacaaggggcacttgtttcctcaggcctggttctctcggctgctggctccatggctagcgctcgccagcttagctgcaggagggaacggaggttggcctgggcagggcaggtcagtgggttcctcagtctcctgacttaccgtacctggcctgccttggcgctgcatcctgcttcctccacactgacccctttttcttccctctgccagatatggaagagccgctctgacccagttctgcacattgacctgcggaggtgggcagacctcctgctggtggctcctcttgatgccaacactctggggaaggtggccagtggcatctgtgacaacttgcttgtgagtgatgtcctggtgccctcgtccgtccctgggcctcacacccagtttgctgagctgcagacatccttgtacaaggagacctgctgctgtggggccccggtctgcccagggagatcgtgctccgccattccccacatcgcccccagtgctctcaccttctctgtagcacatgggcacagccctggtcctgatgggtcagtgtgacctgccactgctccccaggagtgtccccctctcccctgcccttgcacccagccaggtgcccacaggaagacccttcttccttgctctttgtccctcctcgtgggctgcctgggtgtgctcttccactgtctctgcccagccccatcgcctcccgcttcagctctgccttctccgcagatctgggtatacacgtgggcaatgtaattgggggttcacttcttcatagatggctcatatacactttatcacccttgtagctttcctgtatattaggggaagcttagaggggaagaggggagaaagacggggcagtggcgagagccgatgggtggtagggagaaatggaagtccagctgtccaaagtgggcactgtcctaggcctaagatgcctccagggagctgttgcccttaaaggggagctgcctttgtttatatgatcgtcctgggaagatttgggtgtgatttctctcctccttctccctaattgccaccccccacctcatttattgagctttcgcctaccacgtactgtactggggtctgttctgagagcctcacaggacacagggagctcccaggctggaaggagaatgccaggcttgatcacccatgccgttgggaagggagtatcctctggtgaggggtacagtcctgaatgaccccagtcagtcctttctatggagtcaccaccttgcatagtgctgggcctgtggtagacatccaataaatacttactgcatgtatgcggtaactagcagttttacttttgcgagtagctgggagtttttcagagtttcatgtggtgaagaaggtggatgatgaagctgggacaggatgttttttggggtcacagattagtgttcttgtatacttgtcaatgggctcttaaggcactcctcaaagaatctgccagtgatttaagcatcatttgaataagagcacagggtgagcagaagaacaacttgtgtggccaggagcaggggtagggagtgcagagaagagagagcctgggtgcaatgtcatcaagaaggctttccctatagtcccagctacttgggaggctgaggtgggagggtcgcttaagcccaggagttctaggctgcggtgccccttgattgtgcctgtgaatagccagaatagccagtgcgctccagcctgggcaacatagcaagaccctgtctctagttaaaaaaaaaaaaagggaaaaggctaggcatggtgcctcatgcctataaccccagcactttgggaggctgaggcaggaaaattgcttgagcccaggagtttgagaccagcctgagcaacatggtgaaactccatctctacaaaacatataaaaaaaattagccaggtgtggtggtgcatgcctgtggtccccagctactcaggaggctgaggtgggaggatcgcttgagtccaggaggtcaaggctgcagtgagctgtgattgtgccactgtactccagcctgggctacagaggtgagactctgtctcaaaaaaacaaaaaggcttcccagcagcactggtgccacaactgacatggcagctgcagctagaacagttgagtttcttggctgctctcatcaaattgggtcagagttgtgtgtggccagcaccatctcaccaaatctccaggctccctgctggcgggtcagcagcagctggtgtgacaaagtactggcctctgggagctaagccccggcctgggccagctctgcaagggcgctttccttcttcctgcaagctctgcttccccttttccttctaagctgccatcacttcatgaaatccctgggcttccctcctccagagttggctgggaagtgaaacatgttcccaagaccagcccccagatcatttgcctcaaaggttttccctcgaagtcacaaatgtttcaaggaatctcaaattttacaaagtttgaagtgtgggcattggtggcctgtggctgtgtcctctctctgtagctgttttctccctacatccctgaaaggaagttgagcctgctcctccatccgcagacctccctttccagcgcccagggcatggggtgctgtgagggcagcatgctaggtgtgaccgtgctcctggcctccaggcccgtgtccctctgtcctctagcccactaaggccctggcccatttgtgctaaacaggcagtcggacctagaaagagcagacaatctctctgggtcaccagtctggctaggagctggtctcctgactgggatccaggccttctcccctgcccatgtgaattcccaggggcagagcctgaaatgttgaacacagcactggccaaagagatgtcaccgtgggaaccgaggctctcttctcctcctgcctgctttcgtgggttcagagtagctgaggcttgtctgagaggagttggagtgctggttttcaccctggttggtgtgctttgctttgagggcacttagaaagcccagcccagcccttgctcctgccctgcacacagcggagcgacttttctaggtatgctcttgatttctgcagaagcagcaggtggcatggagccaagaggaagtgtgactgaaactgtccactcatagcccggctgccgtattgagagggcttggtgggaaactaatgctggtggctgatgcaagcagccaggtcccagggctgtttgctgtcctgcttcctccctgtccctgggacttgggggaggtgctggtcctgtcctgtcggggcattgttctctggactccttcgctcttttcccagatgagcttcccttcaggggaggggtttccagcctgttaccctgaggagctcacagccctggaagaggtgtctggagtagtcagagcactgggagcttctctctcccccaggcggcccccagcccagggagcctgtgcctgtgggaagcccaggagtcactgccctggagcctgtgttttgtgcctggccctgcgctcagagctttgtagccattctcacctcagtcctcacagctgcccagggagggacctttctagagaggaagccaggccctggccttcagtcccatgtccaggttctcacagctagtaatacacacacagctagtgctctcacagctagagcacagtcaggatttgaactcagggctacgtaatttcaaagtccgtggcacaaaggactctgtgagctggatggctcctttcacaactgctcaggtctgtggcttggtgggacggcctggatttgggagatggtgaggctgtgcagtggaacattgcctgggtggtgcccattgtccgggtgtgggcgtggatgactgcttacctctcagggagcagctccctatctgtgaaatgggacagcaccttctttataaggtctcagtgagggttaatgagatcctatatatgagaaggttttggtaacggcagatgttttcattgccagactttagttggcctcggagagctgatgtcaagtagatgagccccacctgaggagcagcctggtcctttgctttctggtgcaaccaaaaaagcctgccttctgctccccagggttgcttttcccaggaggtgtgagcctacctggaggaggcttaggcacagggatacctgctggaggtctgagcgttggttgagcacctcctgtttgtaggatcctgtgccagagcctgtggggaggtggagagaggcgaggagacatagcccccacccctgagggatgagacagctccctgcaggcaggctgtgcccagtcatctcaagcctacagctgggctgctggctgcagggtctggagggcggtggggagggtggcagacagagtagcaagacccccacttccctggccttcttcacagacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtgggtgtcttgccaggcttatagcccagggctgtagaaggggctcagctttggggtcatatctcagttcagttcctggcctgttaatgaccttagcaaaccattctctgagcttagctttctcagctggaaaatgggaatcgtaattcctgcctccagattggtagggtaaaatggggtggaatgtgtaaagtacctggtagagtccctggcacgcagcccacacgcagttaaggatggctactggaacgagtcccagggtcttgccaggggtcttgggagagatctgatgtgtctggctcaggcaaagacagaccttgccctctcaggccttgggctctgggtggagcacttggagcaatgggcaggggtctgcagggctacaggcactgttggcctgtctggccacagcggaattttgctcccaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatttaggagactccattctttccctacaacccagctgtggtcccagagatcagggggtgttgccaggtgtggctggggaagggtctgggttcacaactcaccggcactctttagtccccgtataacatggtggttaaggataaagatctgaagccagacagcccctagttccaatcccagctctgccgcttactagcagtggcagtttggttcaggacttagccttcctgaccttcacttacctcagctatcttgttatcctaccctcagggagttgttgagaggattcagtgaaattttgtgtgcagaatacccatgccactgagtgcctggaacgtagtaaatgtcaaatcaatggaagttaaaactaggcatgcatatatgccagagagctttcctagcatttactgcaatgccctgtctcattttgggaaaaaggaaatcctggatgctaagttgacacatccctttatgcaagtgacaggtaagcagccaggagggttgaccctgccctgggtcccaggcctcttgcctgcttcttggtttcctctgttctcatcctttcagctttgctggacctgaggcaggggcctgggtgtctgtgcctccctaccccccagtacacatgaccaagggaagtagatccagagacaccatgcactctggcccagaaaccctctgctacccagcttttgacttaattgccatttggtgtggctgcagcggggagggcttgtctgcgtatttggagctgaggctgaggctggcttcctgccctctggcttccaggccaggtgtgagggacatcccatgtgggctctgagagcactgagagtagaggtgccttgaggggaccaggaagcctactggctggaatcagtgctccagcagcctccacagcctttatctcaacagcacttgacttcaccaggtgaccctttgggataaaattgccttagggtatgaaataaactataactaaaatggtagcatcaagaaccaacttctttggctggtttggggatggggcatggggagaacctgggtaactgaaacccggagacggtcccaaaagtccatttacagggtttccaaattccttcttgtccacattgcccttcctctccctcagcaacccactagtaaatggtgaggcttcccaattttatttttatttattttttgagacggagtcttgctctgtccccaaggctggagtgcagtggcgcgatcacagctcaagccattctccctcgtcagtctcctgagtagctgggattacgggtgcccgccaccacgcccagcttatttttgtattatttgtagagatgggttttgccatgttggccagactaatgttgaactcctgacctcaagtgatctgctggccatggcctcccaaagtgctgggattacaggcgtgagccaccgcgcccagccgcttcccaattttaacagaaactgatagcattttctgagtgttcatcgtgggcgaggatctatgccagggattttagggaaggcagtcacccagggagatcaaccacaaagtgcctgtgtgaaaaggccatgggagcagggaagttcacaggccactgtcccagagctctgaaaacagctgtggctgctcagcaggactgcgccttgttggctagaagggaacatatatccctgtggactcaggccagctggaggcccctgtccctgggggttcgtctctccatctcctacccacagcagtcctgcatccctgccgcccattttgaagcggggggtctggatgaatgggtctgggctgggcctaaagagcccagctgttccctgcaccagactggagctaagaggagcaggtgctgcatttagctggccccatctgccaaggaggtgctgagtggggagtgacaatcactgctttccccacgaggggtccaagcacttgaagttaccttcatcttggggagaaatgtttctcagagaagattctagcctccctgatgattttttatagaattctggaagtttcagagaatagaacatttgggtctgaaatgtgcactcttttgtggcagccatgagcccttcaaggctgctgtggatgctgctgggtgggaggcagaagccaccaaaccaaggcccagcttccaccctgggccgcctccagcccttcctgcaccccgctggtcaggtgccgctgctgcctccccactgcctcaggtcaggcccagactcctgggcagtacacacctggccctttgtgatctggctcctgcctacccttctagcactgccctttaccacatgccaaccctgaagggctccgtattctcttgccagactggacaaccttgaacttgtgaggcctcttgcctgtgcacatgctgctgcttttactgggataagactgactcccacacatgcctgtggatgtacctgggtgctacctcctttggaaagccttccctggccaactgcaacctccttgcccaggttgccatggtgcttcccactattattttttatttttatttttattttttgagatggagtctcattctttcgcccagactggagtgcagtggtgcggtctcagctcactgtaaactctgcctcccaggttcaagcaattctcctgcttcagcctcctgagaggctgggattacaggtgtgcaccaccatgcccagctttttttttctttttcttttttaaaatttttagacggtgtcttgctctgtcgcccaggctggagtgcagtggcatgatcttggctcactgcaagctccgcctccctggttcacgccattctcctgcctcagcctcctgagtagctgggactacaggcgcccgccaccacgcccggctaattttttttttgtatttttaatagagacggagtttcactgtgttagccaggatggtctcaatctcctgacctcgtgattcacctgcctcagcctcccaaagtgctgggattacaggcgtgagccatcgcacctggcctgattttttttttttttttttttgtatttttaatagagacggggtttcaccatgttggccaggctggtctcgaactcctgacctcatgatcttcctgcctcggcctcccaaagtgctggaattacaggagtgagccaccgtgcccggccaccactatttattacaacagaattgtaattgttagtttactttgtgtcctcctaacattgggttctcttggagagcaggagttgtcctgttccttacagaacccagtaagtcactccaagcttgtactgatcaaaaaagtggtgtgtgtgttggggctattggttcctgctcctttctgtgcaagagacaaaatttagcaaccacaaaagcaaagattgataaatttgactatagaaaaataggttcactgagcaacaacccaaagtcaaggtcaaaggacaacatgctggggaaattatctgcagctcataaacaaagggctgattctcctaatatatgaagaactcctatgcattgatgataaaaagaccaagggccgggcacaatagctcacacctgtaatcctagccctttgggaggccgaggtgggtagattgcctgagctcaaggagttgagacccacctggcctacctggtgaaaccctgtctctactaaaatacaaaaaattagccagacatggtggtgcatgcctgtagtcccagctacttgggtggctcaggcaggagaattgcttgaacctgcgaggcgggggttgcagtaagctgagatcatgccactgaactccagcctgggtgactgagcaagattccatctcaataaaaaaaaaaaaaaaaaaaaagaaagaaaaagaaaaaggaaaaaaagaccaagaacatgtattaaaaagtgagcagaagatacgaagaattcacattaaaaacaaaaaaaaaaacaaaaccaaaaacccagtcacacaaagggcccttaaacagctactcagccacattcatgaggagagtggtgcaaatcaagctagacctaaaacttttgcctgttagactggtgggggtgtggggaattggtgccctcatgcattgctggtaggagcgtaaattgatggcaacttcactggagaacaatctcggagtatctatcaaaactacgtatgcaccttaccctttgacccagcaattctacttctagggatttgtcccacagatacactcacttctatgacattatgtctaaacagatttattgcaggcttgtatatggtactgaaagaccaggccaggcacagtggctcacgcctgtaatcccagcattttgggaggccaaggcgggcagattggctgagctcaggagtttgagaccagcctggcaacatggcgaaaccccgtctctactaaaaatacaaagtcaggtgtgatggtgcatgcctgtaatcccagctactcaggaggctgaggcaggagaatcgcttcaacctgggaggtggaggttgcagtgagccaagattgcaccactgcacttcaacctaggtgacagagaaagactctgtctcaaaaaaaaaaaaaaaaaattacatatgcaccttaccctttgacctagcaattctgcttctagggatttgtcccacagatacactcagttgtatgacattatgtctgaacaggagatttattgcagcctcgcatatggtgctaaaagactggaaacaccctcactatctaacagccaggagattggataaataaattagtgtgttccttcatacactggaactctacacaaccataaaacaaagtgttgaggaagctgatttgggaagacttctgaggtacattgttaaacagaaaaagcaaggtgcagaagaatgtcacatgcatgcttgtgcagaaaaaatgggggtggggaaagaaaaggaggatatattcttattggcttgtgtgtgcatcaaatgcctttaaaaagataaacagagaaaaacattgtctattgtttttctcttggcaggggaactaactgagtggttgagaaacaaagataggaggcaggccaggactccgtctcaaaaaaaaaaaaaaaaaagataggaggtgacttcatttttaattgttgggccagatgaatatactatctaccacaaaatcaataaatacattttaaaaagagttccttgtggtcaggcacagtggctcacacctgtaatcccaacactttgggaggccaaggcagagggattagtttaagaccagaagtttgagacaggcctaggcaacacagtgagactccatctctaccaaaagaaacacaactaactggacatggtggcacacgcctgtattcccagctacttaggaggctgaggtgggaggattgcttgagcccaggagtccaaggctgcagtgagctatggtcatgccagtgcactccggcctgggtgaggagtgagactctgtctctaaaaaatttaataataataaataaaaatataaaaagatttttctgctctttttgtttgttttttaagacagggcctcactctgtcatccaggctggagtgtagtggcacaatcacagctcactgcagacttgactttctggggctcaagtgatcctcccatcttagactcccgagtaactgggactacaggcacccgccaccatggcccggctaatttttgtatttttggtagatacggggtttcaccatgttggccaggctagtcttgaactcctggccttaagtgatccacctgcctcagcctcccaaagtgctgggattacaggtgtgagcctggcctctttctgttctttatctggaagttcttaaaaatgatggcagggagttactgcaaacaaacacacagacttggcagaggcatctggaaattttctttttgtttttgagactgggtttcactccgttacctgggctgactgcagtgcagcagcacaatcacagctcactgtagccttgaactccagggctcagttgatcctcccaccttagcctccccagtagctgagactacaggcacatgacaccatgcctggctaattttttattttttgcagagatggggttttaccatgttgcccaggttggtcatgaactcctggactcaagtgatgctcctgccttggcctcccaaagtgctgtaattacaggcatgagccacggtgcctggcctgaagatattcatcaaggcctttggagtagaaatgggtctgcttttcttgtcacaagctaacagaggaaaatgaattttgagtatccttgtgtgcttttaataaacctttgagatccctgatctcaaggaacttatgttcttatgggagaaagattcacagtgatcaaataacagcaaacaatgaaagtgagactgtgtggcatggactctacttcagaattgagcagtcaggatgggtcccctggacggaacagaacttgggctggggcttacaggaggaccaaggatacaaagggtgaagacatgctgccatgtgcttgatgtaggacacccagggaggaactccggctccacgtgctggggaggttgggagctgttcagtaggggaggcacatggtgagtgtggcgtgcggtcaagatcagcggggcggtatgtgcaggacagattgggtctggattgagaagctggagtctaggaggaagccaggatgctgagaaggggaatctaggttgtgctgaaggccttgaccacacccctgattctggaaaaggggtgacaaaagtaacaatgtgaagaaaaatcaacaccattaaaaactgtaaaaaccacggtcttttccaaaggtggtgtgtactaaaaacaaaacaaaacacaatatccaacaaacaaacaaacaaaaaacaacccactgtccttgtggccagtggagggagggagactaaatgacactgtatgtgtgtgttggtgcaagatttatagcaatcttcagccccacccatgaaaaataattttgctttgcttattatagtatagtttttttctctctcctgacctcacagtattgttcaatctgtctttgtggccaggcgcagtggctcatgcctgtaatcccagcactttgggaggccaaggtgggcagatcacttaaggtcaggagttcaagaccagcctggccaacatggtgaaaccctgtctctactaaaaatacaaaattagccaggtgtggtggtgcatgcctgtaatcccagctactcaggaggctgaggcaggagaattgcttgaaccggggaggaagaggttgcagtgagctgagatcgtaccactgcactccggcctgggcagtagaatgagactccatctcaaaaaacaaaacaaaacaaaaacaatctgttctgtggttcctgggcactttgtggtgtgggattagaaaaacagattggtggtggctcacgcctgtaatcccagcactttgggagaccaaggcgggtggatcacaaggtcaggagtttgagaccagcctggccaacatggcaaaaccctgtctctacttaaaaaatacgaaaattagctgggtggtggcaggcgcctgtaatcccagctactcgggaggctgaggcaggagaatcacttgaacctgggaggcagaggttacagtgaaccgagatcgtgccattgcactccaacctggatgacaagagcaagactccgtctcaaacaaaaaaaaaaaaagaaaaacagattgagatacagaactgggaagatgggaacaaatggaggagtgaaggaatctttttgtttttttttttttgagccagagtctcgctctgtcgcccaggctggagtgcaggggcgcgatctcggctcactgcaagctccgcctcccgggttcacaccattctcctgtctcagcctcctaagtagctgggactacaggcacccaccaccacgcccagctaattttttgtatttttagtagagatggcatttcaccgtgttaaccaggatggtctcgatttcctgaccttgtgatctgcccacctcagcctctcaaagtgctgggattacaggcgtgagccaccgcgcctggccaaggttttttttttttttttttgagatggaatcttgctctgtcgccaggctggagtgcagtggcgcaatctcagctcactgcagcaattgtgattgaggttctttttaaagccctttgcaatgtgtgattctctgagtgcagctgagcaggactgaactgtgtggagccctagataagacttgggttatgggtacgtgttacatgttctccatattgccaagtgtttctttaatctcatttcaccctcctcacataacagcttcacgatggagtcaattagcatatgtagctgtttcatagacaagaaactgagggccgcacagccagtgcagtgtgctagggttttctctttctgccctacagctacctgcaaacaggctcctgcacaggacttctacccttatttgcatttacctccttggggtcagttgaaacaccccttccaccatacatcagcatccccagatgcctgccctttcagtcccaactggacagctccttcattacctttttctgctcatggcttccttccttcatgtattgtggtttctagggcaggatgaaaatcctaagtgtcacgcaactgcctctgagcaaagaaatcaaccccaataactgacaagttgtttacactgagagcttcctggtggaaccaaatattctacaatatttaagccaggtttggtaccccttgcggcaaggcaatgggaatgatcaggccagaagaactaccagttgtctcatagcaaaggaatgtggggagtgggtgggtgtgaggacaagaggcagatatgtgagcttcagggcttttggaggacatgcagctaatccaggtggaatctgggagcatgtgtcgttcccttgctgcaatgggctcatttcatggtggctttatctgctgagattacatggtgatgctttgcctgctagcctagacagcaggtccttagggactggaggcccagcagactccctttcaggcctctggattcctggaagaggaaggagtgttcaaaggtgaattaaaaggtgccttccatctgtgtaggcaaaacaatgttaccagccatagcgatggacttggaagcagccaacatgagttgaacatgaacacatggatgctgaagatcctttctttctctctttaaattttcttttttttttgagatggagtctcgctctgtcgcccaggctggagtgcagtggcgctatcttggctcactgctagctccgccttctgggttcatgccattctcctgcctcagcctcccgaagtagctggactacagacaccggccgccacgcctggctaatttttgttgtatttttagtagagacggggtttcaccgtgttagccaggatggtctcgatctcctgacctcgtgatccacccgcctcggcctcccaaagtgctgggattacaggtgtgagccactgcacccggccctctctttaaaattaaaaaaaagaaagttttttaactttaactaggtcctgaccagacataaaatttttttaattaaaaaatttttttggccaggtgtggtggctcacacctataatcccagtactttgggaggccaaggcagatgaatcacaaggtcaggcgttcaagacccacctggccaagacggcgaaaccccgtctctactaaaaataaaaaattagctgggcgtggtggcgagtgcctgtaatcccagctgctcaggaggctgaggcagagaattgcttgaacccgggaggcagaggttgcagtgagccgagatcgtgccactgcactctagcctgggcgacagagtgagactccatctcaaaaaaaaaagtaaataacatttttttaagagacagggtcttactctttcatccaggttggactgcagtggtgcgatcatggctcacatacagcctcgacttccctggactcaggtgttcctcgcacctcagccaccagaggagtagccaggaccacaggtgagagccaccacacccaagcaatcttcctgcctcagcctctcaaattgctgggattaaaggtgtaagccaccgctcctggccctgaagatttcctcctctcagaagagaccgtggcctggccctggcttgggagctgatatgttacctggaacttctggaaattgctctcctggcaggggagaagttgaattctggtgtgccatgcttgggggaagctggcatgatggagggaagagagagaaggctgtggaagggaactcaggtttatctggctcctggcctgtgccagaccctgcatttaagcctcctaaacatccttccagatgggcattgttattcccatttaagaaataagaggctgggcggctgggcgcggtggctcatgcctgtaatcccagcactttgggaggccaaggcaggcggatcacgaggtcaggagatcgagaccatcctggtgaacacggtgaaaccccgtctctactaaaaatacaaaagattagctgggcatggtggcaggcacctgtagtcccagctaatcgggaggctgaggcagaagaatggtgtgaacccaggaggtggagcttgaagtgagtggagatcctgccaccccactccagcttgggtgacagagcgagactccatctcaaaaaaaaaaaaaaaaaaaaaaaaagcggctggacacagtgactcatgcctgtaatcccagcactttgggaggccgaggtgggtggatcacgaggtcaggagttcgagaccagcctgaccaacatggtgaaaccccgtctctactaaaaatacaaaaattagccaggtgtggtggcatgcacctgtaatcccagctactcaggaggctgaggccggagaatcgcttgaacccaggaggcggaggttgcagtgagcagagattgcaccactgcactccagcctggatgacagagcgagactctgtctcaaaaaaaaaaaaataaaaaaagacataacctgtgctaggtgtggtggtgtgcacgggcaatcctggctactcagaggctgaggcaggaaaatcgctttagcccaggagtttgagtctacagtgtgccatgactgagcctgtgaatagccactgactccagcctaggcaacgtagggagaccctatctctaaaaaatgataataataagaggaacctgaggcccagaaagaaggatataactgaaattgacccaatagttccatagacagcttttcctgataaacagaaattgacatatcttgtcttaaagctggaaactcaccagattcagacaatgagataccaggtctctcaaaaagtatcaaagaatctcatacacagtttttcctgataaacagaaatggacacatctggtcttaaagcttgaaactcaccagattcagacagtgagataccaggcctctcaaaaagtaggaaagaactgaaactcacagagcatagcatccagacaatgagacccaggcccctcattatcatgattgcttccttacccctcaggagttcctgttttcccttacattgttaagtttcttccctgctgtacaaacccctaattttagccagggagatggatttgagactgagctcccatctccttggccacagcactcaattaaagccttcttccttggcaatcctgtgtctcagtcattggctttttgtgtgaccaacagcaggacctagaccaaacccctggtgtgtcagcaacctaaccacaaaccaagcatggcctcttacaggggaaagtagaaatagtggtgctgctaacacaggctggacctgagctaggaatagaaagaaacacaggctgactgtattttgtctaaactgggcacttctgagagtgaaaaagggcaattaacatgccaggaaaataggcatcaactggactgttctgggcaaaccagcatgtatggtcactactcacagagcaccagaaggaagccatgctctgtgaagcaatggccaccatttacaatttaattctcacagcaaccctaaggtggatattgttgtcccctggccatttctcctgagagcaagaatttgacaaatgaggacgctgaggttcaaataagttatttaactttctttttttttgagacggagtcttgctctgttgcccaggctgggggtgcagtcttggcttactgcagcctccacctcacgggttcaagtgattctcctgcctcagcctcctgagtagctgggactacaggtgcgcatcaccatgcccagctaattttttatagttttagtagagacggggtttcaccatgttggccaggctggtctcgaactcctgacctccggtgatccacctgcattggcctcccaaagtgctgggattacaggcgtgagccactgcgcctgaccggttacttaactttctcaaggtcccacagctagtaagtgaggaagctctggcaggctccaagcccttgctctttctgtgagtcatgttgcctccaaggcccagggccattggaggaagaccagaggaggaggccagctggagggaacaaagcttgggtcttggagggtgacaggccagtcaccagacaatccctgaagtctccatatggcctctcccagggctggcttgcaagagaaggtgagtgtgtagtgggggtttagggcggggtagaggccccccaggcttccacaaggatcgtcctgggcttccaggaaggcgtgaccaaggcagaggcttgcctgggaattttctaggaaagaagtcatgccctgagttgccccatttttatgattggagaacaggaacactgatacatcgaatggcaggtatcctggagccaggactgtcccctctggtctatagattctgccatggccctggctcagtctctctggaactcagagaatcgtggtggtctgggatgcaggaatactccagattagcagcagaaggtgtgcaagcatatgcatgcatgcagaatttgtaagcctcaggggttagttcttgctccattcacaagccagcctgaccctccagagtggaccagtggccacagcatagaaaatggagggcacaggccaaagctcagatggcctttggaatcaccttgacttatgacatcacaggcagatgggtaggaaataggccaccagtcatccagtcaggtggatcacagcacctgctcgcacctgggcctgggccagtgctggctctcggggacaagtctgcctgcggtacttcacacaagcacaatggcctgaggcctctgcaagccaaagttgcataagcaaggactgatcatatgtcttcattcatttattaatttttttaattagtaaggttatttgaagtagttttaagttcacagcaaaactgagtggaaagtacagggagtttccatatcccatatcccactgtccccacacatctacaacctcctttcattcattcattttttttctttttttgagatggggtatcactctgtcacccaggctggagtgcagtggtgtgattttggctcactgcaacctccgcctcccaggctcaagtgatcctcccacccgagcctcccccgtagctgggaccacaggtgcgtcccaccatgcccagctaatttttttgaatttttggtagagacagggttttgccatgttgccctgtctggtctcgaactcctgagttcagacgatccaacttggccttccaaagtgctgggattacaggcatgagccaccatgcttggcctgtgagaaaacatttcaagtggtcagttttcaaggcatgataaatctaagtactggcagccagcctgaaaatgtaacaaaccacagggctcatgcatctagaaggtcacaataaacaaacagaatgtagaagaggggtcagctcataaaagggaaaaaagtttcattattgggaaatctaaacttaagtggggaaggggatggggtataatcttataagggggataagaaaacgtaggcaatatccgggaagattgtaaccccatagtactcaaccaatgaggaactgggggagggacttctgtgctaagggataaattacctgctgtgactgtcccaggcgtgcctgcctgcaagacacctgatcttgcaagaccactattagaagtctcactttaactgttcttcatgcctctaagtccattctttgggtttggacaggtgagcatgtttctcacaacctgggggcctgtctgggatctctgtgcctgcatggagtgggactctggccaagaggggagacatgtcctactcaatttaggtggcctgctctgtcgggcatcccggctccccacagaagccatagacaaacccaagacttattcaggagacagttgagatgacacagggagaaaagcgggcatcgtggcaaccaggcaaccttgtgtgtgagccaaggtggaaaattggactgtaagtactgccttggtggttgggcattttcggcggttgagtgtgtgtgtgactgagacgtatcttagatacaaagtgagtgcggagtcctaatccgtggttctgttctcccgagagggaaatggctggacacagatgaagcgattctcggggtgtgcaagaaacctccagtaaaggggggttgagtacacagggaaactcagacacagagactgactgaaaatgggaaacaggaattctaggcctaggggacaaaggaaagagggagccaaagagactcctctgacattcccccagatagtcctttggggagaatgtggcaggtttggagggacaaccctcgaaccagggacaaggaaaagcaaaagataataaagcattgctgttttatctggcccaaagaccccatttgtaagccttcagggttttggcccaagtttggctcagatgaggattgggtgtgccaagttttaattctctatgtgaatgataaaaccccaccctcacaagaagagatgttatgctctctgctggatcaaggaattagcccccatgtttcccttcaaagaagaagaaaaagagcctagtaaaaagccctcacccagggaaaagccctgggaccccctgtcatacatgccccctccatatgtctcacaaaataggggacaggaagatcaaggggcagcaggagggttagaggaagaaagacctggagaccatggggaagctgaaccaactgctcctttaaatccttatccaaatttgaaaaaagaattagaacagtgtaagagggatattgaaaacttccctatccctttcacacagcaggcatctagcatgttcccttttagggaagttctcgtgggacagggagagattggctttgtaaatgctcctcttacaagtactaatgttaggaatttcaagaaggaaatgaaaccactcctagaagatcccctcggtttagcagaccaactggacaaattcataggacccagcttttacacctgggctgaaatgatgtctatcttaaatatcctgttcataggagaagaaaagggaatgattaggagagtggccatgactatctggaagaggcaacaccctcccaggcaagaagtcttgacagtcgaacaaaaaacttccaaatgtcaatcccaaatgggataataatgatcccagggactaggcccaaatgcaggacctcagagaactgatagttaaaggggtcaaggagcccactcctaggacacaaaatgtctcaaaggcattcgagattcaacaagaaaaagaaaactccctctgcattcctgcagaggccagagatcagatggaaaaaaaaaaactccagattaagttcagagaacccagtaaggcaaagccttttaaaagttaactttgtaactaagagctggccttgtgggccaggaagtgcagctgcaggttggggggtggcaggtgtcgcagagcaggagcagacagctgaaataaaggtagacagtgtgagagagctagtgtgagtaaacccctgataaaagaactaatgtctatagtacacaaagggagtcactggggaccccaggctctgtgtaatgcaatacttagtgaggcagccttgttggctggggtggatgccaggattcttggtcttgcagctggggagattggggttgcacaggtggagtgggtttggagtaggaatttcgtggccgtgggagggaccagctctgcattgaagggggggtcctgagccggttgccaagttgcaataaaaatgtcagagttttcataaatgggctagtgaggagggggctagtgaggaggggatgtcttatcctcctagggcccaatgatttggttgtgaccagatgtgctatctgtttagagcagagtttctatcagcctttacctaattgtgtcacttatctgggagggagagtatctgtgtctgttccaggtatcttgcagcttcaggcacccacccccacaccccagtccacttttagcttccctatcttagtgtgcctaaagggaaaggaatgtgcttattaaggcccactgtttttactggggcccattgtatgagagtgaagtttggtgattacccaggagacttcccccgaatctcgatcccccccaacccccctccttctgtgcttgagctctttatctgtgatttacaggctgagctttcaggcgccatttgttagaagagaagtaatttctttgaactgcatgaggttagaaagggagctatttctgagctgctttttaatagaaggaaagttttctgccagggactcactttaccttgtctacctaaatttctttctgcctcctataacattaggaattatgggtgtatagggacttataccctcactaaacaagtatgtggaaattgtgtaacttgtcaaaggataaaccaaaaggtaattagaaaacaggccacaggaggaagacctcctggactaagaccatttcaaagcattcaagtatattttacaaaaatgctcaaagtagaaagacgaaagtatttactggtgatcgtagatcacctttccagctgggtggaagccttttgcctcccaacagccaccaccaggtatatggtcaaaattatattagaacagattgcacctagctttggcctggtgaaaaatattgattcagacaatgagagccactttacctcaaaggtgttaaggggaattatggaaggtttacaaattagatgggattatcacaccccttggcatcccccttcctctagaaaggtagaaagaatgaatcaaactctcaaaaagcatttcaccaaactaatcttagaaactaaaatgcttggaccaaatgtctcccaatagcactctgcaggattaggacagctccaataaaagacttgggattgttcccttacaagttattatatgggctcctgtatttaggcagagctacagatctccctactatggaaaccaaggatcaattcttaagaaattatatactggccatatcctccaccctgtcatcccttaggttaaaaagacttctaactcaaactccacctcttaagtttgtggttcaccacttccagcctggtgacttcatgctgattaagacttggaaataagacaagctccacccaagctgggaaggtccctatcaagtgctcctgaccactgagatggccctgcaaacagctgaatggaggtggactcactatattcgagtcaagggactggtaaaagagatcccggaagggagggaaaaagatcagtggaaagtgcccgagtctaactttaactcttaactttaaggaacccttaaagtgaactctaagaaaaatctaaaaagaaaacatgagctggccccatttctggaaattaacatggctgggatgggctaatatacaaagagcagaaggtcaaaatggaaactggcagcagactcttctctacccagtcaggttggtgattaatgtgaccaagacagtagcaccccagactataagatttaatgcctgccaggttttaccttgtggaaatttaaaaaatcagagacagatctcacaggcagataaatatctttgccctaaaccaaatacaggttacagtagggcatcaccctaccccagctgggataatatatggtggactacccaatttcagggctggacagtaaacatggggtgggtaactccaagctggagacccctaaagaataaactacatctgtccaagagctccctgccaaataactgccagaatttttttctttttttttgagacagagtctccctttgtcgcccaggctggagtgcagtggctgatctcggctcactgcaagctctgcccctcaggttcatgccattctcctgcctcagcctcctgagtagctgggactacaggcgtctgccaccatgcccggctaattttttgtattttttagtagagatggggtttcaccgtgttagccaggatgggctagatctcctgaactcatgatccgcccgcctcagcctcccaaagtgctgggattacaggtgtgagctgctgtgcccggccccaaagcacactctcttgacactgcatcctctcgctcagcctggggaggatggagtggtgtagcagtcgagggctttgcataaccagatcaacaaggatgcctcatttacaggtccactcagtccatctttactgtatgtatatgtgctctgtgctaggcactgtgcccagtgctgcggacacagtggggaaaagaatccacatgctccctgccctcagggtcctttctgagatagctgcccacaggtaaggaagagtagacaccctgataagcaccatggaggaaaagtacggggtactgagaggggataaccttggagcctaatttaggcaagggcaggggttttcaggaaagacttcctggaggaggtaagtggaagcaagatgagtgaccaggagttcgccaggggaagatgaaccagggcatttcagacccaggctattacatgtgcaaatgtgggaaggggaagagctggctggggcacataaaagttttgtgagtggggcagagtgcagtgggtgaaggagggcagattgagtaggggcccagtgaggcagggactgggtggggatcatggagaggctctgggaagccaaggtggtacttgggaaacaagaactccctctttttcccatcaggtaaatgataaccacacactgcatgtagcctccttagctaatagcttgggctgcattaatagtggtatagcatgcaggtcaaaggaggtgatttttcctccttctggctcagactgcatctgaaggattgtggtccttttggggcccctgctgcccaacatctgcaggagaagagccagcatgctgaaggctttgcaaaagccaggctggatgagcagggaagagcagcctcaggggacaagagtctatcctagaactctgagaaatgacctggaggcaaagttcagccccagagaaggaaaatgtcctggcacctagagcttatggaaatggagggagtgactgagggagtgagcctcctgctctggggaagtttgaggagacactggaggactagaggtgtgaagagggcccctgcttagcttcatgggtggcctagaatcagtccttgccattgctcgagcatctactgtgtgctccctcccttccaccttcgtgctggagactcaccacacatgtcccccaaacacaggattttggacctcacaaatggtggggctgacccaggctagtctggggcggactcaggtcttttttctgctcagactgctttgggggaaaccagggattgggaatagtggtggtctcaggcccatgggctggctgctgctagtcaccctctgaagttatctcccggggcctgcctttcagagtcctgagtgtgttctggtgctctgaaccctccaactgtcagccataccgtcctcacctattcgaaacttgagaagtcaacacatccctcttccacttccccttcaactgtgtgcagactgggacttcccagtcgtctctgggtgttccccaaacagaaggctgccctggctctcataccccagacctctcactcttggctgcctctgtctctgatgttatgttagtccccaggccctcaccttctttcttggtaatggctccaactcattcccatggctctttcccactgccatcaccgggcctccagagctggcttccctggaggtcctgccacctaccttccactccccgcttggcctgtctactctctgctgagttctgagaccagggccagttacagttttttaaaaaaattgaagtataacacatatggtaaagtgcacacatcttaagtgtacagcgtgatggatttttttttctttttgagacagggtctgtctctgtcacccaggctggagtgtagtggtgcaatcactgctcgctgcaacccagccttgacctcctgggctcaggtgatcgtcccatctcagcctcctgagtagctaggatacaagattgtgccgccatgcccagttaatttttgtagagatggggttttgtcatgttacctgggctggtctcgaacttctgggctcaagagatctgcccacctcagcctcccaaagtgctggagttacaggtgagagccaccacacctggctggcctgcatgatggatttttagaggtgcacacacctgtgaaccaccacccagatcaagctcgagaactttttcaggcccattctcccaaaaagctctgtcctctaggctcccacagctttactgtgggatacttggcagataattgccttacattccaactagctagagggccgggacccctcctgtttgctgtttttgtttcaccctgccaacctagcatggtgcagtgctcgtaggaagtgcccctgaggcccattagatggaggggtttagagttcattcacagtgttccagaatctgtgcccagttgtccctcagaaatgtgggagaggtgacagagatggaggatgaggtcaccagagcgcacaggatccctgagcacccagtgtgctggttctgctcaggtgacctgccaccccagggatgatatgcacagggctggaggcagacattctcagcagagggctcaggagtgtggaactccttgtatggacgccctgcccagtggacacaggctgcagcatagctctgcccaaactcccatcccagacccagagacacctgtcttgagtgcccaccatggcaggctcagagatctgaaggaatagggccaggctgtgcttaggggagcctttgaagtcaggcgcctggtgcagaacgctctgggagaggtcagaatgcatagcttctcacctggagggtaagacctccttggctggcttccccctttccctggaacctgtcccttccctctccttggtgcagggcccagctagggagatgataccaccaaaggaacagagtctcagcctagacttgagcagcaagatggggatggcaggtggctggaggtgggtgggaaagcagggcagcatgggtgtatggtgcataaagtccaacagctgtcttggagagctaggtctccaggctgccagaagactagaagatgcttcctctgctctaaggcacaaccctccaaatctttgagggggagagaaagagcccttttctggggtccagatcccagttgtcactgggagggtttcccttgggtggactcttgagtcctggagaccatattgttcctgtctcctctttgactgtagtaaatacgggtctcacaccaggcttggggctgctaggtaaatctttgtttttacatcacatctgctatttcggtgatcgatgcaggccttggatcccagacaccaacatatgtcttcttaaccacttgcttaaggcagcatggtggcaaagtcttattatcagagatggtctgtccctccatgattggtagaggcatggccttgagcatatgaggtcaaagagggagggaaagagaaggaagagaaatgaacatcaatggtcaatgcaggtggtaagtaccttagatgaactgaagtaccttagttcaacttctgaaaggggaagcctgaaaagttaacatttctggagtgtctattctttgacaagcgcttgcttgctcttgtgtgatccacaggatgtcttactatcttcattttactgagaaggaaattgatgctcaggggagttatccaatcagaataaaaaagcaggcagatatggagctggattttgagccaggtgtatccaactccaaggctggctccttctcctccatggaatgtactctctaggggccataagcatgctttcttggtgagatgtcctgtcccacaccaaggagcccctctccagagactttttttgagatggggtctggctatgttgcccaggcttgtcttgaactcctggcctcaagtgatcctcccaccttagcctcctgagtagctgtgattataagcacgaaccgtcatgctcagcttctctaaagatttgagggaagcttccaacatgtaagagagaggccaaaacagcagaacaaatggaactcagaggaaacaaagatgatgcaaagagcagaagaaaatgttgaagaaactgcaattgatcatctcagagagattggaagatatattgcatccacaaaacaggaactggatgccatagaagggggagcaatcagagaacaagaatttaaaatgtgagagagtggtagaaagataaaatcaaggaaatctttcagaaagttacacagaaagactcagagatgaacaacaggatacaaaaaataagaaaattagatcaatctgagattcaacatctgactgattcaacttcctgaaaaagaggacagagataataggtgataaagagttaaaaacacaataaacgttttcggaaacgacagaagtgcttaattgagagtctagtgagtgcctagcaaaatgaatgtatataaaacaaagcaaaatctctcaccaaggctcatcattgtgaaatcttagaacactaggattaaagagaagattttaggaagaggacatttggaatgctgtcaggaggagctctgcagacaaaacaaccataactgatgaaaaataattttaaaaacaaccattcacattctctggaatttttcttaaggccatatggcagataaacatttattggccagatgcagtggctcatacctgtaatcccagcaatttgggaggccaaggtgggaggatcacttgagtccagcagtttaagaccaacctggacaacaaagtgagaccccatctcaaaaaaaaaaaattggccagagacggtggcacatacctgtggtcccagctacacgggaggctgaggcaggaggattgcttgagcccaggaggtcgaggctggagtaagccatattcgtgccactacactccagcctgcgcaacagagcaaaggggcttgaatttaatttgatcagactgtggagaaatttatgcccaagtgattataaaacaatagaggaaccagtcagcagttagtagaggctaacagttgtgtgatactaatatacaggttaacagaaagctcaagaacagacacaaagaaagccatcttaaagccattgtcattccagggtgacagtacacacgcacaaggctgtggcttcttaggcatgacgtcagaaactgcacacagccgggaaataaacttccctaaaatagtccagccaggccactaaataaataagcaaacaacaaaaacaagaagctgtgtgcatgtggcagaggggtagtggttagtatccagagttgctacaatttattatctgaaacattaatatattttattttattatttttttgagacaaagtctctgttgcccaggctggggtgcagtagtatgatctcagctcactgcagctcccacctcctggattcaagcaattctcctgcctcagcctcccaagtagctggaattacaggtggtgccaccaggcccagctaatttttgtatttttagcagagatgaggtttcaccatgttggccagtctggtcttgaattcctgacctcaggtgatccacccaccttgaccttccaaagtgcggggattacaggcgcaagccaccgtgcctggcgaatgttaatatattttatgctataaatatatattattttagcataatatataactatgtatatactatatataagtatattataaattataatttttaacaaaaaattatgggacatgcatagaaacagtaacatgtgacccatacacaagaaaaaagtaggcaacagagctgcctttgagagggtccaaatgtcagacttagcaggcaaagacttccaagcagctattaaacaactaaaggaaaccacacttaaagaagtaaaggaggccaggtgtggtggctcacacctgtaatccctgcactttgggaggccgaggcgggcagatctcaaggtcaagagatcgagactatcctggccaacatggtgaaaccctgcctctactaaaaatacaaaggttagctgggcatggtggtgtgtgcctgtagtcccagctatttgggaggctgagacaggagaattgcttgaacccaggaggcagaggttgcagtgagtcaagatcacaccactgcactccagcctggcgacagagcaagactgtctcaaaaaaaaaaaaaaaaaaagaagtaaaggaaggaggggcatggtggctcatgtctgtaatcccaacactttgggaggctgagctgagaggattgcctgaggccaggagtcaagaccagcctgggcaacatagagaggcctcatctctacagaaaattttaaaattggctgggcacggtggctcatgcctgtaatcccagcactttgggaggctgaggtgggcggatcacgaggtcaggagattgggaccatcctggctaacacggtgaaaccccatctctactaaaaaatacaaaaaattagctgggcatggtggtgggtgcctgtagtcccagctacttgggaggctgaggcaggagaatggcatgaacctgggaggcggggcttgcagtgatccgagatcgtgccactgcactctagcctgggcaacagagcaagactccgtctcaaaaaaaaaaaaaaatttaaaattatccagatgtggtggcacaggcctgtagtctcagctacttgggaggctgaggcaagaggagtgcttgagcccaggattttgaagctgctatgagccatgatctcacctttgcacttcaccctgggtgacagagtaagacactgtttggaaaaaaaaaaaaagctaggcttggtggctcactcctgtaatcctggcactttggtaggctgaggtgggcagagtgcttgaggccaggagtttaagaccagcttgcctaacatggcaaaaacctatctctactaaaaatataaaaattatgtgtgcacacagtggctcatgcctgtaatcccagcactttgggataccaaggcaggcagatcatttaaggtcagaagttcgagaccagcctggcaaacatggtgaaaccccatttctactaaaataaaataaaaaaaattagccaggcatggtggtgcatgcctgtaatcttagctacttgagaggccgagacacaacaatcacttgaacctgggagatggaggctgcagtgagctgagatcatgccactgcactccaacctgagtgacagagtgagactctgtctaaaaaaaaagacaaagaagtaaagtataatgacagtgtctcatcaaatatattgagcatatcaacaaagaaatagaaattgtataagaaaaagtaaaatggaaactccaaagttggaaattacaataactgaaatgaaaaatccagtagaggagttcagtaatcaatttgaactggcaaaagcaagaatcagtgaacttaaagatagattgatagagaatatgcaacctgaagaatgaggagaaaaaggaatgaagaaaaatgaacaaagccttagagaaatgtgggctatcatgaagtacaccaaaatagatataataggagtatcagaaagaggagaaaaagaaaagaagacaacatatatttgaagatgcaatggctgaaaatttctcaaaaatgatgaaaaccactcagttacacatctaagaatcttaaggaactccaagtagtagagagccacactcagatacactctattaaaactctggaaagctaaggacaaagagaatacactgaaaacaagagaaaaatgatttgtcatgtccaagggaatcccaataacaataacagccaccttctcatcagaaaaaatggagggaagaaggcagtgggattacacattcaaactgctgaaaataacctgtcaaccaacagtcttttccagcaaaactagtgttatgggatatttggggtttcgattttatggccagaaacctgtggctggtggcacctttgctcaagttctcgtcctgtgtccaggaagaatgaggaatgcagacaagtgaagggtgaacaagtcaaagaggagctttattaagtgtcagaacagctcaaaggagacccacagtgggtagctcctctctgtaggcaggtcgtcctgttgagtgttcaactctcagcagagaggaggccctggagagggtggttcccctctgcaggcaggtcactctgatgtctgcttctctcagcagagaggaggccctggagaaggtagcttgtctctgcagctggtcatcccattgtctattcagctctggctgagcctggggcttttatgggcctcagaggggaggaagtgtgcaatgattggtccatgggcagccatggtggcctggaaaaggcaccagttcttactccagctgtgggattggcagcctggtccccagccttcaggccttccctgacctgaaggtggggcctcaccggggacctgttttcttctgcccaggaattggtccacttcctgctgctgttcatggtgtcggggcttggtcccaacattgctccaagattggagtgggtgccaacagcagggagaagccaggcagtgggagcaggcacttctgaccctgaaaagcaaggggtgcctttctagtccctcaagaatgcagggatgcctgagtcttcagtctggtttggatggctgcagccgtgcccaggaaggcagggctcctgcctgctctgtggagccagaggtgaggacgatgcctccctgctgcagctggtgtcttggcaatggccactctagatgggtcactgttgccattactagattccaaaaagaaaaatgaaatatagacatttccagataagcaaaaataaacataattggttgctaccagacctaccttacaagatataataaaggaaggtcttcagaatttaagtaagtgacccccaacagtactcaaaaaccatatgaaaaaacagagtgctggtaattaagtataaaagacagtataaatacatatttcttcttctttctgttaactaattgtaaaaagcaattgtataaaacaatgtcaattatcattgggtttatagcatatagaaatgtgatatagtcaataacagcagcacatagtaggtgttcaaaagctgggacctgccgtgttgttgttgttattattgactggcctgtttaggggcacaaaagtggattataggaactccagaaagggatgcttgatttcaatactcagaaaaattttaaaggaatgttaaaatgcatatagaagcattttgaaaatattgactatttacttctgtatccagaaacatgcagactaattgagtagagaaatcccttcctaaaaatgctgaataaaacatcaaatatgtctgtgtgaaagcacagatgaacggatgttaaatagggaaccagtcagaagccagaataacaagagcatgaccccatcagggtgagcctgcaccagggcctgtgcttcctgaggccctggattgtaaatggccagcgtgccaggcacctcctgggcaccacttcagtccgcttggccccagttctgattctggccactgctgaggtgatgagtgttctgtgggcctcatgcaggtgctgcctcaccttgggcacatggggcccacccctcccttcctgtctgagtcacacagggaggatgctctcgggaatcccctggaccagtatgcatatgcacaccccaagttcaggggagttcatgtctgtgaggccactcttgaccaatgagtgacacaagcaaatactcaatgtgtcttttttgtatctcccatttcataagactctttggaagatcctatggaatcaagcacctatcagaggtccccttgaaaatgcgaccttgtcccgggcttccctctttatttgtttctctctccagccctcactcctactccctgggattacgtcccaaattaattacacaaaaacctttgtctgaggctctgcttttaggggacccaaaactaatcaggaaagaggagaaaaggcctgaagtctggtcctgggaggtaggacccttcctctcctccaaatttgggacttctcagaagttaataccctaggggagagagagggaaaaaaactcacctacagaagactttgctgtatccacttagttgtggctggagaagcaatacagggtaaaaaggaagtccgaaagccaacattcatgcagagaaaagcccaaaattatattccctgtatgaccagaaaaacactaagccaaaaaaatgtttaaagtggttctgagttggaagtacttttaggtgcctggcaaaagcaaacaaaaagcctttctggaataatatattttaaacacagattcaaagaattcccacaaagaattacaagaaacatgacctcataattaacaattaataagttcatatggaaacaaaccacaaggagtatgcgtcagcagaaacaataaataaatagcggggtgagacccacaaatactgcataagatagaatgatgagacacagaatagaagataagtattttaatgtatttaatgaagtgaaaaaagatactgaaaatatgagaaagaaacgaataatattaggcatatttatttatttatttttatttatttatttttttgagatgcagtcttgctctgtcacccaggctggagtgcagtggcgtaatctcagctcactgcaagctccacctcctgagttcaggccattctgcctcagcctcccgagtagctgggactacaggcgcgtgccaccatgcctggctaattttttgtatttttagtagagacggggtttcactgtgttagccaggatggtctcgatcacctgacctagtgatccacctgcctcggcctcccaaagtgctgggattacaggtgtgagtcaccacgcccagcctaattaggcatatttaaagatgaaccagataaaacttctacaaatgaaactgcaataattaaaataaaaagactcaaaagacaagtgaaaaagctgaatagacaaaggtgaagacagaatagtaaattgaaaagtagagcttaagaaattaccaagaattcaacaaagaaaggtaataaggtgaaatatgaaaaagaagagacatgggagaaattcaacatttattcatgataaaacctctcagcaaactaagaattaaaaggcacttcctcaactcagtgaaagacatccacaaaaaacctatacctactgtcatattttatagtgaaagactgaagtcggctgggcgcggtggctcacgcctgtaatcccagcactttgggaggctgaggcgggtggatcacctgaggtcaggagtttgagaccagcctggccaatgtggtgaaaccctgtctctattaaaaatacaaaattagccgggtgtggtggcgcatgcctataatcccagctactcgggaggctgaagcggaggttgcagtaagcagaggccgcaccattgcactccagcctgggtgacaagagtgaaactctgtctcaaaaaacaacaacaataacaacaaaaaataacaccgaagtcttttactctaagttcaggaacaagcaaggatgttcacccttaccactgccattccgctttcaactggaggtcctaaccagggctagaagtcaagaaaaatataataaaataaataaaaggcttacagattggaaaggaagaaataaacctgtctctgttagtagaatacataattgtttatttagaaaatcacaaagaatctacaaaaaagcaactacaactaataagtaaatttatcaaggttacaagatacaagatcaacagagaagaatcactatgtttctatatattaggaatgcccaattaaaatgagaattttaaaaacggtgccattttaaatagcataaaaacaaggaatacttggcataaatctaacaaaacatgcaagactgacatgctgaaaacaacaaaacattgataagagacactaaagaagacctaaatagaggcaatgggttggaaaatatatatatattttttcttttttgcttttttacactatccacctggagacagaaaaatccatattttaaagtccaaattctccccaacttgatcagtagatttaatgtaatcccaatcaacagcccagcaggattttcataaaaatcaatatgttgattctaaaatatttatggtaatacaaagaaacttgaatatccacaaaaaattttgagaaaaagaacaaattaggaagactcacactgctagattgtaagaatgtactttaaaaccaggaatactaacaagcaagtttagcaggatcacagtatgcaagatcaatatacataatcaaaaaactttccacaaagaaaagcccaagcacagatgacttcactggtgaattttatgacccagttgaagaataattaataacaattccttataaactgtttcaaaacttagaaaacgagagaacactttccaaatcattctacgaagccaataattccccgatacccaaaacaaagacatcacaagaaaaaacagacagacaaaaatgaagaaaactacagaccaatatcttttgtcagtatagatgtaaaaatcttcaaaacaaatagaatcaaacaatacagcaacatatgaaaaagaatgtacaacatggccaattgggacttttcccaagaaggtaaggttggctgaagatatgaaaatcaatcaatgttacataccatattaatagaataaaagattgaagctttaaatcgggtcagtgatgcagaaaaagcatctgaaaaaaatccaataccttatatgataaaaattctcagaaagctagaaatagaaaggaagttctttgaactgataaagatcatctacgaagagtcctgcactaatatagtacctaatggtgaaagactgaaactgtctgacccctaagatcagcaggaaaggatttttcctcttactacacctgttcaacattgtactggaaataatagccaccaaattagatcctcccttcctgccccaaaatgaaagaaataaatggcatcactgttgaaaaagacgtaaaattacttctattctcagataatacgattgttctatggaaataattattaaatcttatggaagccacaaaaacctattagagataataaatttagcaagcttgcagaaattaagaaaataattcaatttacaatagcataaaaaaggataaattggccgggcacagtggctcatgcctgtaatcccagctacttgggaggctgacacaggagaatcgcttgaaccagggagtcggaggttgcagtgggccgagatcgtgccaccacactccagcctgacaaaagagcgagactccatctcaaaaaaaaaaaaaaaaaaaaaaaaaaaaaaagagatggaggccatcctggccaacatggtgaaaccccacctctgctaaaaatacaaaaattagctgggcatggtggtgcatgcctgtagtcccagctactcgggaggctgaggcaggagaatcacttgaatccgggaggtggaggttgcagtgagccgagattgtgccactgcactccagcctggagacagagttagagtccgtctcaaaaaaaaaacaaacaaacaaaaaaaaaccacacaagattcatatgctgcaaactacaaaacattgaaagaaattaaagaaggcttaagtaaatagaacgatattccatattcatggattggaagacaatattgttaagatggcaataccccctaaatttgtctacacttacaatgtagtagtacactttcaaaatcccagcttctttttgcagaaattgaaaaactgattctgaaatttgtataaaaatgcagcagacccagaattgctaaaacaatcttgaaaaaaagaacaatattgaaggacttacacttcttgatttcagaacttcctgcaatgctgcagcaatcagcattgtgtagtactgacataaggacagacatataaattaatgaaatagaattgagagtccagaagtaaacacatacgtttatattccattgattttttaacaagggtgccaagataatttaacggagaaaaatatcttgtcatcaaatcactgatgttgggacaactggatatctacatgcaaaagaatgaagttgatcccttccttagaccatatacaaaaattaagtccgatctgcaaatggctcagatacctaaatatgatagctgtaactctaaaactcttagaggaaaacgtaatcataaactttcatgatcttaggttaggcaaagccttcttacatgcaacagaaaaagcacaagcaacaaaagatgaaatagataaattgtacttcatcaaaatggaaatcttttggcttcaaaggacactatcaagaaagtaaaaagacaacacagagaatgaggtaaattatttgcaaattatgtatatgatcagggactagtatccagaatataaaatagcaactacagcttaaaaagacatatacctcaaaaattgggcaaaggatttaaacagatatttttccaaagaagatataccaatggacaacaccacatgaaaagattgtaaatattattatccatcagggaaatgcaagtcaaacccacaaggagatgccacatcacacatactaggatggctataataaaacagatggacaataacaagtgttgacaaggatgtggagaaattggaactctcatacattgctatgggaatgtgaaatggtgcagctgctttggacaagcctggcaactcctcaaaaagctaaatatagtgttaccgtatgacctagcaatttcattcttaggtatataccccccaaaatggaaacatatttacacaacaatttgtacacaaatattcatagtggtgttattcataatagcaaaaaagcagaaacaagccaatgttcatcagttgatgaatggctaaataaaatgtgatatatccatacaatggaatattatttgcccattaaaatgaatgaaatactgataatgctacaacttgtataaaccttgaaaacatcatgctaagtgaaagatgccagctacaaaacgccacatattttataattccacttatatgaaatgccaagaataggcaaatctctagagactgaaagtagattagtggctgccagggtataaagataggagacagtgaagactgactactaatagatacaggtttcttttggtgtaataaaaatattctggaatcagatagtggggatggttacacatctttgtgactatagtaaaaaatacataattgtacattttttttttttgagatggagtttcactctgtcacctgggctggggtgcagtggcaccatcttggctcactgcaacctccacctcctgggttccagcaattctcctgcctcagcctcccgagtagctgggactacaggcgcaagcagccacgcctggctaatttttgtatttttagtagacggggtgtcactatattggccaggctggtctcgaactcctagaccttgtgatccacccacctcggcctcccaaagtgctgggattacaggcgtgagccaccgcacccggccaacgatggggttttctaaatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaaaggaatgcttccagtttttgcctattcagtatgatattggctgtgggtttgtcataaatagctcttattattttgagatacatcccatcaatacctagtttattgagagtttttagcatgaagggctgtttgattttgttgaagaccttttctgcatctattgagataatcatgtggtttttgtctttggttctgtttatatgatggattacgtttattgatttgtgtatgttgaaccagccttgcatcccagggatgaagccaacttgatcgtggtggataagctttttgatgtgctgctggattcggtttgccagtattttattgaggatttttgcatcgatgttcatcagagatattggtctaaaattattttttttgttgtgtctctgccaggctttggtatcaggatgatgctggcctcataaaatgagttagggaggattccctctttttctattgattggaatagtttcagaaggaatggtaccagctcctctttgtacctctggtagaattcggctgtgaatccatctggtcctggactttttttggttggtaggctattaattattgcctcaatttcagagcctgttattggtctattcagggattcaacttcttcctcgtttagtcttgggagggtgtatgtgtccaggaattcatccatttcttctagattttctagtttatttgcatagaagtgtttatagtattctctgatggtagtttgtatttctgtgggatcggtggtgatatcccctttattattttttattgcgtctatttgattcttctctcttttcttctttattagtcttgctagtggtctatcaattttgttgatcttttaaaaaaaccagctcctggattcattgatttttttgaagggttttttgtgtctctatctccttcagttctgctctgatcttagttatttcttgccttctgctagcttttgaatatgtttgcttctgcgtctctagttcttttaattgtgatgttagagtgtcaattttagatctttccttctttctcttgtgggcatttagtgctataaattccctctacacactgctttaaatgtgtcccagagattctggtatgttgtgtctttgttctcattggtttcaaagaacatctttatttctgccttcatttcgttatgtacacagtagtcattcaggagcaggttgttcagtttccatgtagttgagcagttttgaatgagtttcttaatcctgagttctagtttgattgcactgtggtctgagagagagtttgttataatttctgttcttttacatttgctgaggagagctttacttccaactatgtggtcaattttcaaataagtgcgatgtggtgctgggaagaatgtatattctgttgatttggggtggaatgttctatagatgtctattaggttggcttgatgcagagctgagttcaaatcttggatatccttgttaactttatgtctcattgatctgtctaatgttgacagtggggtgttgaagtctcccattattattgtgtgggagtctaagtctctttgtaggtctctaaggacttgctttatgaatctgggtgctcctgtattgggtgcacatatattgaggatagttagctcttgttgaattgatccctttaccattatgtaatggccttctttgtctcttttgatctttgttggtttaaagtctgttttatcagagactaggattgcaacccctgcttttttttttgttttctatttgcttggcagatcttcctccatccctttattttgagcctacgtgtgtctctgcatgtgagatgggtctcctgaatacagcacactgatgggtcttgactctatccagtttgccagtctgtgtcttttaattggagaatttagcccatttacatttaaggttaatattgttatgtgtaaatttgatcctgtcattgtgatgttagccggttattttgctcgttagttgatgcagtttcttcctagcatcagtggtctttacaatttggcaaggttttgcagtggctggtactggttgttcctctccacatttagtgctttcttcaggaactcttgtaaggcaggcctggtggtgacaaaatctctcagcatttgcttctctgtaaaggattttatttctccttcacttatgaagcttagtttggctggatatgaaattctgggttgaaaattcttttctttaagaatgttgaatattggcccccactctcttctggcttgtagagtttctgctgagatatcagctgttagtctgatgggcttccctttgtgggtaacccaaccttactctctggctgcccttaacattttttccttcatttcaactttggtgaatctgacaattatgtgtcttggagttgttcttctcgaggagtatctttgtggcattctctgtatttcctgaatttgaaagttggcctgccttgctagattggggaaattctcctggataatatcctgaagagtgttttccaacttggttgcattctccccgtcactttcaggtacaccaatcaggtgtagatttggtcttttcacacagtcacatatttcttagaggctttgtttatttctttttactcttttttctctaaacttctcttcttgcttcatttcattcatttgatcttcaatcactgatactctttcttccacttgatcgaatcagctactgatgcttgtgcatgcatcatggtgttctcgtgccatggttttcagctccatcaggtaatttaaggtcttctctacgctgtttattctagttagccattcgtctaatcttttttcaaggtttttagcttctttgcaatgggttcgaacatccttctttagctcggagaagtttgttattactgatcgtctgaagccttcttctctcaactcatcaaagtaattctccatccagctttgttccgttgcttgcgaggagctgtgttcctcagttgggaatgcagaaatcacccgtcttctgtgttgcttatgctgggagctgtagagtggagctgttcctattcggccatcttggaaccactgactctcatcttttaaagatgagatttggacacacagccaaacaatatcagaccctgtctcaaaaaaaaaaaaaaagattaattattcacctatcatgtgacccaaccattccactcctaggtatttactcaaaagaaatgaaagcatatgtccatacaaagactatacatcaatgttcatagcagctttatttgcaatggccccaaactgaaaataatccaaatgtccatcaacaagtgggtggtaaacaaatggtggaacatccacacaatggaatactactcagcaataaaaaagacgaactagtgtgtatggtgtggatccctaagtgaatgaatctcaacaattatgttaagtaaatgaagccagacaaaaaagagcttatcctgtataattccatttatataaaatcctagaagtgggaggatcgcttaaggccaggagtttgagaccagcctgagcaacatagcaaaaccctgtctctaaaaaaaataggaaaaagttagccaggtgtggtttgtgtgcccacagtcccagctacttaggaggctgaggcaggaggatcacttgagcctaggagtttgaggctgcagtgagctgtgattataccactgcactccagcctggacaacagagcaaggcctcatgtctaaacataaataaataggttgggaacagtggctcacgcctgtagtcccagcactttgggaagccgaggcaggtggatcacaaggtcaggagttcaagaccagcttggccaagatggtgaaaccccatctctactaaaaatataaaaaattagctgggcatggtgacatgcacctgtaatcccagctactcaggaggctgaggcaggagaatctcttgaacctggaaggcggacattgcagtgagccgagatcatgccattgcactccagcctgggcgacagagcaagattccatctcaaaaaataaataaataaataaaataaaaataataaataaataaaaatataagatgacattctagaaaatgcagattaacctgtggtgatagaaagttgactagtggttgcctgggagcagggtgggtgaagaatcaaattaacaaagaagtacaagggcacctttggggctgatagatgtggtcatcttttttttttttttttttttgatatggagttttactcttgttgcccaggctggaatgcaatggtgcaatctcggctcactgcaacctccacctcctggactcaagagattctcctgccccagccttccaagtagctaggattactggcacctgccaccatgcctggctaatttttgtatttttagtagagacagggtttcaccatgttggcgaggctgttctcgaactcctgaccttaggtgatccacctgccttggcctcccaaagtgcaggatttacaggcgtgacctatcacgcttggcctgcacgtggtcatcatcttgattgtaatgatttgcacacctgtgtcaacacttatgaacacttgtgtacacttcaaataattcagtttcttgtacttcaattatacctcagtagagctatttttaaaatacgtatctttgattagatcatggtcttaacaaagccgctctaactcaaattttggagaaatgtgacatgagacaaggtatcacatgatgttaagaaattattgcagccaggtgtagcggttcatgcctgtaatcccgcactttgggaggccaagatgagaggattacttgagcccaggagtttgagacgagcctgagcaatgtaatgagaccccatctttacaaaaatatcaaaaaattagctgggcatggtggcacatgcccatagtcgcagctactcaggaggctgaggtgggaagattgcttgagcctgggaggttaaggctacagtgactgatcacgccactgcattccagccagggccacagagcaaaacctcatgttaaaaaaaaaaaaagataaattattgctaattttttttttttgagacggagtctcaccctgtcgcccaggctggagtgcagtgacacgatctcagctcactacaacctccgcctcttgggttcaagcaattctcctgcctcagcctcctgagtagctgggattacaggtgcgcaccaccacaccctgctaatttttttgtatctttagtagagacggggtttcaccacgttggccaggctggtctcgaattcctgacctcaggtgatctgcccgccttggcctcccaaagtgctgggattacaggcgtgagccaccgtacccggcctgctaattttattagttatgaaaatgtaataaaatgtcctaatttatttttaaaatgtgaggagggatgggaggccctcaaatgggctccataaacagctctggagctagcttccacctcatggccaaccaggggtggctatgcgctagcctgcaggtctccaacctgtccagcccagttgtcttggagatggggatgggaagtgggcagagagaagctctcaatccttctgacttccttggaaatgtccttggagccattgtacttaacagtaaatctttgccttctgcacagggactctttgtcttaaccctctggggccgctggctctgaggcagtcgctgttgtctagatcaagtttctgtctgtacacctctttctttcttgctggcagagacaccatttgtatgtgtgtcacactcctcccaggggctcaggaaaatcattctattctacccagctcaaggggtaaatcctgattggtgtaggctagtcttctttgcagagattggtttaggagttggcatgtgaatcaatgagatttgagaaaaggatggggagggagaccgtattagtcctttcctgccactgtaacaaaataccttagactggagaattgagagatagcataactgtattgctcacagctacagaagctggaagtccaaaatcagggcaccagcagattcagtgtctgatgagagcttagtctctgcttccaagatgggaccttgttgctgtgtcctctggaggggacaaatgttgtgccctcccataacacaaaagatgaaaaggcaaaaagagatgaatgctgtttcttcagggcgcaaaaggtggaaaggcaaaaggaagacaggccagctagttccctcctgcccttttgtaagacacgaatcccatccatgaggacagagccctggtggcctaatcatctcctaaaggctccacctcttaatactgctgcactggggattcagtttcaacatgaattttggaggaggcacaaacactcgcaccatagcagagtcttctgggaaatgtttccttgctcttaaaaagggctccaagggctaggcatccttcctctcatagcggatattgttgtttctggatatgacgcctagagctgtggcagctctcctgagacaatacgcagagcccttcctaggacagaccaagccagtacgcatgggagaggaaagacaggaagaacctgagcctgacgctgctgctgagtcacagattagcccattctggagctgccatcacctccccgcttcctgctgtatgaattaataaactttccttattgtttttttgttttgttttgtttttcagatggagtttcactcttgttgcccaggctcaccttcttgattcttgccgtatgaattcataaacttttttttttttttttttttttttgagacggagtttcactcttgttgcccaggctggagtgcagtggtgtgatctcgactgactgctgcctccgcctcccaggttcaagtgattctcctgccacagcctcctgagtagctgggactacaggcgcctgccaccacacctggctaatttttgtgtttttaggagagatggggtttcgccatgttggtcaggctggtctcaaactcctgacctcaggtgatccgcccgcctcagcctcccaaagtgctgggattacaggcgtgagccatcgtgcctggccttattgttgaatccattaaagatgaactaacataggctgggcacagtggctcacgcttgtaaccccagcactttgggaggccggggagggcagatcacgaggtcaggagatcaagaccatcctggctaacacggcaaaaccccatctctactaaaaatacaaaaaattagccgggcgtggtagctggcgcctgtagtcccagctactcaggaggctgaggcaggagaatggcatgaacccgggaggcaaagcttgcagtgagccaagacagcgccactgcactccagcctgggcaacagagcaagactctgtctcaaaaaaaaaaaaagctggtcacggtagctcacgcctgtaatcccagcactttgggaggccgaggcgggcggatcacgaggtcaggagatccagaccatcttggctaacacggtgaaaccctgtctctactaaaaatacaaaaaaattagctgggcgtggtggcaggcacctgtagtcccagctactctggaggctgaggcaggagaatggtgtgaacccgggaggcagagcttgcagtgagccgagatcgtgccactgcactccagcctgggcgacagagcaagactccgtctcaaaaaaaaataaaaaataaaaaataaaaaacaaaaggtgcaagatacaaggtgctagacttcaacaaaattgctcattaaaagggaccatgaaaaaaacagaaaaagcaagctgcaggctgggagaaaacatgtgcaaaacatatatttgaccccctccctccaaaagaaatccatctggaaaatataaagaatgcctacaaatcaataataagaccaattacttgatttttagaaattggcaaaagtcttcaacaggactcttacacaagaagctacttaaatggccaataagcacatgaggggatgctcaacatcattagtcatgaggaaaatgcaaattaaagccacaaagctaccaccatgcacctaccagaatgactaaagtgaaaaaaagtaataacaattacacatttgacaaggctgtggagcaactggaactctcatacactgctgatgtgagtgtaaaactgcacaaccactcaggagacctgtttagcagctttgaataacattaagcactcacttaccttatgacccagcaattctgctctgaggtatatatttaagagcaatgagggcataatgtctgcaagacttatacaagaatattcatagcaactttattcatatggccaaaaccaagaaacaatcaaaatgcctatcatctaggagaataaacaaaatatgatatattcatataatgatataggacttagcaagtaacaaaacaaactgctatggatacatgcgataacatggatgcatctcaaacacattatgtcaagtagaagaagccagatggagaatttgtgctaggataatatcatttttatgaagttcaagaacaggcaaaactaattgatggtgataaaagttagaacagtgggccgggcacggtggctctcgcctgtaatcccagcactttgggaggttgaggtgggcggatcacttgaggtcaggaaatcgaaaccagcctggccaacatggtgaaaccccgtctctactaaaaatacaaaaattagtcaggtgtggtggtgcgcgcctgtaaccccagctacttgggaggctgaggcaggagaattgcttgaacctgggaggtggaggttgcagtgagccaagatcacgacactgcactccagtgtgggtgacagggcaagactctttctcaaaaaacaaaacaaaacaaaaaaaacagtgcttagctctgggttatgtgaatatcagctgtacaagggcagaagggaactttctgatgtgatgcacatgttctatatcttgagctgagtgtcagttacatgggcatgcaaacgataaaatgtatcaagctatacattcaaaatttgtgtatttttctgtgtgtaaattatacctccatagagtactacattcatgcattgcttaatgataaggatacattctgagaaatgtatccttaggtgattttgccattgtgcaaacattctggagtgtacttacacaaaactagatgggatagcctactacacacctaggctatgtgtacagcttattgctcctaggctaaaaacctgtactgcatgttactgtactgaatagtgtaaggaagtagtaacacaatggttatttgtgccatggtaatttttaagctccattataatcttataggaccactgctgtatatgtggtccaccattgaccatgacgttgttgtgcagtgcatgactgtatttgcattttttaagaaataccattcaccagagaagctggtctattcaatttttaaaaagagtttagcagagggccgggtgcggtggttcatgcctgtaatcccagcactttgggaggccgaggcaggcagatcacgaggtcagaagatcgagaccatcctggctaacacggtgaaaccccatcactactaaaaatacaggaaattagtcgggcagggtggcaggcgcccgtagtcccagctactcgggaggctgaggcaggagaatggcctgggaggcagagcatgcagtgagctgagatcacgccactcactacactccagcctgggcgacagagcaagactccgtctcaaaaaaaaatagtttagcagagttgccagatataaattcaatatctaataaattaaagtttaatgaatgtatatacatcatcaagttagaaaatgcaaattaaaaatttacaatagcaatgaaaaatataagatattgaaaataaatctaacaggccgggcgaagtggctcacgcctgtaatcccagcactttggaaggctgaggcgggcggatcacgaggtcaggagatcgagaccatcctggctaacacagtgaaaccccgtctctactaaaaatacaaaaaattagccgggcgaggtggcaggcgcctgtagtcccagctactcgggagactgaggcaggagaatggcgtaaacctcggggggcggagcctgcagtgagctgagatcgcgccactgcactccagcctgggcgacagcgagactccgtttcaaaaaaaaaaaggaaaaaaaagaaaataaatctaacaaaagatgtgtaaaaacctttttttaaaagaagtggggtcttgctatattgcctgggctggtcttgaactcctgggctcaagcaatccacccacctttgcctcctaaagtgctgggattacaggcataagccattgtacccagtcctgtaaaatcttataagccactgtacccagccctgtaaaatcttttttttttttttgggacggagtctcgctctgttgccgaggctggagggcagtgccgtgatctcggctcactgcaagctccgcctcccaggttcagccattctcctgcctcagcctcccaagtagctggtactacaggcacccgccaccacgcccggctaattttttgtatttttagtagagatggggtttcaccgtgttaaccagcatggtatcgatctcctgacctcatgatctgcccgccttggactcccaaagtgctgggattacaggtgtgagccaccacacccagcctgtaaaatctttatgtagaaaattatagcaccttactgaaaggcaataagaaaaccaattggtgagcaacaacatgtttgtggaaagactcaatgctgtaaaactgttatttctccccagattgatttaatactgtttccatcaaatcataacaaaactttgcacacatttcaccaaaaaaaaaaaaaaaaaaaaaaattagtgcctagatcctataaatcaattaggaggacaaaaaattcaatagaaaaatgtttaaaaatatgaacaggtgctgggtgtggcggctcatgcctgttaattccagcactttgggaggctgaggtgggcagatcacttgaggtcaagagttcaagaccagcctggccaacatggtgaaaccccatctctactaaaaatacaaaagttagccgggcgtggtggcagtcctctgtaatcatagctactcaggaggctgaggtaggagaatcacttgaacccaggaggtggaggttgcaatgagctgagatcacaccactgcactccagcctgggcgacggagtgagacactgtctcaaaaaaccaaaccaaaccaaaacaaaacaaaccataaacaggtatttcacagaaaacacaaatggcccattaaatatatgaaaatatactcaccttcattagtaaaaaggggaaatgtaaataaaaccacaaattttcatttcatgcccactagtttggaaaaaaattagaagactgacaaaatgctggtgaaatgtaactattaaactgcagtgggactagaggtgagtacactcactttgaagaaaagttttacattatttggtaaaagtgaacattcacacaccctgagacccagcagttctactcctggagatatggatggaatagtcacagagcactgtttattagatcaaaaacaaaatagcccaagtacccattacagtagagtgaataaatgaattgtggttcagtcacacaatagaatactatattatagtggaacagaaaactatagctccatacattaacatggatgtagctgatgatattttccagacggccaccaccatacagcccgtctcatgtgctcttctcaccttttgagatgccagtgacatattacatctttcttgtagtcccacaggtccctgaaactgttttttttcccctcctgcagtctattttctctctggttcagtttcagtctattttccctgtggttccaatcaggtcatttctattctgtgtttcagttcacggattctttcttctgtcctcccgttcttctgttgagcacatccactgagctttaaaattttagtcattgtctttttcagtttgagcatttccatttggtgctgcatatgttaactagcttgatttagccatttcacaatgtctacatatatcaaaacatcatttgtataccataagtatatataatttttttttggtcaacaaaaataataaaatttctatttggttctctctctctctctcttcctccctctgtccctctgtgccaatgcctgtaagaatacttttttattgtttttgttgagacggagtctcactctatcgcccaggctggagtgcagtggcacgatctaggctcactgcaagctctgcctcccggcttcatgccattctcctgcctcagcctcccaagtagctgggactacaggtgtccgccaccacgcccggctaattttttgtatttttagtagagacggggtttcactgtgttagccaggatgttctcgatctcccgacctcgtgattcgcccgcctcggcctcccaaagtgctgggattacaggcgtgagccaccgcgcccggccaattccagcactttgggaggccgaggcaggtggctcacgaggtcaggagatggggaccatcctggctaacacagtgaaaccccgtctctactaaaaatacaaaaaattagccgggcgtggtggcgggcgcctgtggtcccagctactcgggaggctgaggcaggagaatggggtgaacccgggaggcggagctggcagtgagccgagatggcgccactgcactccagcctgggcgacagagcaagactccgtctcaaaaaaaaaaaaaaaaaattgctgtgattacaggcatgagccaccgctcccgtccttgactggtgattttctactgaaacccagacatgttaggtattacgagactctgggtcttactgaaaccttgcttcccacgctgctactccagcacaggaggggaggtgctgccgcgttgctgtgaggtggaggcggaagtccaggttccccactcagcacccatggactctagagaagggggcactgtgccttactttggagggtgtgggagtcctagattctactagaccagcactggctgtgcggggtgggggtgtcaccttactgctctttcatggcctccactttcaccatattctcaggatggcagtgaccttggagtggagagaggggatgtgattgggcaggagacgcaggaggcttcaaaagaactgtgaatgttttattttgtagttgagcagtaggtatacagatgtttctttctttctttctttctttctttctttctttctttctttctttctttctttgagacagagcctcgctttgttgcccaagctggagtgcagtggcacaatctcggctcactgcaacctctgcctcccaggttgaagcgatcctcctccctgagcttcctaagtagctgggattacaggcgtgcaccaccacgcccagctaatttttttgtatatttagtagagacgggattgcaccatgttggccaggcttgtctcaaatttctgacctcaggtgattcacctgcctctgcctcccaaagtgctgggattacaggcatgagccactgtgcccagccggtatacaggtattaattttattattattatatattacggaatgttttaaaaacagaaaaacctaaccacaacagagtagaaatatgctgtgtttagaatatttgtaacacagttagctgagctcctcagacatagcaatatccatcgtctgtagtattaagcactatccatgtgccaggtgctgtgccaagcacttcacacacatcatcttatttatccctcaccacactcctaggggacagatactaacccactttacatacaaggaagctcaggctcaaagaggttaagtcgcttgcccagaatcacagagtaatatgtggctgaggtgggacgggagcccaggcctgtctgcagagactgtattcttcaacccacagcatccgaacaaggatgaaaccaattaatatcattcattgtaatcatggcatgccatgtcctacccacagctgataaaatccgacagaaagcattagactcccacaggatgggtaatatgtcttgggaggaccttgtgggcaaagtgaatacaagtggcagctgcacccaaacaagcccagggtcaggacccacccaggtgagcagagcttggaattagccagtgaggcaggagctgtggctgaggcctgtccagccgtgtggcagggctgtgaaggcaggcagaatagcaagggagggacgccagagatggggaaccatgaaagatgtctcgcctcctgtttcagagggagggatccaactcgcggggcaagagcggctggaactggagggagagaatagtgtctgcaagagcagaataccagacatcagagttagcaatccaggcaggagccagaacccagggccacagagagcatggtctgccctgtcccaccgctttctctgtgacacaggggaaagaggttacagaaattgagtgataatggctaaggtgaatcagccacgaactatagccctctcaggagctgcaggccctgccctacccagcctgcccaactggtgggtggcaaagacctgtccacccactaggacagggcaagaggcagagctaccagttaggagctcacgtggtcactgtccatgggaatggtggttcaggccaacaaaatcagattgtccagcgacaattgtcaattcccactgtaaggccacagccctgggatgggaatcctggttggactacagctcacagtcaaggttggagtatttgtgtagcccagattcaggctgagtccctagcagctgagagcctgcctaggatacaggaagtgtagttgggcatctctgggtttagacatcaaacaaggaagggcggggtgaaatgaggaaaagtgaccaggatggcaagggacccacaccttcccctcagagctgctgcaagggcagttctcctagccccagtacatcctaggcgccggttcacagctggtagcctcctgtaacctggactagctggacaagttgggccaaatagattgttcctttggagtctgattattatgaaatattctactttttctctcataatacttcttgacttaaagtttgtataatatttccatattagctttcttgggattagtgttgacatgaaatattgctttctaacctttgactttcacctttttatgtccttatatttatatttattatatttatttatttatttatttttgagacagtgtctcactaggtctcccaggctggagtgcagtggcttaatcttggcttactgcaacttccgcctccccatgtccaagcaattctcatgcctcagcctcctgagtagctgagactacaggtgtatgccaccacgcccgattaattttttttttttttttgagaccgagtctcactctgtcacccaggctggagtgcagtggcgccatctcggctcactgcaagctccacctcctgggttcacaccattctcctgcctcagcctcctgagtagctgggactacaggcgcccgccaccacgcctggctaattttttgtatttttagtagagatggggtttcaccatgttggcaggctgttctcaaatgcctgacctcaagtgatccgtcagccttggcctcccaaagtgctgagattacaggcgtgagccatcgtgcccagcctacgtctatatgtgtatgtgtgtgtatatatatatatatatataaatatattttgtttgtttggtttttgtttgtttgtataatatttccatattagctttcttgggattagtgttgacatgaaatgttgctttctaaccttttgctttcacctttttatgtccttatatttattatatttatttatttatttatgtttgagacagcgttcacgccattctcctgcctcagcctcccgagtagctggcactacaggcgcccgccaccatgcccagctaattttttttgttttctttttagtagagatggggtttcaccgtgttagccaggatgatctcaatctcctgacctcgtgatctgcccgcctcagcctcccaaaatgctgggattacagacgtgagccactgcgcccagacttaatcaatatttttttaaataatttcattttgttctgctgttagctttttttttttttttttttgatggagtcttgctctgttgccaggctggagtgcagtggtgcgatcttggctaactgcaagctccgcctcccgggttcaacaggttcaagccattctcctgcctcagcctctggagtagctgggattacaggcgcccaccaccacacccagctaattttttttttttttttttttgacagagtctcgctctgtagcccaggctggaatgcagtggcacaatcttgctcactgctacctctgcctcctgggtcccagttcaagcaatttttctgcctcagcctcccgagtagctgagattacaggcatgtgccaccatgcccagctaatttttgatatttagtagagacggggtttcaccattttggccaggctggtcttgaactcctgacctcgtgatccacccgcctcagcctcccaaagtgctgggattacaggcgcgagccactgcacctggcctaatttttgtatttttagtagagacagggtttcaccatgttgggcaggatggtctcaatctcctcacctcttgatctgcctgcctcagcctctcaaagtgctgggattacaagcacgagccactgtgcctggcctactgttagctttttaattgcattttcttttactactattttagtggtcatcttagagattataaaatgcatccttgatttatttcaatctacattaagttagaacatttacaatttatacttaaatgatgcaataaccttataacagttaactcccatttagtacccaccctctttggttttattgttgtcatatatttacttttttgattttttttgagacagggtcttcctgtgttgcctaagctggagggcagtggcatgatcttggctcactggaacctcaacctcctgggctcaaacgatcctcctgccttagcctctccagtagctgagaacagtagctgagaccacaggcatgcattgctgtgcctggctaattttttttaaaattttttatagagatagggtcttgttatgttgtccaggctggtctgaaaatcctggcatcgagtaatccttccacatgggcatcccaaagtgctgagattacaggtgtgagccaccacactgggtctcatatacttgcttttatgtgaaaaatcttatgagatgttgttttaaatagccaatatttgattctcattggacacatttttactctttccttgtgctcttcattccttcttgcagtaccatcagggctcattttccatcagcctgaaaaattccctcagcctgggcaacatagggagacctcatctctacaaatacttaaaaaaaattagttggatatggcggtgcacggctgtggtctcagctactcaggaggttgaggcagggggatagcctgagcccgagaggccagggatgcagtgagctgtgacagcgctactgcactctagcctgggtgacagagcgagagcgagacctggtctcaaaaaataaaagacaaaaacaaaaataaaccttctctagtttttcttttcttttcttttcttttctttttttttttttttttgagactgggtcttgctctgtcacccaggttggagtgcagtggcacaatcacagctcactgtagcctcgaactgcagggtagctgggactataagtgtgcaccaccactcctggccaattttttattttttgtagagatgtggtcttaccatgttgctcatatggtcttgaatttctggcgtcaaacaatcctcccaaagtgctgagacaggacccatgagccaccgtgcaaacctcctcaagtatttcttatagtgcagatgtgcactagtaacaaagcacattctttccgcttttgtctgtctgacaacatgtttcttttactttattttttgaagtgggcatataattgtagcttggcaggttttttttttagcattttattttattttatttttggaagagagtctggctctgttgcccaggtttgagtgcagtggcacaatctcggctcactgcagcctcgcctcctggattcaagcgattcttatgcctcggcctcctgagtagctgagattacaggcatgcaccagtatgcccagctaatttttgtagttttagtagagatggggttttgccatgttggccaggctggtcttgaactcctaacctcaagtgatctgcctgcctcggcctcccaaagtgttgggatcacaggtgtgaaccactgtccccaactctttttagcattttaaagatgtcatttcattattgtctggcttccatagtctgccatcagttgtattgctggtatctctgtctctctctctcttttaaaatgtggtttcttttaagactttctactttgtctttgattttcagtaatttaactgtgatgaggctaagtgtagtttactttatgcttactctgcttggagctcattgatattcttgaatctatggcttgatgcctttcatcatatttgtggaattctcagccattatttctttttctttttttttttttttttttttgttgagacagagtctcactctgtcacccaggctgaagtgcagtggcacaatcttggctcactgcaacctctgcctcctgggttcaagtgattctcctgcctcagcctcccaagtagctgggattacaggcacgagccaccatgcctggctaatttttgtatttttagtacagacagagtttcaccattttggtcagggtggtctcgaactcctgacctcaggtgatccgccctccttggcctcccaaaatgttggaattacagggatgaaccaccacgcccagccttctttgtcttttcttttcttttctttctttctttttttttttttttttgagacaaggtctcattctgttgcccaggctgctggagtgcagtggtgcagtcatggctcactgcagcctcaccctccctggctgatgtgatcctgatcctcccactaaagtagctggaactacagttgtacaccactatgcctggctaatttttgtattttttgtagagacagggttttgccatgttggctaggctggtcttgaactcctgggctcaagtgatcctcccacttcagcctcccaaagtgcttggaatacagtcgtgagctaccatgcccagcccattatttcttcaaatactgcttctctcctattccctctcttctctccttaaggaattccaaacacgtatgttagaccttttgagcacatcccgtgcatctcttatactcagttctgtttttccttctattattctttttgctttgtgcttcaatttgaataatttctattgactggtctttaagttcacgagtcttgccttctgctgtatatagtcttttgctaaacctatccagtgagttcttaatttcaaatatattttgcagtccaaaatgtcagttttttggctgggtgcagtgactcatgcctgtaatctcagcattttgggaggctgaggcaggtggatcacttaagctcgggagtttgagaccagcctgggcaacatggcaaaaccctatctctacaaaaaatacaaaaaatatctgggtgttcccttttcccttccccttccctttcttttcctttccttttctttgacggagtctcgctgtgtcgcccaggctggagtgcagtggcacaatctcagctcactgcaacctcctccttctggtttcaagtgattctcctgcctcagcctcctgagtagctgggattacaggcacccgccaccacgcctggctaatttttgctttttttttttttttttttttttttgagacagagtctcactgtgttgcccaggctggagtgcagtggcacgatcttggctcactgcaagctcgcctcctgggttcaagcgattcttctgcctcagcctcctaagtagctgggagtacaggtgcatgccaccacgcccagctaatttttgtatttttagtagagacggggtttcaccatattggccaggctggtctcgaactcctgacctcatgatccgcccgcctcggccccccaaagtgctgggattataggcgtgagccacatcgcccggccaatttttgcatttttagtagagatggggtttcaccatgttgggcaggctggtctcaaactccgaccttgtgttccacccaccttggcctcccaaagtgctgggattacaggcatgagcaccacacccggccagatacttattttcttggcccattgagactgtgacttcctgcttggtccacttccttgcacctgagtttgggaaatggcttcatggagaaagcaatttaaatgtgaggcttgtccaggcgaggtggctcatgcctgtaatcccagcactttgggaggccgaggcaggtggatcacctgaggtcaggagtttgagaccagcctggccaacatggcaaaaccccatctctactaaaaatacaaaaattagctgggcgtggtggcacacgcctgtagtcccagctacttgggaggctgagtcaggagaatcacttatatccaggaggcagaggttgcagtgagccaagatcatgctactgcactccagcctgggggacagagtgagaccctgtctcaaaaaaaaaaaaagtgaggctcacctcatgtgcattccttctccaacgaccataaccctgcattggctgctgtccagtgcctacaaactgttgttggatattctattttgcccagtatttatggttgtttaccatggtagggtaaatctgagatcaatgagtctgccttggctggaatcaggtttctccctcaggggtttgagtggttgaggctaagttgaaagggtgtgtttcagagcagccacaaagctgtctggactctgaggtcatgcccaggaagctgagagatgaggaaatggaaaaaatgagtttgcggaagctgggaggacaagaaaaagctgaacaaatgcagggtggttgtggggtgtttgtgagggaagggagcggatgctgagagagctcaggaagtgccataggaccactcaccacaccctgttgtcttgaatccctagtgcccacacgcagtaccactctccagccccagggtccatgcctggacaaggtccaggtcctactcttggagtcctgtgagggcctgtctcccttactgataataatcccccagactcaagggaatccaagggacctgctgatctggcaaccaaaaggactcaacctcccaccaccccaacaggtaaagaaaccaaggcacagagaggttaggttcccttctgagggccacacaggaataagttgtacagccaggataaatacccacatactgtaaactcatgagcctgagctcttaacaaatgggttctcctacctcccatgaacaagcacaatccagtctcttctcatgaaagaaaaccttctggactcaagcccccaaggcggcccatgagctcaagtagcctgtgccccctgcacccttggaaggcatgagcttccttgggcctatacatggaagacaaggctctgaacaggtagcaaaaggtctggttatgaaccttgctctgttaatgatttgctcgggaaccccaggcaagtcaccgtccttctctgagcctcagttttccccaacacttgtgaggctattgtaaattgatgataaacccatgtgggaggctgggcatggtggctcatgcctgtaatcccaatactttgggaggccgaggctggtggatcacttgaggtcaggagttggagaccagcctggccaacatggtgaaaccccgtctctactaaaaatacaaaaattagccaagcatgatggcgcacacgtgtggtcccagctactcgggaggctgaggcttgagaattgcttgaacccgggagacagaggttgcagtgagctgagattacgccacagcattccagcctgggcaacagagcgagactctgtctcaaaaaaaacaaaacacaaaaacctatgtgggaaacagcccttggggctcccggtgcccagcagtgccgggcctgtcactgaccttgctctaggatgattcacagggacgtcgtgggtggccagagggctcgtgggtggccagagggccccttgcctgcagcagcaagagcagaatggctggtgtgccaagcttcggggcaccagtgggcaataggagaattctgtcagtgctggggaagggagtaaggaagcaagaacagccttcaggcgtgggtctcccagccacaggggctgtaggggagaccccggaaggaggatggggcagctgtcttagaataccaatcacccaaaggagcccatattccatgtttaccaggagtaccagggtcctcaatatcgtcttcacttgcatttatttgcattttttgcttataatttgtcatttggtggggtctcatttcatatcacagtctctactttttcctccctatttgggcacagggagaggtggaccttcagctaagtcctcctcggggaatttcattttaactctcaatataccttcagactccattagacccaattttaattttaatttttaaccaacctttctttcttctttcctttccttcgttctttctttctttctttctttcttttttttgacagggtctcactctgtctcccaggctagagtgcagtggcacaatctcagctcactgcaacctctgcctcacaggttcaagccatcctcctgcctcagcctcccgagtagctgggacaacaggtgcgtgccacaacgcctggctaatttttgtattttttggtattcttatttttagtagagagggggttttgccatgttgctcaggctggtcttgaactcttgagctcagtgatctgcctccctcgacctcccaaagtgctgggattacaggcatgagccatcatgcctggttgaagtttcttttttgagcagttcaaacgatttatgaggattattttattacttttattttttcacggaggtctcccaaaaccaaagagaacttttatttatttatttattcatttatttttttgagatggggtttcgctcttgttgcccaggctggagtgcaatggcacaatctcagctcactgcaaccttcacctcccggattcaagtgatgcttctatctcagcctcccaagtaactgggattacaggtgcctgacaccatgcccagctaattttttttttgttgttgttagtagagacagtgtttcaccatgttggcagactggtctcaaactcctgacctcaggtaatcctcctgccttggcctctcaaagtgctgggattacaggcgtgagcgactgcacctgtccactttcttttttttttttttaataaaaaagaatgaagggctgggtgtagtggctcatgcctgtaatttctgcatttccagaggccaaggagggcagattgcttaaactcaggagttcgagaccagcctgggcaacagggtgaaaccctgcctctatgaaaaaatacaaaaattatttgggctcagtggcacacccctgtactcccagctacttgggaggctgaggtgggaggattactaagcccaggatgcagaagttgcagtgagccgctgcactccagcctggatgacagaggagaccctgcctcaaaaaaaaaaaaaaaaaaaaaaagaagaagcttattttatcttgtaattatcatatggatctactggatcatttgtaaatctaaaatatattatgagatcttcatgatcttatttttcctatatcataaaacattttgctattgtattccctcaggaactatttcatcattactcatcaattattcccaacccatgctttgaaaaaaagactaaaatagtaagaaaacagaagaatgatggaattgcctgaatgactcaatagtgacatgagtcattgctatttcaccaattttcagttttcttattgccttgtccaaagcattaggaccgtctttcaagaaagtgtaaaaagtccagagatatcatctttgtatttttttttagctttcattgcacacagttaagaattcagaattgttcattttcctacaaagaggaaagagaaggaaactgacagaggaagacatttcacagctattagagcaatcagtagatgaatgcaacgcgacaaacagcagcactctagactgtaatgatgaggtaaaagcatcgtatgagcaaaatcttcagatgatgacatcatgcatgaattttctcaaacccaagaattgtccctattttcccaggggtaggggagaactagagagggatggctctttgcccagggtcactcagctcttgctctgtcctgttgctcagagatctgtgactgagccagcccctcctgtagcatacagtagatgctgccccgcaggatgggacagggctggaccttgaggtgaagaggctgtctggatacctgctcctgactgctagctcttcgcccacctcacctgccacctgtcctttggcgttgggttcttgaggccgtggtttccctctgggtggtgactcagtgcccacagcccgccttgcatgtgatcttcccctcccctgggcctcactgactgccccagcaagaggcagctgtggtttcccctgaagcagcaaccacgaactgccaagcccaccccacccctccgtgtcctagccccaacctcggggcctcagctgaaggagagatggggaggcctcataggcccatggcacttggtgtttacaacgagcttagccctcacagcatgagtgtggaaagtattatccctattcaattgatgaggagagtgaggccaacatgtgtgaggggcttatttcatttatgcattcatttattctacaagcgtctctcaaaagcccactaaaacccaggacagtagacccagagacacgatgtccagatgtacctcaggaaggactggccctggcggcgggagggtcgtgagtgctcagctctccagggattgcccccagctgcagagatttgcctcctctgcctcggcctcccatgcctttctctgggcagcctcatatccaaggactaatccagctgggtactaattcaggcccggctatttaagccctgtgtggggcggtgacaggtcattcggagctcccagtgaggcagctgaggccagggttgggcctgtcttgcagctggacttcttctccctctgcccagtttggcctctttgccttcccttctccaggtgctgtctgcaagagctctccctaacagacatccctcacagtaactccgagcccaaatccacttcctgaggaacccaccctgcaaccctcggctttcaaagagtggccagcctcatggcacagaggcatgtaaaccacccgggtggggagagaataggcccagggagacacagccaccggggcccagaaagctggctttggttttgtggggggtgtgggccgcagagttcaggattggggcgtggcagcaaggcaggggcccaagcgcctgaaaaccacagcccacccccttggcttggagaagggcgaggtccccacctgtctaccatgattttctcagacccagtctgctccaataagcagcccccgctcggctggaccgtctcccaatttcccttcccaaatacatactctgactgtgggtctagatgcctcctacatcctgagtgccttgtggccagccagcagcagcagcagagctgcccagaggaactgtgctggatctagtagggggagaagggagaacaggcccttctgggaccccaagatcccgtgcagggagcacatctgggttccaaacccacaaaaggaaacgtggccaagaaagcaaccaatctccacccccggcagggttgggctgcaccgccatactgtgactgtgctggctacagtcccatggcgatggggaactcacagccccgtgcccctccaaccagaggtccctgggctgggcaacttagataattaggaaggtcttccttcccttaaggtcctcctctggcctctggagctatgggatctgctgttctttggtaccagtaatccacatgtgaggccccatttttctcctaagtcactgtaggatcttgggcctcagttctccatctgtttagcaagggagagcagaggagagccagtccttccacttcccacctgccctgacattttatgactcagtgatacactgacgcctgtcccgttctgcctccttgccttctctcctccaagttgcccagctccatcaccttccctgcccctcccttgaccttccacctcccctgggctgacaagagctgagggtggtcagaagtcggcccggcttcccacctgacacagaggactgctcgaaggagatgctggtcactaagagcagggcagcagctgtaacaagccagcattctggaagctcctggaaatcatattgcagaatgctggcctggcaaggggtgagggtaagggtctagggtggggaacagtgagttctatatagcaggggagccaggacaagtgctgtccatgctggaatgcttcgttctgagcaagaatgacatcacagacaacccctgctccatgcttattaccatgggctgcccaaacccccacccacacagggagggcagcgggaggggacagaaatgaatgggcacaagctgtggcataaattctggtggaggatggagggaaacgatgccagagcatctagccaggccatagcctcacaagctctgtccctgagacaggatttctgcaacactggagagggatggtacccagccatccatgacttctgtgccaggcccgacttgtgtttaattgtatacattattaatggaactggtggcaaggggctggggctcagtctgtgaccagcatcagggctcagtctatgaccaggttcagtgctttatctaggaccaggaccaagactcattctgtggtaggatcagggcttagtgagtgatcaggatgagagctcagtctgtgacgagatcatgggctcaagcctatagctcacattaaggatcccctccgggtggggctcagagccagggacattgtggaaagtgtctgaaggcaaggtggggtcagctgggagagaggggagaagtggaagcatgaaggccaagaggtccctgggcctgaggccagctgtgtgaaaacagaaaagagagtcaggactccagctctgccactcactggctgtgtgattttggagagttacttccctttttgaggtctatgttgtcttgtgcgtaaaatgggaatattaggccgggcacagtgactcacacctgtaatcccagcactttgggaggccgaggcaggcagatcacgaagtcaagagattgagaccatcctggccaacatggtgaaaccccgtctctactaaaaatataaaaattaaagcccaggcgaggtggctcacgcctgtaatcccagcacttcgggaggccgaggtgggaggatcacgaggtcaggagatcaagaccatcctggttaacacggtgaaaccccatctctattaaaaatacaaaaaattagcctggcatggtggtgggcgcctgtagtcccagctgctggggaggctgagacaggagaatggtgtgaacccaggaggcagagcttgcagtgagccaagactgcaccactgtactccaacctgggcaacagagtgagactgtctcaaaaaagacaaaaaatgagctaggcgtggtggcaagcacctgtagtcccagctacttgggaggctgaggcaggagaatcacttgaacccgggaagcagaggttgcagtgagccaagatcacgccactgcactccagcctggcaacagatcaagactccgtctcaaaaaaaaaaaaagggggggaatattagttaggtgcagtggcttacaacgttaatccagcactttgggaggccaaggcgggaggacagattgagcctaggagatttgagaccagcctgggcaacacagtaagaccctgtctctataaaaaatttaaaaggtagctgggcatggtggggcccgcctgtagtcccagctacttgggcggctgaagcaagaggatcgcttgcgcccagtaattcaaggttgcaatgagctacaattgggctactgggctccatcctgggtgacagagtgcgaccttgtctctgaaaaataataataataaaatttttaaaagtgggaattttgacttctgttctgcctttgagatagagtcttgctctgagtcaccaacatgcaagttactatttcacaaagcaccaagaacccttatcaatacctgcctcccaagattattcacaggagtgagaatgcacttcatgagacagcagaaaaaatggggaggggttgtttgctcaatttccaaaggagaattgcttcagacaggaaaatctcaaaaggaaacagccttactgttgtcatggcttctcctcacagttcttctggtcagtttttattccccaaaataatgtgtacagagtatttacagtcagagaatgctaaaggattacaacaaaaataacacgctctttaccccacgtcagcctgctcgccaaaagcagccatttcaacttattcagttgtttcttctggtttttactccctaaataaagcattgatttcaattctggttatctcccaagaggtccaatttagatgctgtctctagggctccctattgtgacagaggaggttcacttacactctttctcctctcctttcaatatcataccaccacaactcttggttacattcacaatcactaaaaagtgtttatggctgaaacaactaatatactatctttttcaatctcctttcccccacagagttaatcattgtctcatttttttcacttgcttattttctttgacccatgattagatcttctgcaaaagcccagtaagataattctcaatactgattttcactatcagttccagttccttaatttttttttcccttgagacaccctttctggagccctcagttctcctgcctccatctgagccagaagctttccagatcagcagcacagtcgtcatccagaggcttccctttgccaacattctgcaacgtcatttcttctctttcctctatggatctctgatttttctgggttccatttcttctttcttggtttatgcccttttagggtggagcacatcctccagttccttcctgaggaagttttcacggaagacaatttttttttttgtctgaaaatgtcttattttctaccctcacactgggttgatactttggctgggtatataatgattttccctcagcaactttaaggcattgtttcataaacttctagtttctaatattgctgttgagaggtctaatactgatctggctcagattctctctctctctcttttttcctttttttttttttttttgagataagagtcttgctctcttgcccaggctggagtgcagtggcacgatctcggcttacctccacctcccaggttcaagggacttttgtgcctcagcctcccagggagctgggactagcaccaccacacccagataatttttgtaatattcttcccctgagatggagtcttgctctgtcacccaggctggagtgcagtggtgtgatctcggctcactgcaacctccacctcccgggttcaagcaattctcctgcctcagcctctcgagtagctgggattacaggtatgagccactatgctacccatttttttttttttttttgagacagggtctcactctgtcgcccaggctggactgcagtggcacaatcacagcccactgcagccttgacttcccaggatcaagcaatcctcccacttcagcctcccgagtaggtgggactacaggtgtatgccaccacccttgtctaatttttttagttttttgtagagctgggcctcaccatgttgcccaggctgttcttgaactcctgggctcaacaatcctcccaccttcgcctccccaaatgctgggataacaggcatgagccacggggcccagccaatctttaagttctttaaacaaatgtttcagttttcagagtatatgttttgcctttctttaaaaaaaatttatttctggaagatctggggctccgaatccagctaggatggctgtggttccgctactgctgtctgggggtttgtggaacaccgtgggagcgtccaatctggctgttactcgcggctctatggtgaagctgctcgaaatgcactacagtgtccatctgcagtcacacgatgtgctctatgggtcaggtactgggcagcagtcagtgacaagtgtaacctccatggatgacagcaacagttactggagaatatgggtaagatcaccacagctggtgagaggggaacccccatcaagtgctgccagcccatccggctgacacatgtcaacactggctgaaacctccacaactttctgaaaaccaggaagtgggtgcttttggtgaggaaggtgaaggtagtcacctggatgactggaccatactctgtaacgggccctactgggtgagagatggtgaggggtggttcaaacattcttccattgaggaaccgctgtctgtcacaggagaacgatatggtggacccatcagtgggcaaaaagagacgcatggtctggcctagccaagccgagcaacgactggaaagccatggaaggcatcttcatgaggcccagtgagttgttgaaggcaggaggccaccatgcagaggtaggagtctggaggctctgagccactgtcactacacagtttgtagacatctgtgctgcttcaccttgggatccctgccacaagttccccaggagtggccatgttactactgagatgaagatgtgcaatggaaaacagtggctgtgttcacaagctccagccctgcacatttgaattggctgctctcccagacttgggtcagtactttctgagtagaggacttgctggtgacagggtggatgctttttattcatactggtgtgtccggaattggtgggttcttggtctcactgacttcaagaatgaagccacggacccttgcggtgagtgttacagttcttaaaggcggtgtgtccggagtttgttccttctgatgttcggatgtgtttggagtttcttccttctggtgggttcctggtctcactggctcaggagtgaagctgcggacctttgccgtgagtgttacagctcttaaggcggtgcgtctggagttgttcgttcctcccggtgggttcgtggtctcgttggcttcaggagtgaagctgcagacctttgctgtgagtgttacagctcataaaagcaaggtggacccaaagagtgagcagcagcaagatttgttgcaaagagcgaaagaacaaagcttccacagtgtggaaggggacccgggttgccactgccagctcgggcagcctgcttttattctcttatctggccccacccacatcctgctgagtggtagagtccagtggtctgttttgacagggcgctgattggtgcgtttacaatccctgagctagacacaaaggttctccacgtccccaccagattagctagatacagagtgtggccacaaaggttctccaagtccactctgtatctaccagagtagccagatacagagtgtccactggtgcattcacaaaccctgagcgagacacagcgtgctgattggtatgtttacaaaccttgagctagatacagagtgccaattggtgtatttacaatcccttagctagacataaaggttctccaagtccccaccaatctcaggagcccagctgggttcacccagtggatcctgcaccggggctgcaggtggagctgcctgccagtcccgcgccgtgtgcccgcactcctcagctcttgggtggtccatgggactgggcgccttggagcaaggggtggcgctcctgggggaggctccggcagcacaggagcccacggagtggggtggaggctcaggcatggcgggctgcaggtcccgagccctgccccgtgggaaggcagctaaggcccggcgagaaattgagcacagaagctgctggcccaggtgctaagcccctcactgcccggggcggtggggccggccggccgctccgaggtccgctgagcccacgcccacccggaactcgcgctggcccgcaagcaccgcgcgcagcccgggttcccgccgcgcctctccctccacacctcccggcaagctgagggagccggctccgggcttggccagcccagaaaggggctcctacagtgcagcggcgggctgaagggctcctcaagtgccgccatagtgggagcccaggcagaggaggcgcggagagcgagccagggctgtgaggactgccagcacgctgtcacctctcactggtaagacacactgaggggacatccctcttagctgtgaaacttctagtcctcaggagcttggcgtcctggattgttaaacttcatgactttatcccaattttctttctccaaaatgatgttttttttgagacaatcttgctctgtcgcttaggctggagtgccatggcctaactcagctcactgcaacctccgcctcccgggttcaagcaattctcttgcctcagcctcccaagtagctgggattacaggtgcccgccaccacacccggctaatttttgtatttttagtagagacaggattttaccatgttggctagggctggtctcttaactcctggcctcaactgatccacccccctcagcctcccaaagtgctgggattacaggtgtgagccgccatgtcgggcctccaaaatgattttttttttttaaagaaagaattttattattagcctctgtgttatttattaggtgtgctatttcatgatttgctttatccttgagtcctaaaactcttttgagatgctgggaaccttcaatgtgggggccttttaagagctttagttgcatccgaaccttttctctttctactttcatttctccgcaggtacctcatttttaatagatttttgactaattatggccaaagactctcaaagaatacaacacaataaacagccaaataattttattcctaagttgttggggtgatcagacccaacaccaggccgtgggggatatgaagtcccgcggaatcaaacccatgagaaaagacaagagagaaagtcggaccaggggcccaactatagggaggctgggaaggccctgagctctgggagcccaggctatttattggtgatcaaacaaagaaacaggtgttgaggattgtaaggaagcagtgtatcaagcgaatgagctacagctgtgatggtttagcattttctttgaaacatatggctacttgagataatgggagtgctagaagcaaggagccagcaaatctaggcacattccaaaggccacgaggggttttagaccctggaccgccgacatgtaccaagccctgctcagcttctctcccaacactcagcttttctcccaacagtaagtattttattctttttgatgctattgtatagaattgctttcttaatttcatttttatattattcattgctagcataaagaaatatggttgacttttatatattgatattatactcctcaaactgattgaattcattagttctagtagttgtttttagtggattccttaggattttctctattcaagatcatatgctccgcaaatagagatggctttacttcctccatcccaatttcagtggtatttgaaattaaattttaattgccctggctaactgccctggttggatctccaggacaatgttgagtagaagttgtgagagtggacatccttctctggctcctgatcttagggggaggtttcagtttttcaccattaagtatgaagttggtgttgggtttttcataggtgaaccttaacaggttgaggaagttcccttctattcctagtttgctgagtgtctttatcataaaagagtgttggattttgtcaaattctttttctgcatcattgagatgatcttgtggttttcttccttattctactaatatggtgcattggattgattcattttcgtaagtccagccaaccttgcattcttgggaaaaatcccacttggtcaatcttacatgttgctggattcagttagatagtattttattaaagatttctatatctatattgacaagggatattggtctgtagaatttttgtttctgtttttgttgtgatgtctctctggttttggtatcagaataataactggcctcatagaataggttaggaagtattctttcctcttctgatttttggaagactttatggagaattggagttcatccttcaactgttttaaaattcactagtgaaatcatccctactttttctttgtgagaagttttttgatcatatatattgatcttgcatactgtgaccctgctacatttgcttattagttctattagtacttaaagtgcattccacagggccaggtgtggtggctcacacctgtaatcccagcattttgggaggctgaggtgggaggatcacttgagctcaggagttcaagaccagcctgggcaacatagtgagaccccccccatcattagaaaaataaaataccctccaaagaattatctacatacatgtcttctgcaattaaagacatttttacttattattttcctacctacatgcctttgttttcttttccttccctgatttcaccagcttgaaattccagggtaatgttgagtaagagtggggagagagaatgtccttgcctttttccttatcttaggagaaaaacattcagtctgcaccattaagtattaagttagcagtagttttttggtaaatagtctattgtgaagtccccttttttattgctgattttggcaatttgtgtattctctctttttttcttggtctctattaaagcttgtcaattttgttgatcattaaaaaaagaaaaacgacttttgggctgggggcggtggctcacacatgtaatcccagcacttaggaaagctgagacaggcggatcacaaggtcaagagattgagaccattctggccaacatggtgaaaccccgtctctactaaaaatacaaaaattagctgggcatgatggcacatgtctatagtccatcccagctactcgggaggctgaggcaggagaatcacttgaacctgggagagggaggtttcagtgagccgagactgcgccactgcactccagcctggcgacagagtgagaccccccatcactagaaaaataaaataccctccaaagaattatctacatacatgtcttctgcaactaaagacatttttactcattattttcctacctacatgcctttgttttcttttccttccctgatttcaccggcttgaaattccagggtaatgttgagtaagagtggggagagagaatgtccttgcctttttccttatcttaggagaaaaacattcagtctgcaccattaagtattaagttagcagtagttttttggtaaatagtctattgtgaagtccccttttttattgctgattttggcaatttgtgtattctctctttttttcttggtctctattaaagcttgtcaattttgttgatcattaaaaaaagaaaaacgacttttgggctgggggcggtggctcacacatgtaatcccagcacttaggaaagctgagacaggcggatcacaaggtcaagagattgagaccattctggccaacatggtgaaaccccgtctctactaaaaatacaaaaattagctgggcatggtggcacatgcctgtagtcccagctactcgggaagctgaggcaggagaatcacttgaacctgggagagggaggtttcagtgagccgagattgcgccactgcactccagcctggcgacagagtgagacttcatctcaaaaacaaacaaaacaaaaagcaaacaaaaaaaaaggccgggcgcggtggctcacgcctgtaatcctagcactttaggaggctgaggcgggtggatcacgaggtcaggagatcgagaccatcctggctaacatggtgaaaccccgtctctactaaaaatacagaaaaaattatctgggcgtggtggcgggcgcctgtagtcccagctactccggaggctgaggcagtagaatggcgtgaacccgggaggtggagcttgcagtgagccgagatggcgccactgcactccagcctgggcgacagagcgagactccgtctcaaaagacaacacaaaaaaacaccaactctcttttttttttttttttttttttgagacagagtctgactctgtcgcccaggctggagtgcagtgatgcaatctcggctcactgcaagctccgcctcccgggttcacgccattctcctgcctcagcctcccgagtagctgggactacaggcgcctgccactatgcccggctaatttttgtatttttagtagagacggggtttcaccgtgttagccaggatggtctcgatctcctgaccttgtgatccgcccgcctcggcctcccaaagtgctgggattacaggcttgagccaccgcgcccggcctattgtttttttctatttcattgatttctgctcttatctttattattttcttcttcttactttgggtttgatttccttttcttttttgaactacttgaggtggaagcttagattattgatatttgattcgtctcccattgcagcataagcatttaaattatgtaaattataaatttacttataaggctgggcacagtcgctcacatctgtaatcccagcactttgggaggctgaggcaggcaaatcacttgaggtcaggagttcaagattagcgtggtcaacatggtgaaaccctgccgctgctaaaaatacaaaaattacccaggaatgatggtgtgcacctgtaatcccagctactcgaggatgaggcaggagaatcgcttgaaccctggaagcagaggttgcagtgagctgagatcacgccactgcactccagcctggacaacagagcagatcacttggctggtcttgaactcctggcctcaagtgatctgcccaccttggtctcccaaagtgctgggattacaggtgtgagccaccacacctggcaccctgatgggattttgactggtattgcattaactctgttggttgcattgggaagagtttgtcacttaaccatgttgatttttctactttataaacatttatgtagatattttttagtttctctcatcggttttgttttgttttctgcatactgctcttgcacatgtttcgttagatttttacaaagtaggaatctgtttcttatgcagttctaaatggtacttttcaaaatttccaatttatttattgctaatctataggaatacaattgattttttttttccttctacaaatgtctgaggtaggaaaacaaggctgcccagcttgtggcagccctgataatcctcaaaggctgatcttggcctccagccctgactgaggagaaaaggggccacccatagccccactggcacaattggtttttctatgctgacctcatatcccataactttgcttaagtcattcattgtaggagctttttgtagattctttgtgattttctataaaggcaattatgtattttgctaacagaaacaggtttgtttcttctttgccagtctgtaggccttttatttgtttttcttgacttcttgcactggttagggcctctagtaaaatattgaatgggtgtgttaagaggaggtatccttgcttcttcctgaacttagagtgaaagaattcagtttcttaccataaaatatgacagtagatgtagggtttttgtgaatgtccatcattgagttgaggaattcccattagttcttagtttgctgagaggttttcatcaggaataaatgttggatttcttccatgtcttttaacttctctttcatatttcaccattttttcattctttgctgaatttttagtaatttcttaaactgtttattttattttatttttgagacagtctcactctgttgtccagactggagtgtggtggcgtgacattggctcactgcaacctccgcctcccaagttcaagtgattctcaagcctcagcctcccgaatagctgggattacaggtgccggctactatgcccggctaatttttgtatttttggtagagacagggttttgccatgttggccgggctggtctcaaacttctgacctcaagtgatctacctgtctcagcctcccaaagagctgggattacaagtgtgagccaccacacccaacctcttttgaggttttaaatcttaataattatagtttcattcctgagagttttatttggttcatcttcaaatatgcctaattaatttaattagtttatttgccatattttcagtatcgctttacaattctttttttttttttttttcagacaaggtcttgctctgttgcccaggctggggtgcagtggcaccatctcggctcattgcagcctccacctcccgagttcaagcaattctcctgcctcagcctcctgagtagctggaatcacaggcacgcaccaccatactcggctaagttttgtatttttagtagagacagggttttgccatgttggccaggctggtctctaactcttgacctcaagtgacccacccatttggctttccaaagtgctgggattacagctgtgagtcaccgcacctggcccgttttacacttctttaaacatattaaaaattttttttcagctgggcatggtggttcatgcctgcaatcccagcactttgggaggctgaggtgggcagatcacctgaggtcaggagttcgagaccagcctaaccaacacggagaaaccccatctctactaaaaatacaaaattaggtgtggtggctcatgcctgtaatcccagctacttcggaggctgaggcaggagaattgcttgaacccgggaggtggaggttgcagtgagccgagattgcatcattgcactccagcctgggcaataagagcaaaactccatctctctctctatatatataataaatatatatataataatatatattatatgtcatatatagttatatattataattatataatctataaatatataaaaatatataatatataatatatatttataatatataatatatatttttccgtgtgtgtgtgtatatatatgtgtatatatatgtatttttttttttttttagagagagagagatggggtctcactctattgcccagcctggtcttgaactcctggctcaaacaatcctctagcccaggcctcccagagtgctgggattacagccgagcgcccggcctgaaacacttattttctatcctgcatctcatcattctattttatgtagtatttgtgggtctcatcttgttattcgttgtttctgctgactcatgcccttgtggtttgtttctttttgagtttattgatgtttaattatgaacttatgttccttgaaattctttgtgggaagtctttgaatctgtgtttaaaatatattcttccagaaaggatttttgtttgcttttgccaggcgcctaggggtacttccaactcagatccacttaaaaattgtttttggcttagtgtttttccaatcacatagggaatatgatgttgggcttttctctgtgtgaatatcagcttgttatgcattttactggatttctttttagcctgtgttacctctccagcacagctaagtgggtacggcaaagtcttctgtggctgagttgttttctccccatttctcccttagggcactggcttttgagaagtcccaaatttgggggagaaaggaaatctttgataacctacttcccaggaccagacctcaggtcttttcttctctttcctcattttgtttcccctaaaagcaaagcctcagacaaaggtttttgtgtaattaactttggaagtaatcccagggagtaggagtgagggctggagagagaaagaaagagggaagcccgggacaaggtcgcattatttaaggggacctctgataggtgcttgattccataggatcttccaaggagtcttatgaaatgggagatacaaaaaagacacaatgagtatttgcttgtgtcaatcattggtcaagagtggcctcacagacatgaactcccctgaacttggggtctgcgcatgcataatggttcaggggattcccgagagcatctgccctgtggggtcagtgagactcagacaggaagggaggggtgggccccatgtgcccaaggtgaggcagcacctgcatgaggcccacagaacactcatcacctcagcagtggccagaatcagaactggggccaagcagactgaagtggtgcccaggaggtgcctggcacactggccatttacatcccagggtctcagaaagcacaggccccggtgcaggctcaccctgatggggtcatgctcttgttattctggcttctgactgattccctgtttaacacccttttatctgtgctttcacacacacatttttggtatttcattcagcatttttaggaagggatttctctattcagctagtctgcatatttccagatagagaaataaatggtcattgttttcaaatgtttacatatactttatttttaaatttttattatttgagatggagccttgctctgtcgcccaggctggagtgcagtggcacgatcttggctcactgcaacctcctgctactgggttcaagtgattctcctgcctcagcctcctgagtagctgggactacaggcgcgtgctaccacgcccggctaatttttgtatttttagtagagataaggttttgctatgttggccaggctggtctcaaactcctgacctcaagtgatcctcccacttcggcttcctaaagtgccggaattacaggcgtgagctactgcgcccggcctcaaaatgtttatatatacttcaatattctttttgttattatttgctaagtattgaaaccaagcattcctttctggagctcccataactcactttgtgccctgttttgaaaaacaggccagtcaataatgacagcagcaacgcagcagctcccagcttttcaacacctactgtgtggctgacacctgctgtggctttataggcattatgtcagtgaattctcaaaactaccctaaaatagtcactctggttcccttttttcatatattttttatttttaaaattgagacaaggttttgctgtgttgcccaggctgatttcaaattcctatgctcaagtgatcctcccacttcggcttctggttcccttttcccagccactggttcccttttcacagaagaggaaaccatggcctggaaaggggccaaggccacatagtatttacgtcaagcttgtccaacccacaactcacgggccacatgcggcccaggatggctttgaatgcagcccaacacaaattcataaactttcttaaaatattataatttttttttttttttttacaaaaaattagccaggcgtggtggtgcatgcctgtagtcccagctacttgggaggctgaggcaggagaattgcttgaacctgggaggcagaggttgcagtgaactgagaccgtgccactgcactccagcctgggcaatagagtgagactccatctcaaaaactaaaatataaaataaaataaaataaaaatttttttggcaaaattttttaagctcatcagctatcattagtgttagtgtattttatctgtggcccaagacaattcttcttcttccagtgtggcccagggaagccaaaagattagacacccctaataagttgttgagccaggattgtgtccaaagcttccccacttttactacatcgcatgcctttctatggaaaaaagccttcccttcttccctagtacttctcccaaaacacacactcatatagagtagcacttgagatccagtgccccttggcagccgattgcagtgggtaagctgagctcagggttgcaggccagcagggcggcagtcagcacacagagctttcctatccccccaggaaacctgcaaggaccccagtaggccttagatggccagtgttggcaaatcctaactgggaggcaaactgggagagcccactgccgttgcagactggttactgtccccgctggagccctgtggaagtgggtagaaatccaggcctaaggagggtaccaagccagagccacctgccccctagtaccccagcctgggggggccacccagtgagcatttctgtctcctcgggtgctgtagtcaaggtgaaaagcaagttgcaacctgaaggctgggcattccaggtatagggcttcttctggttaaaatgtgtgggtacggggactaggggaggcttggaaggggctgtccccagagtttctatgagtgaatatatactttgaaacacttagaaccttattgtcagcatggacagacagggaccttggggacagagggacattaaggccaacatcttgttttatagatcagtaaactgaggtccagagacccatggcctagcgaaggaggttcaagtgcaggccttcctgaccacagtgcaccgccaaggctccttctctacaccactgcatgtgtgcgtgtgagtgggcagctgcacaccatcgtatacgtaaacgtgtttacgcatggagtacatgtgctttatggtgcaggggtgaaggcacaaaggcgtgtgtatgggggggctggggtgttatactagcaggctgagcagactgtaacaaggggacacacatctctcttttgggccaacccatgtttggagaagacaggagctttctcatgcacaagcgccaagagaggaaagtgaacccaggtttgggcggtctgtggtgacttgtgccatggaccatgtggaagcctgaagatgcctggggccttcgtagtaccattgcctttagcctcccgtggccacctgcagcaactgccatcacccttactgtggacgggagttgcactgctaaagtccccacggccctgcaggatggccagagatgtctgccctcactccgctaccctctcagtcttctttgaccactctggtcccccaacctcaatgtcgaccccacatctgcaagtgacatcactgtccatgtagctctgtaagtcttcaaactgggagtcagcctacctcctgccatcactgaccttcaagcaatccagatgaaaaatgcctctgggcattttggggacaggagatataaggaatgagtcataaatatcctgtcatataaaataggatgctatgaaacactccccgggtcatgtcaaaaggagacaggagccaacctgaatacacttccaccagccaaaggcgagattttttgagcaccagtaagattaataactgcaatggattgacaccaatcagacatgtttaaatccactgattcacacatatttaaaaataactagtttttcaccttagggggatgctaggcagctggtaaataaagggaaagcattaaatatttgtcatgtcttttgcatatgatctatctctcaggataactaaataatcaatgagggcaagtttcactttgtagaaatatgcaggttaataaaataagaaataatacagttataatgtcactattttgcaattcctcatgaatttaagtaatgatcatccatggctgcagatgttgcaaaatgagacacaaccagaagttaggtgcttcctgatggaagcacatatcaccatctaggaggtggtcttgaaaaaaatagttggacgtgaatttgttcaagcctccctaactaaatacagaagacagaagacatgttaaatggtaccacagggttgcaatcaaccaaattcagactgtgggaaactgcaaggataaacaacctagtttccagcttggtgcggtagctcacgcctgtaattccaacactttgggaggctgaggctggtggatgacttgaggtcaggagttcgagaccagcctggccaacctggtgaaaccctgtctctactaaaaatacaaaatttagctgggtgtggtggcacacgcctgtaatcccagctactcgggaggctgaagctggagaatcacttgaaccctggaagctgaggttgcagggagccgatatcacgccactgcactccaggctgggtgatagcaagactcggtctccaaaaaaaaccaaaaaacaaaaacaaaattaaaaaaatcccccaatttccttaacaaaacagtattacaaaacaaaaagagacggaggggaaacttgcaggttttaagatttatcaaccaagccctatttatagactttatttgtatattaattcaaacacctgttaaaaaagaaaatgaggccaggaatggaggctcacacttgtaatcccagtgctttgggaggctgatgcgggtggatcacttgaggctaggagttccagattaacaaagtgggcaacaaagtgaaaccttgtttctacaaaaattttaaaaaattaccaggcatggtagtgcacgcctgtagttccagctactcaggagactgaggcagaaggattacttgagcccaggagtttgaggttgcagtgagctatagttgaaccactgaactccagcctgggtgacaaaacaacatcctgtctcaagaaaaaaaaaaaaagaaaaagaaaaaattataattgaagaaatagaaaacaccaactggattataatttccattaatgacttattattgatttttatatgataaagtagtgacttctttctttctttcttttcttccttgcctttcctttctttctttctttttttttttttttttgagacagattcttgctctgtcacccaggctgtagtgcagtggctcgatctcagctcactgcaagctctgcctcccaggttcacgccattctcctgcctcagcctcccaagtagctgggattacaggcgcccgccaccacgcccggctaattttttgtatttttagtagagagggggtttcactgtgttagccaggatggtctcgatctcctgaccttgtggtctgcctgcctcagcctcccaaagtgctggggttacaggcccaggaacaggataatgataatatctgttccaaacagtgtcttcactaaataatcccaaccagtaagaaatagaatcatttcaatcacaagactcaagtcactccaaaaagatgatgctaagagctgttgatcacgtgttcctacagcgatccataccaacatactgatgaagctacagctaaggtattaggctactgtgctcccatctaggaagtgacccccagggattcttcaccctgtgctttcaccagcactctgtatatgaacttaaccacctcagcactcccccctgcttttgccatgtcttctgtgtttggatgttgagtattgctggatggaaagctttgctatcagcagaacaatggttgaggttgtaaaagcctactaagtgccattctaaaatgggtcgttgtgctgtatgaaacaacaaccacaacaactcagaagcttcaaacaataatcctttattgtcacgctcatgacctgtgggtcagctgtacaattcagctgaaattgaatcgtaccttggttgatcgaggctagactccaagctgcaggctgagttcagatctgctcggcatgtccctcgttctcctgggaccagcggctacccagggattatggcctgttcctggagactcattcctggacccagaaggaaggagcagcagctatatggggcacgttcttgtcatggcagattactgcagcatgagaaggcatgtccaactgagcaagcacatttcaaaacttctcatgtcaggttcacaagtttcctactggccaaagcaagtcacatggccaaacacaaaatcaaaaggtgggaaagtattctctgtccaccatggcaaggatgtgggtggataattatattacaagggacaaataattcaatctttcacagtctttggggatccagggcactgcctttgttcatgccccagcacttctcatcaagacaaaagaacatcctgctaggagactttcctgccactagcagagccccttcaaacctagtggcagctagagtgattttttttttttttttaactagctctcctctagttttgtctgtttgtgtgtatggtaaaaaaatgcataagataaaatttaccatcttttttttttgagacagagttttgtcttgttgcacagggtggagtgcaatggtgcattcttggctcactgcaacctacgcctcccaggttcaagctattttcctgcctcagcctcccgagtagctgggattacaggcatgcgccaccacgcccagctaatttttgtatttttagttgagacagggtttcaccatgttagccaggctggtctcaaacttctgacctcaggtgattcaccagcctcagctcccaaagtgctgggattataggcgtgagccaccacacccatgcctggctcccctttccttttttttgttgttttttttttttgttttttttgcatagagtctcaccctgttgtccagactggagtacagtggtgtgaactcggctcactgcaacctctgcctcctgggttcaagcaattctcctgcgtcagccacctgagcagctgggactacagccgtgtaccaccacacctggctaattttcgtatttttagtagagacagggtttcaccatgttggccaggctagtctcgaactcctgacatcaagtgatccacctggcttggtctcccaaagtgctgggattacagacgtgagccactgtgcctggccaaaatttaccatcttaaccatttctaagtatagagttaagtaccgttagttaaattcgcattgttatggaagagctctccggaatttttttagcttgcaaaagtgaaactatacccatgaaactaacacctctgtatttccctctccccagcccctgacaaccactattctactttctgtttctatgaatttgactactatagacaactcatgtaagtagaatcacatagtatctgtgttttggggactggcttatttcacttaataagatgttctcaaggttcaaccatgttgtagcatgtgtcagaatttccttcctttttaaggctcaataatattccgttgtatgtatatacctcattttctttatccatttgtcagtggacacttgggttgcttttgacctcttggctattacaactagtgctgctgtaagcatagtgtggaaatatctccttgagatcctgttttcaattattttggctgtaaaaccagaagtgagatggttgggtcataggatagttctatttttagtgttttaggaacttccatattgtttcccatagtagctgccccattttacattcccaccagcagtgcagaagcattccagttttcacacattattgccaacacttgttattttctgttattttgatactaattatcctaatacgtgtgttttttttcttttttattttggagacaagagttttgctcttgtctcccaggctgaagtgcagtgacgcaatctcagcttactgcaacctctgcctcctgggttcaagtgattctcctgtctcagcctcctaagtagctggaattacaggtgcctgccaccacaactggctaattttttgtatttttagtagagacaggggttttaccatgttggccaggctggtctcgaactcctgacctcaggtgatccacctgcctcagcctcccaaagtgctgggattacaggcgtgagccacaatgccgggcctcaattttttaattaaattttttattttgagataattatagattcacatgcattataagaaataatatagacagattccatgtactcttcacctggtttccttctcatttcctcagtggcaacatcttgcacaatagtacaatatccacagccaggaaattgatattgatacaatccatagatcttgttcagatttcagcagcttacatattcagagtgacattttaaacaagcaaatctgatcctatcacttacctgcttaaaacttttccaaggatgttcattacataattgtttgaactggtttatttttgagacggagtctcgctctattgaccaggctggagtgcagtggtgtgatctcggctcactgcaagctccacctctgggttcatgccattctcctgcctcagcctcccaagtagctgggactactggcgcccaccaccatgcccggctaatttttgtatttttagtagagacggggtttcaccgtgttagccaggatggtctcgatctcctgaccttgtgatccgcccgcctcaccctccgaaagtgctgggattacaggcgtgaaccaccgcgctgggcctgaacttgttaaaaaatgagaaccaacctaaatgtccagcagcagcaggatggttgaatagattacattgcgtccatataataggcacacaatccagccaggaaaacttggagcagtcgtatgtacgctgatatgggctgggttccatggtctattcttttcctacggaaaaaagccaggtacaggattgtgaatacctggccgggcacggtggtgcacgccgtaatcccagcattttgggaggctgaggcgagtggatcacctgaggtcaggagtttgagaccagcctgactaacatggtgaaaccccatctctactaaatacaaaaaattagtggagtgtggtggcacatgcctgtaatcccagctacttgggaggctgaggcaggagaatcacttgaacccgggaggcagaggttgcagtgagccgagatcatgccattgcactccagcctgggcaacaagtgcgaaaccctgtctcaaacaaataaataaataaaaataaataaattgtggataccttttgggtataaaggcatacaatataggaaagggtacatagtacactgaccacagtagttgtctcagcaggctgagattgtgtagtgggatggaaagttaattcactctgttttgtagtggttctcaaagttctgcgtttgaagaacccctcaaagttcaggacccctctacactctaaaaattactcagtgtccccaaaaacattttcattaatgagggttatcagaaattaaagctaagaaatttaaaaaatatttacatattaattcatttagaaataacaataggccaggcgaggtggctcgtgcctgtaatcccaacaatttgggaggccaaggcaggctgatcacttgaactcggaagttcgagaccagcctggccaacatagtgaaatgccatctctacaaaatatacaaaaattaggctgggcgtggtggctcatgcctgtaaacccagcactttgggaggccaaggctggtggatcatgaggtcatgagatcgagaccatcctggctaacacggtgaaaccccgtctctactaaaaatacacaaaattagctgggtgtggtggcacacgcttgtagtcccagctacttgggaggctgaggcaggagaatggtgtgaacccgggaggcggagcttgcagtgagccgagatggtgccactgcactccagcctgggcaacagagcaagactccatctcaaaaaaaaaattatatatatatatacacacaaaaaaattagtcaggtgtggtggtggtgtgtgccagtagtcccagctacacaggaggctgagactggaaaatcacttaagcccaggatgcggaggttgcagtgagccgagattgtgccactgcaccccggcctgggcaacagagtaagaccctgtctcaaaaacaaaaaaaaaaaaaagaaaggaaataacaacaataaagcaattatatgttaatataaatgacagttttgtaaaaagtaactatcctttccaaaacaaaaacatttagtgagaaaaatgactttgttttgcatttttgcaaatctctttaatatctgacttaattgaaaaatcttcattctcatatctgtttctgcattcgatctatcagaatacattgttttggttggagtatgtgaagaaaattcatgtcagtaagatatgtagttagaaaaaagagactttaaatagccttttgtgggtattctttgatagcacatcgactggacaagcagcagtttctcaaagcaatgtagaatctgaaaccatagcaatgacatattcatactgttacattaaaactcattgttccggctgggcgccgtggctcatgcctgtaatcccagcaccttgggaggctgaggccagacgtattacatgaggccaggagtttgagactagacaggccaacatgacaaaaccccgcctctactaaaaatacaaaaattagctgggtttggtgatgcacatctctaattctagctacttgggaagctgaggcacaagaattgcttgaacccgggaggcagaggttgcagtgaaccgagattttgccactgaacgtcagcctgggtgacagagcaagactctgtctcaaacaacaaaacaaaacaaaagccattgctctctcttgtccccccacttttttttttaagacagggtttcactctgtcacccaggctagggtacagtggcttgatcatagctcattgcaacctcagactcctgagctcaagcaatcctcctgtctcagcctccttagtagctggaactataggtgtgtgccaccacacctggctaattttttattttttaaaataaagatggggtcttgctatgttgcccaggccggtctccagctcttcgcctctagtgatcctcccacctctacctgccaaagtgttgggattacaggcatgagccactatactcagccctgtcttgtaccttaagtgaatcttttatgtgagtgtagttctgtaacattatgcatttgtcatttggaaagtactgatagagttatgcagatcatccaatttttgacacattttgttagacaatattgaaaaatcatgtgtgttaatatcactactaatctcataagaaaattgtttaagtaaggctgggcacggtgactcatgcctgtaatcccagcactttgggaggccgaggtgggtacatcacctgaggtcaggagttcaagaccagcctggccaacatggtgaaaccccatctttactaaaaatacaaaaattagccaggtgtggtggcgtgtgcctgtaattccagttactcaggaggctgaggcaggagaattgcttgaacccaggaggcagaggttacagtgagctgagattatgtcattgcactccagcctgggtgacagagcaagactccatctcacacaaaaaaaaaaaaaagaaaagaaaggaaaaaaaaagtgtttaagtacttagaagcttgttaagctcacaatggtggatacacattttccaaaattctaacttttgcttgaaagctcaaattttatcattggcaacaaatgctgtcagttgcttttatggagtgacagtttcactttatttattgttaagaaatgtctgctaaataccagtcggaataaccatagtttgtcagtctttcaagtaaaaatggtgttctatgaaaaaagcagctagtttggctgacaactcagacaatcacacaagcgcttttccttagagaagcccatcatcctttggtaagcagcagaagtgctttctacatactcctcctttcatcacacaaaatatcaagcatagaaagatatatactgctcacagattgagagttaataaaagtattttttactgttccatcaaggtcattcataaatgaaatgtttttaaattgcaaatacatggcaatgaagaatacaatgctagcctgggcaacatactgagacaccgtctctacaaaaaataaaaaaatagccgatgtggtggtacgtgcctgtagttccagctaattggaggctgaagtgggaggatcgcttgagcccaggatgtcaaggctgcagtgtcagggaggaaaaacgttttgtctgcactcaggttcattgattagaggtctgtgaattaaactgacaaaggacagaataacaggagaaaaggcacacaacttttatgaatatttacctgcatgagagttcacagaaaagaactgaaactcaaagaagtcattagacatggggacttacacaacattttaacaaaggaaagagggtttgggcatcaagggtgacaaattgtggggaagtggctaggaaatatatgggggaacgaatggacgatagaggttattttagtaaggtctgtttatgcaaaatcatcttggtattcacaaagggaaatttatgccctgttttttgcagctaagaggaaagcagagaactcatcctgcaactgttgattcccagttgcattccactcaaaatagttcttctgccaaagtggcttattttggagtggcatattttgatcctctcaggcactactgccttaacttgtgttgaagcaatgacacgttcactcgccattgctctcaagcagtcagtcaaatgataacacatcatttgaatgaaaagggcatagaatgtctgagtattactataaacatagttttgaccttgcagatctctaagtatcttggggacctccagggtccataggccatactttgacaacactgctgttccgtattgtattacttgtttacttactttaaccaacaaataaataattttttcagacaggatcttgctctgttacccagactggtgtgcactggcataatcataactcactgcagccttgacctcccgggctccattgatcctcctgcctcagcctcctgagtagctggggctactggtgcatgccaccatgcccagctaatttttgtattttttgtagagttggggtttcaccatgttgcccaggctgatcagaaattcctgggctcaagtaatcctcccacctggcctcccaaagtgttcagattacaggtgtgagccaccacacccaaataaacaattttaaagcacctcttccatggctctctactgctgagtgtaaagtacagatgccttggcctaagatccaaagccttaagtgactggcctttgcctctttgccactggcatgtcctcgctctttatccaaacacaggtcaagccacagaagttactgggattcccagaacgtatttgcatgcgtttctgtccctgcgtccatctccattttctcccaagcattctttaagcccaagtaccacagtcaatctctctgactcctccaagaaaaggccattgcagccatgattagtgaagggctgcagatacacaagtaaggtgggatgcactgcaactcacctagcatcctcccagggcttactctgccataggatctctggtgccagacctaaaaatgtgtgcggaaggaatggaggcaggtgctggggagaggggaggcctgccaggaattctagaatgcaccaaaaaaggccacttccttctgttgccaaggtcctgggtctctatgctttagggcaagggtgtctggggatggtccttgtgaggggcaactggggaccctagtggggcaggcctagggctgccagataaaatatagaaagcttagttaaaattagatttaagataacaaatactcttttagtataagtatatcccaaatactgcatagaacctcctcatcctaaaaaaaaattcaatgtttatctgaaattcaaatgtaatggagtcctgtattgttgtttggtaaatctggcaatcccgtgtaggcctttgctattcagctcgctgagcaaagtggcccctcttcacttaccttgccacctaccagacctgcccagacctggtcctggctgcctccaggcagcacagcccactgaaaggaaccctttccgtcccaaagctgcccagagcctgagaacagaagcaaactgcgcgcttggatggatatggcggattaggctatgcctttggagaactaactcctctcggagaagggggctctctctcacagccaggaccttctggggtgcctatgcggagacgccctccttccttgacccacttcttctccccactccccgctgatgcccagccctctctctaaccttcctgagttgctgtctctgcaactccccctgccaggactggctatcaatcccttcagaaactaaagcccagtccagcccctgggaggcctcctgggtgtctgggattcccctggtgggatgcgtctggcctgaggttggagacaatgatgcgttcttcctcccagccagtggcttctctaccagccagactgctttgccttttctccttttaaggacctgagggcaaactctccttccctctgggaggacttctttcttccaaaggtcccagaggggggtgtgtcctttagcttgaggccctcgctttcctccattctcatgaccttgcccccttccctgtggagggtcttgttatgctgaaggcacctttccctccttccggactggcgttcctagcatccccacggaaaccgaaaatgcctcctgcagaaccatctggccacatggctccaatctgccctctctcccacccccggtttcccctcctggaagggggacacagggaaggaggcttaggcaaggcatccctggcgtgcctcagtccctgaggcataataatataatgattgttgctgtttcatgccactaagccttggggtgttttgttacataactgtaactggaatgtatttgatcacaggctccatcctgcaccaggagcagcctcgggttcgcgtgtgtgggagctgcagaatgcctgtacaaacttctataccctccccatgtccctttgcacaaacagcccccattggccatcctttgggcctagaagttcatatcctgctgcctgttcatgtcctgggaagcaacgtgggttggaggccagctgagctctggaaagtgggcttggggtctagaagaaggtcgtgggctccacatgggttcaagccttagtcccaatgggccgaggagcagaagaggaccacagtgaggttctctaaagcatatggcttagacaagggccccatgccacagctaagggcagtactagctgagcacttcatatctttcatctcttgtttgtttgcttgagaaagaggatctccttctgttgcccatgctggagtgcagtgactattcacaggcgcaatcacagctcacggcagacccaaactcctgacctcaggtgatcctcccacctcagcctcccaagtagctgggactacagacataagctactgcacccagcactatccgtcatcgcttgatcctcacccagtcctgttccattgggcttatcgtcttcattgccccagtgagagcaccaaggctcatagaaaagccagtcgcttgcccagggtcctgggacatatgtctgaagccaaggccaggagctctccattataccatatggcctcaaaggccctccttggttcaaagacacttgatggagcattttgtagaaacatcatctccttggctttgtttaaaatcaacatcaccacccacagccccccaccacacacacacaaaaaatatatctgtgcacagtggctcacgcctgtaatcctagcactttgggaggccgaggcaggcggattgcctgagctcagtagttcaagaccagcctggacaacacagcaaaaccccatctctactaaaaatagaaaaatattagccaggtgtggtggtgcatgcctgtagtcctagcttcttgggaggctgattcaggagaattgcttgaatctgggaggcagaggttgcagtgagctgagatcacatcactgcacttcagcctgggtaacagagcgagactctctccaaataataataataataataataataataaaataaacttcaaaactaaaacaactttaggctaactgggaaaactgaaataggaagacctcgccttgaccctagggaatgaagccaaaactcagagggctggaggtatccagctgcctagctgctgtccagctaggagcacagtttctttggaggtccccaaaccatgctggtggagcctcatctatctctttagctccccatcaaagggatcactttatcagctgcacagtctttaagcccaacgtccacagcaggactctcttttaaaacagtttggccttgagagaggcagtccgcttgttatctatgttttgttttgtgttggcttcctggcgagttatcagggagactttggtttctttgtcttctgttatctccctgctgggtttcaaagctgccctctgagctgctgtcagcctgagctgtgtcttcccctgcagggacagagagccggaggtggaaggggccacaactctaccagagccttcccttccagctgttgtctcctgggcgcccacccccagtgcctggaacttgccagctctcatcaaggctggctaggtgtcacttgtggcttctccaggggcatataacatcaagagagtgggcctcatagggccaagatcaggggaaaggaggggggtttgaaacaccctttacaaaaattataactaaggaaattatgacagtgaaagagatcagacctaactgactccatcttgcttctaacctttaagttgtcctggttcattcctggacatagacagaactaactttgggaaggaattcagtttatggtttgactcggaaacaaaattgataatagacctttcctgaaaagacccccttcttgcctaggacccgcctttgcacaactaacaaattagctacaagatgagaagctgtggtttaggggtcatgcagcctctggctccaagagtctgaacctccccaaattgctcctgtggataatatcactattgtaaaacctagatcagcgcttgagatattttgcagaccctgcactggatggatcaactgataccacccagactggtaatctggctcaaccagttctgccatcctacccaggaacagaagacagcaagaaaacatcacttaaatcccctattcaatccatctccaacctaaccaatcagcactccccgcctcccaagctcttacccaccaaattatcttttaagactctgatccccatatgcttgggaagactgatctgaataataataaaactctggtttcacccacagctggctctgtgtgaattactctttctccattgcagttcccctgtcttgataaatcggctctatctaggcagtgggcaaggtgaacccattgggcagttacatgttcacagagcagccactttctttaaaattgaggggctgagagtggtggctcatgcctgtaatcccagcatcttgggaggccgaggcaggtggattacctgagggcaggagtttgagaccagcctggccaacatggtgaaaccccgtcgctactaaaaatgcaaaaaaattatctgggcatggtggcagtgcttgtaatcccagccactccagaggctgaggcaggagaatcacttgaacccgagaggtggaggttgcagtgagctgaggtcacgccattgcactccagcctgggcaacaagagcgaaactctgtcttgaaaaataaataaataaaataaacttggggaaaccaacatagacttgtcactttacctttatatgtttgtttgccaactacaatacaaaaagcaacttatggccgggcacggtggctcacgcctgtaatcccagcactttgggaggctgaggcgggtggatcataaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagcaacttatattgcttaaaaagaaagaggatgttttaactcccagtgaataggaagaagccctttgaccctgaagtcctgtgaagggaaacaggcttagaaaagttggccctcctcaggagattgccaagtagtttaaggtttgggggaaattaaactcttcccagtttgggggatgcatctgaggggagtatcctggggcatagtgatgcaattacccgtcagtgaaaagaagacaaaggaggaaaaaaggaaacagctctttttttctttctccagagtctgaggctcaaaggaattccagtgatttaggatgcactcgtgaggagtgcaggcggaaaatgattggttacccatctggaaaggggaaaaacatgtccctttgttcctttctctttccagtgaatacccagggtacataaggaagataaaaaaaggcatccctttctttcttctgatcttatatccccaagttgcagaaactttgcaggtgccacccatgggtgcaagtgtgaccttcacccatgtagcagggaggcctaatgggtagggatattcgcacttacctatgtgccaccctatcctcctgctgttggtaacctttgggttccctataccttctctatgccatggatgtgagcatgacttccatccatgaagcaggagggcctagttggcaggaattagtcatgctcacctgcgctgtgcctccttcctgaggtcaagcttctccgccctgcagaacataatttggccacagctttgtgcaaaggaatatgagatgtcttttctgtgtctcatggtgcttggcactacattggcaaccaaggaaatgacagggacatttttgccatgaatttacttgcagataccaaggcacactttacctcatctgtgctactcttaaccttccagtttatacttttgatgattaagccaaatgctcattctacccagtaatatctgtggtttgcaacaacatccttaacatttaacactgtatataaagaagagataggaaccatgagagccatgaaagaaagaaagaaaagaacaataggaaagactggaggtcctagggccgacacccttatgggcagttggggcctggagttagtcaaggagcctttggataacaccaagatgtggccttggtgagataccctcagttgccccaggacctccttctggtcccatgcgatggctagacctccatgaagggaaactagattggaacaaagccaacattcccaacacccgaaggtgatgggggattgacattgtcctccccagcaagcctgtcctccatttcttaagtctggcagctgtgctagttgcttttaattggctgacagaggcctggtattttttctttcattttggctactgtggagtctgaaaaaaggacagaatgagcagatccagccaggcacagcagctcatgcctgtaatcccagcactttgggaggtcaaggcaggcaaatcacttgaggtctgaagttcgagaccagcctggccaacatggtgaaaccccacctctactaaaaatacaaaaattattctaggtgttatggcacatgcctgtaattccagctacttgggaggctgaggcaggacaatcacttgaacctggaagatggaggctgcagtgagccaagatcacaccactgcactccagcttgggtgacagagtgagactccatctcaaaaaaaaaaagaaaaaagtaagaaagaaaagatccacttttattcacccttccacagatcctggatgagcccccaaaatgttacaggatccttggggtgtcactttgccagctggaaacctctgtggccagtggcacctttgcccgagtttttctctggcctgctgggctcattctgcccactcacactggcaggctgctcttggctcacgctaccggcctggatcccacacctgccaggggtgagccaggcgtagtgtagtgaggggtatgtgagcgagcatgggctccaaccactgtgcacagccaggcactctggctgcagcagggtgagcagctccaggtgctggcatgggcaatggcttcctgcaaggctgcagctggaccaggcataccataagtagctaccacagttgatgctggggaatgttatggtgcccagaagcttggagatgccaggaaccacagagccctaaagggtgtcacggccctggtttggggagctcctaggtctaggctccctgaagggctgtagctcttctctccttctctcttctctccttcttgtcatgtacaacatggtgagcaaggggcatgtttcagccctgtttgtgttgtagctcttttagccctgtcatttggcaggtcccaagttcttgtcctgcatccaggaagaatgaggtatgcagacaagcgaagggtgagcaagatgaagagaagctttattgagtgacagaacagcttagaggagacctgaaataggtagctcctttctgtagccagggtgtcccaatgagtgttcagctctcaggagagacggtagctcctctctgcagctggtcatcatgttgtctcttcagctctcagcagagagggtagctcctctctgcagctggttgtcccatcatcttctcaagtctggctgagtccagggcttttatgggcctcagaggggaggaagcgcatgtcagttggtccatgggaaaccatgtgcagccccagaaaaagcatcacaagttcccactctggtttgtgggaccagcagtgtagtccccagctacaggccctcgccagcttcaaggtgaggcttcactggggaacttttcctttctgcccaggagcctgtctcctgcctctgttcatgatgtccaggctgttcataccaaagggcacctggaggccagtgccaagctgccctcagcacccccttggcctccctctggtgcttgctggtgcccaaagtcaggagggggctaaggtggcagggggctggcgtgttaacactgccctgagtgtacacacacatggctgggttgcgacagtgcccaggcttggccccaaccttgctctgagatcggagcagttgccaggagttgacagagatcaggcagtgagataagacacctcagagcctgcagggggaagggggtggccttcctagggctccaaaagtgcagagaggcctgggtccacagctgcagctgagtggctgcagctgctccttgggagggtggggcttctacctgctcccagcccccaaaagcacagggaggcctgggtccacagctgtgacttgggtggccacagccacgcccaggaatgccaggcccctgtctgctcctggctctcactggctccttggagtgtggcactggcctgggcccagctccatatcagggcccctttctgcccacccctccatgctcaattacactgctcccccgtcagtgggtgactcagcccagcctcatcacagtggctcccagggcagtggactctagggggctcccagggacaggctccagggagtgcctgcctgcctcctgtctgcattttccctgcagcagtcatgggcaaggtgcaggtggtgctgtagccccagtcaaccccacacaaacaaaccaaatgctcttggggctggccccaagagtccccaactgtgcccttggccaggcgtgcaagattgtgaccacggtggagactctgggtctgggagcaggttctgcccagccatgagaggatgggggtggtgcagctgactgcctcagggatgcagggcacaggggacatggggcacaggagtcccactactgccactgctgctcccacagctgctcctgccaccaccgcccatgcctccctactgcagccagtgtgatggcagcagccactttagacggccccctgctgccatcaaaagcagaggccaggcaccgtggctcatgcctgtaatcccagcactttgggaggctgaggcaggcaaatcatgaggtcagcagttcaagaccagcatggccaacatggtgaaaccccatctctactaaaaatacaaaaaattagctgggtgtagtggcaggagcctgtaattccagctattcgggaggctgaggcaggagaatcgcttgaaccctggaggcggaggttgcagtgagctgagatcgtgccactacactccaggccaggcaacagagccagactccatctcaaaaaaaaaaaaaaaaaaaaaagcacagcagaattttttaagaacattgttctgttctaaaaaaaattgtaaagggttataaaaggtttataagaatcttaccttggctgggcacggtggctcacgcctgcaatcccatcactttgggaggccgaggtgggtggatcacgaggtcaggaaatcgagtccatcctggcgaacatggtgaaaccccgtctctactaaaaaatacaaaataaattagccaggcatggtaacgggtgcctgtagtcccagctactcgggaggctgaggcaggagaatggtgtgaacctgggaggcagagcttgcagtgagccaagatcacgccactgcactccagcctgggtgacagagtgagactctgtctcaaaaaaaaaaaaaaaaaaaaaagaatcttaccttatggtcaagctaattaaaactggatacacttatagaattttattaaaaactagctttagcattaaagatgcactaatgcatacatgaaatttagtttttttttttgtttgaaaaagatttttatgtaacattaagagacaatgaaagatttttgtttgtcttttaagtgaactacaaaaagcactggtgggaggggagagagaagagacagagtcagttggcctcatgtcttcattgggtattgtttataaagctgaatctcctctctatcagaataaagatttttccttaaaaaaaccaaaaaaacaaaaaagaaactttttttgagatgaagtcttgctctgtcacccaggctggagtgcagtggcacaatcttggctcactacaacctctgcctcctgggttcaagagattcccctgccttagcctccctagtatctgggattacaggcccatgccaccatgcccagctaatttttgtattagtagagacagggttttggcatgttggccaggctggtcttgaattcctgatctcaagagatctacccaccttggccttccaaagtgctgggattacagggtgagccacagtacccaggctaaaaaatttttgagttattattttggttaaatgaatgacttatggtaacctaggattctattttgtaatatccaatgttttaagcctttgatatttaacaaacctttcaaaatcaagctctaagttaaaaagagaaaaaaattaggtgccctgaagtccaaaaagacatattcagcttatttaatgtattaataccatgcaggaaacattgtcaaatataaaatggtgtttaactttctttgggttatatttatataaatttgtttttagtatgtgttgcaaaattgtatagggttcctgtaattctgatatgctacagtatatgttattaataattataattgttgtgttgaattattgtgtgccacagaggtaacaaatttccttgtcaactgtgtctttgactgtggcttccctaaatgcttttgtcatccacagtcaattgctgtctttccttggtcctctttagaaagtggttttataatcagctattaaatgttgacaggtgctcttgaatgaaagtttctgataactatggagattattattattattattattattatttgagacggagttttgctctttttgccctggctggagtgcagtggcgcgattttggctcactgcaacctccgcctcctgagttcaagggattctcctgccttaacctcctgagtagcttgagattacaggcgcccaccaccatgtctggctaattttttgtatttttagtagaaatggggtttcaacatgttggccaggctggtctcgaactcctgacctcaggtgatccatccgccttggcctcctaaagtgcagggattacaggcattacccactgtgcccagtcactatagagattattacattacaataaagaaaaaaactttcaggactctcatggagagctgaaatgttcatgaatatcaagcagaacaggagttaactgaatagactcaaccaatagaaaattaaagcaattttttttttttttgcttaaaagattgctgatcctttttgtttctcagagttaagaaaacttttcttttgagctattttcagcttttaacaattgagtaaagtatattcctgtgaacaaaatttgaagcatatttgtttctctttacccgatttctccagattttggaaactatttgtgagtattcttaacttaatggcaatatagttatttgcataagtacaataagaatgttttcttttgcaacaggacacagttggagaaactggttattttaccaaaactttgactggaatgacgtgctttcctttaaggaattaaacttgacttatagagccaataaaatccccttgggaaaactggcctcataccttgtctacacagtccctgtacagggttcctgatttgtgataagtaaagaatgtcactttctgagagtcccaggagccccgagttatcttgggacctcaagaggagaggaatttacccaactcataggcatttgagggtacaaacccatggctggtctcagctttaaaaaagtcttatctgagattcttttggaacacagttccttcaaagccaattttttaaaatttatttttatttattaattattttgaggtggagttttgcgcttgtcacccaggctggagtgcaatggcacaatctcaggtcactgcaacctctacctcccaggttcaaacgattctcctgctttagcctcctgagtagctgggattccaggttcctgccaccacgcctgcaaagccaattttaaaagcctatgtgaggccaggcacagtggctcatgcctgtaatcctaatcccagcactttgggaggccgaggtgggtggatcacgaggtcaggagtttgagaccagcctggccaacatggtgaaaccccgtctctattaaaaatacaaaaaaattagctgggcatggtggtgggcacctgtaatcccagctacttgggaggcctaggcaaggagaatcacttgaacctgggaggcagaggttgcagtgagccgagaccgcaccattgcactccagcctgggagacagtgtgagactctgtctcaaaaaaaaaaaaaaaaaaagcctgatgtgaaaaataattattcttgctgtgccttatgcaaataatcagaccaagtataatacaactaaagtttattttccaaacaaatcagtcctattataatttgtttttaataaaaataaggactgcagagagaaaaattatgttccaaaaactacagtatacttattgttagttgtttttgagtttttatttgtatttttcttcaatttagactaaatcctgaatgttttttggactacaagtccccaaactaatgctttcaaatctttacttctaaaacggggaattgcactccttatcctagaactcattatttgccttatagtacactgtcaatttaaatgctgtactgaaactatagatgatgaagccaccatggcaaaattataactgagacagtgaaagagatctgagctaaccaagtccatcttgcttctaacctccaagctgtccttattcattcatgggcgtaggctgaactgactttgggaagaatttggtttatagtttatagtttaaaacaaagatgatgacagacttttccaaagggaaatccctttcttgcctggggaccagactgcctttgtaggactaacaaattagccacaagattagaaattatggtttaggagtcatgctgctggaggctataagattctgaccctccctaaactgctcctaagatcggtgcttgagatattttacagacctaggacttgatgatcagctggcaccacccacatccataaactggctcatctgatcttgtggtccccacccaggaactgactcagtgcaacaactgtctctgacctgaccaatcagcaccccagtgctggctcattggcttctccccacccaccaagttgtccttaaaaactctgatcctggaatgctctgggagactgatttaagtaataaaacttcagtctcctacacagctcactctgtgtgaattactctttctctattgcaattcccctgttttgacaaatcagctctgtctaggcagtgggcaaggtgaacccattgagaggttacaatgagaatagtaacacctttgtcatgaaagccccagaaccccagctcagtatgctgagtatgtgggagtatgctcagacagctcagacagctgcaaagcagttccattcctctcaccttggggtcaacacctacccgttccatgccccctgtcagcaggaagaatccagagcgattgacaaccttttcccatcttcatagcccacaccttaagaataagatactatgaaaccaaaagggggggattgaaactgcctttgcaaaaattataactgaggaaattatgacagcaaaagagatcagacctaactgactctatcttgcttctaacctttaagctgtcctggttcattcctgagtataggctgaactaactttgggaaggaattcagttcatggcttgactctgaaacaaaattggtaacagccctttcccgaaaagacccccttcttgcctggggaccagtctgcctttgcaggactaacaattagctacaagattagaaattatggtttaaagatgggtgcagtggctcacttctgtaatcccagcactttgggaggctgaggcaggtggatcacttgaggtcaggagttcaagaccagcctggccaacatggtgaaaccccatctctactaaaagtacaaaaatcagctgggtgtagtggtacacatcaatagtcccagctaccctggaggctgaggcaggagaatcacttgaacccaggaggtggaggttgaagtgagctgagattgtgtcattgcactccagcctgggtgacagagggaggctctgtctcaaaaaaaaaaaaaaaaaaagattgtgttctctactcccagccccaccctctcccaaaaaaggacagctggcaacctcgcatgattcccaaagcctgggctacactggccactgggcagatattaagacccagatctgaggaaaggaggttcttggaatctcacagggctgcctggtcctcacacgcatcaggctgtttgctcaccgtgcttcccgtggcacactcacactcacactcatcattcacactcaggtcaggcatctcctccttccagcagggctggcttcatgggatgagagctgtgaggtcacacagagccctgtgctcagtagggccctgtgcttagtttaatcctctgctgctgacatcttgaaatctgaataagaagccttgcactttcgttttacactgggccatacaaataatgtaacatacttccataacatctttttcttttttaaagaattttattaaccatactattccttgcaaagcagggtgaattcataggcagtgtgcccagagttggcccataatatctttctgatgtcacctctcaatctaagttgaatctggtgcctctcctgggctcacacagcccccctgctcactcccctccctaacagccctgatccctctaaactgtaagcctttactcacttatctctctaccctctagactgagctccttgagggctggggcagtctatctgtacaacaccatacttaacacacagtaagtactcattaaatgtgtgctgaaatgaacagaaataggaaggcctggtccagttccctacatgattctggccagagcagggtttaaacccatgtctcttactttagggcaaagacaacccttgctaccctctcactctcctgatcgatagccaaaggctaaaatcaacccagatcaaagccaaatataaatttgtttttctgacctagggcccaaattaatgcattttgtttttctcaaaggtactctgttgttttctagaacagttcaagccaactaatccaaaaatcttaacactcaagggggagtgggggccctgctgggtcacagggggttcaaactggttccagaggaactggtgagctgtgggcagtccacattcttatgtgtgtgggggggcagaggttggggggttcagtggggaatgctgaggctggattttacaggggtcagaaaaggaagggaggatatggcttatactagttctgccaaatctaccatgtaacctccttacagccattcattcattcattcactcactcattcatccattcaaacaggggatgaggagggtgtgccaagcaccagaaaggaagggcacaggtctgctttctagagctgcagtctccatgaaagagtttttgaaggatggaatgaccaggcctgggcaaactgacttctggacaattctggagtgtgggtacagatgatcagtgcttggctggtcagaaaagggaaagccaggaatgtgggggaggtgaaaacaaaatgtttctattctctaaattcacaaaagggcagggaagggagcggccaggctcagtggctcaagtctgtagtcccagccttttgggaggtggccaaggttggaggattgcttgaggacaggagttcaagaccagcctgggcaacatagcaagaccctgtctctaccaaaaatacataaattagcagggtgtggtggcacatgcctgcagtcccagctactatactcaggaggccgagttgggaggactgcttgagcccaggagtttgaggctgcagtgagccatgatcgtgccactgcactccagcctgggtgacagagccagactctgtcttttaaaagcaagtaaaaaggcggggggtgggggactgttttgagaactagtctgaagccaggaacaagtcacacagacttattttcaacctggtccaatcagtcattgatcacgttacttcagtcccctgagagccaaccaatcagcaacagcttcattccagggaccatgcttctgagagccagccaatcagcaagggtcttactccagtgatttgcttctgaaagtcagccaatccctaactgccaagactgaaagtcagccaatctgcacacagtccaacttttgaaaatcagcgaattgctgaatgccatgctttccataccctatataatatcagctctagggttgctttggatctggggtttttgtaagtaaagttagatttttttttttcggtactgcaagtactgaattcagcctcattgtctctgaaatatatcctggagaaggaggacttgaactcttacatgtcccagtggcccatacgggggtctgtggtactgccccctccccccacacacccccatcccaaggctgggcaggtccctgggccccctggccacagccacttcactagcagtttcagggcctcctggccacttctctaaaatcccatcctgttctttctcctgtggtttcctgagaagtagggagggaggctgtggttaaagagactgggtggagggggtttctccacaaagccttccatggggcccacaggcaagggggaggggctcagtctaaggggggtacactgaggggaagacacagcctgctctccaagtggcagtctgagagggacactgatggatggggggcacattccagggcatcacgtctgactgggtaacgtagtctgatgggagaggcaggatgcctaagtgtgcccaggaaaacaactctggtgatccaaggccgcagagggtcaggtctatcttctggggcatgtactaagtactgaggtgggttggggacgaggatgcagagagtaagtcagagaaggcttcgtggtggaagtgaagcttagggccagagcgcctcccccagccatgctgctgggtcagggcatggaagaggacaacagggctcacccctctttcttctcccaatcctctcccgcagtgtcccacaggccaagcctctgatgaggtaaacccaaggctggagatcctttcagaagagagctcctgtgggctttggaagaggggacccgggttggcctggaagaagggtgggatgggccactgagagtggctggagcaataaacagaatgaggttgctgtgaaggttccggatcctttgccggctctgccccgtcccaccccttcccaaacaccgtctccacccctcccctccccggcagaacccagtcttctctgtgcagtgggtacagtacccacccatgccccctcccatgcccagcagtctggctggggtgctctgtccttggcctctccacccccaccgtcatccccatgcaaacctcaaagaggctgacttggcgtagcatttgcctgcacttacctgtggctcttctgtttggagccagccagaaactcctgagtttggttccaaggtgctctacccctcctgcctgcgggaggactaggttcctcaatccttctcctgaggtcaggctgggactagagtgaggcaagcaaggtgcctagggcaaaattttaaggaggcttgccctcccaggtgcacctgaatggccctgagggccagtgcccccttaaattgtgggcccttaggtgcctccttgctttacccaccatgcccccagccagccctgaccctgctgggtgttctggcctcgagagtctgaaatcttataaaatatgccctaaaagctggtagtccggagtccttgggctggcctgggcagccaggtgcctgtcctccccatctcctgcccttagcccttttgggagaggaagccagaagtgctgaagcctggggcggctgggactgcgagatcggtataaggatgggggacctccaccctcaaggaactgaaaaccatgtggaaggaacagaatggtctgcccgcaggggaaaccaagcaaaccaggcctttgattgggaccaaagacagatgtgaaacccaggactctgagctgaccttgactccaccgagctctgccctggggatcaccgggcacctccaagagagatctgaatggctctgggagatgccaggctgaaacaggggacttaggtcccaggtctctgatggaaattagctgtggaaggggacaggtgtgagcaccaggaaagataaggcagtaagggaccctgcctgtgtgtgtcaggagcagggatctgagaggggtctcccacatctccatgcccaggcctcagtacttgggggggtccctggggcaaccctccccctatctcggccactggggctggggcctgtgccctgggtcctctctgcaggtagcatggtcatgccagagcccttgggcatcctttcaaaacttaccttgagccaggagcctccctgttgagatctttgtctaattgggtcttggggtgtcccttggagaggtaccataagccgagatagccgctctctaaggggcgaggggagttagggttgggcgtgtgtcaggtgagacacatggaataacaggagcctttcattactcacagatccatgagagaagccagcgccgatgagggccaacaggaatcccggagacagcagggtgttcaagtagcaggtagagagtgagagagagaggggacctgtgggaccaaggcctttatggggtccagggcgtcacccaggcaggtttcctgaggggagtaataattgggtttaggccaggtgccggtggctcacgcctgtactttgggaggccgaggcgggtggatcacgaggtcaagagattgagaccatcctggaaaacattgtgaaaccccgtctctactaaaaatacaaaaattagctgggcgtggtggtgcgcacctgtagtcccagctactcaggaggctgaggcaggagaatggcttgaacccgggaggcggagcttgcagtgagccaggattgcgccactgcactccagcctgggtgacagagcgagactccatctcaaaaataaataaataaaataaaataaaataaaataaaataaaataaaataattggtgagtttagagcaagcagggtcacgctatggctgagagagggtcactggcctatctgcaacagtccatgcgggctgtggggtcagcgggaccagtcaagtgggctgtatgtagctgtcccacagggaggcagtcaccgggagatgactgtctaaggtagatatctggattgagcacatagaggaactgggaggaagcagggagctggaaacagtgtcaaggttgactgagccctgcttctaatgtaagaaagtccagattatattcaaaacggatgccagggcaacattaaagtacaggaattcactacactccctctgtgcctgggtcactgtttatggtcctcaggagggggggccctgctcattggcctcttctggtactcgggtggggttggggtggtctgtagccccatgagggcaggatgggggcaaaccaagtgtagggcgagcatccccctatgtcttgggaggtactgagctagagctacaatgtgtggatggggggtgctccccaattagtctaggctgcgccttctgcattccattctctgcatgtctggaaggcctgagctcatgggacagaccccaccctggcacctggtgggcggggcattgctttcaagaggtcacctttgtttgggaaaggaaaaaacaaagacgacatagctggctggcgattctgagtctcacctcccagggtgtggagtgagcccaaactccttgcctcccacatctcccctgccacctttcccagggccgggaaacccccaggaggatcgagactcagcttccacccaacccctagaagacctctaatggtcaggcctccagccttggcttgcatccctccagtgatgggtagctcactgccccccagagagtattaggtcattaaaacaaaaacaaaaacaaaaacagattttggaggtggaactgagaggcagtggcctggggaagctggaaggactggatcatgagccagaattgctagggcagacaccacaccactgaccccacacctggaacagtgtctggggctatgtcagctaatggggtaaggttccagggaggcagattccagctcaataagaagggccaggccgggtgcggtggctcacacctgtaatcccagcactttgggaggccaaggcgggagaatcacgaggtcaggagatcaagaccatcctggctaacatggtgaaaccccgtctctactaaaaaaaaaaaaatacaaaaaaaattagctgggcatagtggtgggcgcctgtagtcccagctactcaggagtctgaggcaggagaatggcgtgaacccaggaggcagagcttgcagtgagccgagatggcgccactgcactccagcctgggcaacagagcgagactccgtctcaaaaaacaaaaaacaaaaaaacaaaaacaagaagggccagccatggtggctcacccctgtaatcccagcactttgggaggccaaggcggctggatcacttgagcccaggagtttgagaccagcctggacaacatggtgaaaacccatctctacaaaaaatacaaaaattagctgggtatggtggcgcacacctgtagtcccagctgcttgggaggctgaggtacgagaagtgcttgaacccaggaggtggaggttgcagtaagctgagattacaccactgcactgcagcctgagtgacagagcaagatcctgtctcaaaaaataaaaaatgaaaagaagaaggactacagacttcctctcagcagagccaggggccagtgataaggtgttttgggggagctaatgagttctttgtcactggaggagtgcaagtagagagtagcccatcatcaggactgccagggcttccggaaggtccccagctaaagggataggaccctacctactctggaaggatgaccaggaaatgtatcctgtccccaaatcccagctggcctgtctgagatggctggggggtgggggatggggaagtggagcctgggggtcacctgcgcgtcccactttcaggaatacccgcctctgggcatcagtagtttgcccttagcttcttcctccagccacatttccatctcggctggtcccctgactcaaccccttctcacagccaggtgaaggcaggactggggtcagatgccaactgtgcctagcattggattaggacacccctgtctccctcagactcttcagggctggacgctgcctacctctagtgccttttggacccaggtgggtgaggcggcccttctgagggccgcggcttgctgctggggtaaagtggctgatgtctgacaatagaccttcccctctcgcctgaccctcccagggagagtggcttcccagccaggctcaggcagggccaggctgcttcacaggcagtgggggtgcgctcacagggaagtggggtttggcgacactgcccaggggaggtgtttggggccagaagtggatctctgagccctaggaccctacaggtctgcccactctgggtgtggggcagcaatatgcaagtcccccctgcagtgccccagccagtcctcgggcgtcccttctccctctccctcctgcctgatggcccagggaagccaggtctggacagtccccaaggagacacctgccttaaactcccccccaggagatgtgccttccttctctcagcctcagtttccccatttgaaccatctttatgagcctgtctcatgtgaactgaggtctgggaggttatcctgccagggctgggagtagggttggaggtggggaggtcttggaggccacagaaagaaggaggccgtctcagccctgggaactgacatcatgcgtgtggccgtcagccactggcccaagggtgacagattctatcctaatagaatagaataaagcctatctatctgccttttattctcaccatgtgctggtaattctgaacaatgtcagtgatacaatacttctttctgaaaaagtattttattggtcaaagttctaaacgattgcatgattactgtggaatgttaataatttataaaatgagcttcaaagtaacacctttattctttattagcagcttatttttaaataaacattgtatgctatgtgaaagtcaaatcagagaatgatttccctgttatacagattgcagacttagctgcaatcctgtatttgtatttcatttgtaattcctaaccagttcctccttcctcccttctttgctatagttgctattttccaagccctgtggtacatgtccccatgtttaatcagttgattataaataaacagtggtagaacactgattgtaaagacaaagacacagaacatgagttccttcaattctgccactctatatgacagcttggaggttttatctgtgtttggaattgaaaacaaatagcggaaaccaggagatgtcatgtttttgtttttgtttttgagatagagtctcgctctgttgcccaggctggagtgcagtggtgcgatctcggctcactgcaacctccgcctcccaggttcaagtgattctcctgcctcagccacccaagtagctgggattacaggtgtgcgccactacacctagttaatttttgtatttttggtagagatggtgtttcaccatgttggccaggctggtcttgaactcctgacctctagtgatccactcgcctcagcctcccaaaattctgggattacaagcgtgagccaccgcccctggccatgtttttatttaataaatgcaaattttagttcattattgtcttagtctgttccttctgctataagaaaattacctggctgggtgtggtgcctcacgcctgtaatctcagtactttgggaggccaaggtggagaatcccttgaacccaggaagttgaggctgcagcgagccatgatcacaccactgcactccagcctgggcaacagagggagatcctgtctaaaaagagggggaaaaattatcttagagtagattatttatttatttatttttgagacagagttttgctcttgttgcccaggctggagtgcaatggcccaatcttagctcactgcaacctctgcctcctgggttcaaatgattctcctgcctcagtctcccaagtagctgggattacgggcaccctccaccatgcctggctaattttttgtatttttagtagagaggggtttcaccatgttggccaggttggtctcgaactcctgacctcaggtgatccacctgcctcggcctcccaaaatgctgggattataggcatgagccactgctcccggcctagagtagataatttataaacaacaaaaatgtattgctcacagatctggaggctgggaagtccaagatcaaggcaccagaagattcagtgtctggtgaagcctgctctctgcttccaagatggtgccttctcattgcatcctcacacagcagaagacacgaatgctgtgtcctctcatggtggaaagccaaaagggacaaacaggctccctcaagcccttttataagggtactaatcccattcatgagagcagaccctcacaacctcatcacttcccaaagcccccacctcctaacaccattaccctgggggttaggtttcaacatatgaattttgggaggacaccaatattcagatcatagcaattatgaaatatatttgtttcatttcatgatacttactgtataatcatgtagagggaagggttaaagaatgttccactgtgagagtcaaatgtgctatgtgtatgctgctggcttgtacagctctgcaaaaggggacccagccagttccatgcctggggagaccttgactccatgaggagggctggggaagtggtcagcctctctggtcagaggaatggcctgggccggacctccaatcctgggcttcccagcccaaccataacaactctccatctcagctcaattcatctatgaatgaggttctccagggatagcctacagccgccttattgcactgggtggaggggcagagggacgcaatagctttaggttagccctgagcaaatgctgataaggagcagaagttccaagggcaccaacttgggccaggcagggcagactggacagtggctagaaaactggcagatgccctccagccttactctgccatcctctatcctaccctgccctctcccctgtcatgatagaagggatacaaaatatacctctgtggcataaggattattttgagtgggtgacatttgagaatcaacagatgcaggaagaaactttttttttcttttcctgaactccctttatctgcctaaaagctgagcctcccaaaagaattcaaatgtcataaatcccctccccagagtttgagagtttcccagtcagggaagatgggctccttttatgagactagaagagaaatcacaccaagataagagatcaactaaaccaacattgtcacaaaactatcatatctcccatcttttctcctaagggtccatttacctttcctaaaaggcgcttgtcttcccaaaagtgtcttttctcttttttccttcccctattaagatgttacgtcagcctcaaattctaaatcactttttgagtcacattttcagtgagttccttcttttctatgtgaataaattttgtctttcagattagaaattattagaataaaaaaattagaataaaaattattctaattattctaataattatataataattattctaattattctaattattctaattattctaataattattattctaataatgttgtctttgtgcctattactagtttatcagtttaatttgcaggctctgaagcactgaactgaacctatgtgggtagaggaaaagtttttcctcccaacatgattatttactcacttacttatcttcttttttttttttttttgagacagagtctcactcggtcacccaggctggagtgcagtggcgcaatctcaggctcattgcaaccccgcctcttgagttcatgtaattctcctgcctcagcctcctgagtagctgggattacaggcgcctgccactccacccagctaatttttgtatttttagtataaacagggtttccccatgttggccaggctggtcttgaactcctgacttcaggtgatccacccaccttggcctctgaaagtgctgggattataggggtgagccagcgtgcccagcctcccaacatgattagaataaaaataatcctggccccagccacggtggctcacccctgtaatcccaggacactgggaggccgaggcaggtggatcacaaggtcaggagatcgagactgtcttggctaacatggtgaaaccctgtctctactaaaaaaatgcaaaaaatctgctgggcgtggtggtgggcacatgcagtcccagctactggggaggctgatcgctccactgcactccagcccgggcgacagactgagactccatctcaaaaagaaaaaaaataataatcctaggtaaccttcgttgcacatgtgctatatgccaggtcctgttctaaacctttatatatgttatcgaatgtattcttcccaacaaccctttgagatgagtgctattgttacatccactttataaatgcaaaattgaggtgcaaagaggttaagtcactggcctaaggcacagagaataggtgatggaactggaatttgaacctagtgatttccagagcttaagctctaaatttgcacgaggctacaggtgttgtgagtcctgcttctggctctgccaccactggctaggtaaccttgggcctcagtttccctgtcttcaaagtgaggtggtaagttccctcttggctctgacagtcctcaatcacaagacactggggctggcaaggaggacactaacttgagcgtgatctgtctacatggtcagcagagggaatgtcatgctaccagactccattagctgctgactgggggctttgtactgaaggcctgagactcaagcattctacccagctctgctactgccttgctttggggctttgggccagttgcctgcccctcctgagtctcagtgcctttgtctctcatctgcttggtccttagtctatgggagcagaggagcggtataaactatatagagtaaactcacagtacagagtctgttactgcctgatagtctgttactgcatgaactgtgactctcaagttccagtgctacagtgaccacagcatcttatcagtttcaacagaagagggttgattatttgcatatttatttatttatttgagatagagtctcgctgtctctcagtctggagtgcagtggcataatcttggctcactgcaacctccacctccagggttcaagcaattcttatgcctcagccccccaagtagctgggattacagacatgcaccaccaggcccagctaatttttgtattagtagagatggggtttcaccatgttggccaggctggtctcaaactcctggcctcaagtgatccgcctgcctcggcctcccaaagtgctgggattacaggtgtgagccactgcccccggcctacaaacctgtctctgttagcagaatacataattgtctatgcagaaaatcacaaagaatctacaaaaaagcaactataactaataagtgaatttagcaaggttacaggataaaaggttaaccgagaaaaatcattatgtttctatatattaggaatgactgattaaaatgggaatttaaaaaacggtgccattttaagtaccataaaaaacatgaaatacttggcataaatctaacaaaacaaggtgccaagtcaattcaatgaagaaataacagtcttttcaacaaattttgctggaagaattaaacattcaatttttaattttaattttaattttattattttttgagatggggtcttgctatgttgccaaggctggtcttgaactcctgggttcaagtgttccacctacctcagcctcccaaagtgctgggattataggtgtgtgccaccacacccagctaatttttgtatttttagtagagacagggtttcaccatgttggccaggctggtcttgaactcccggcctcaaatgatctgcccaccttggcctcccaaagtgctgggattataggtgagccactgcgcctggcctaatttgcacatttatcagaactacagccagatttgagaggtttgtggagccaacatatgcattaatcctatcaagatcaacaagtttagctactttgcatataaccaatcatgtgaagaaatgaatggcaacagccctagggaacctgtggcataatctgagatattatatagatataattttttttggatataatatttctatatagtattttttatatatgatatataacatattatgtatatacatcaatagtatatatgtatgtctttgtctcaggttcctggcacagagctcctgaaacccttggtgttttctcagtaatagaagtgtgttttgttattcataacaagcccctttgttatacctgaatttatgctaatggggtgactttgggtggggctcctagatagctacagggtgctgctcactagaaagaggaaacgtgattagagggtggaaacagggaggggacctgaagattgggttataaagacaataagggttggaagcttccaggtcgatgaatgcttctaagtgctgcaggtggggagtgggtgtcctcgatggacttgccacaacccacaccccacataccttgacctaggtatctctcccatttggctgttcctttatatgctttttaataaacctgtaaatgtaagtagtgttttcctgagttctgtgagtcattctaggaagttagagaacttagggggtggtcatgggaactcccaatttttagccagcctagtggaagtgtgggtagcctgggcagcccacttgtgctggcctctgaagcactcttgtgggactgagccctttaacttgtgggatcttgtgcttactacggatagatagtatcagaatttaattgttggacacctacctggtgtcagagaatttatctttttttttttttttttttttttttttttttgagacggagtctcgctctgtcgcccaggctggagtgcagtggcgggatctcggctcattgcaagctccgcctcccgggttcacgccattctcctgcctcagcctcccaagtagctgggactacaggcgcccgccactacgcccggctaattttttgtatttttttttagtagagatggggtttcaccgtttttagccgggatggtctcgatctcctgacctcgtgatccacccgcctcggcctcccaaagtgctgggattacaggcgtgagccaccgcacccggccaattttaaattattataaccaggctcaaacacatctttattaatcaaaataggaaccattacaatgaatacatttttgtgctttgggatttgacaaactcttggaaaagattttctgcatcctactggttgtggaagtattttccatgcaaaaagtgtcaaaatgcttgaagaagcagcagtttgttggcgagaggtcaggtgaatatggcagatgaggcaaaccttcatacatagctcaattcattcaacttttgaagcgttggttgtgcaacatatggttggcattattgtggagaattgggtcctttctgttgaccaatgctggctgcaggcattgcagtttttggtgcatctcatggatttgctgagcatacttctcagatgtaacagttttccaatccagaaagctgtagtggatcagactggcatcggaccaccaaacagtgaccattgtaaaagttcaagaaagaggaaagaaacacgaaacacagctgacagttaaagacaggttttcttttctttcttttttttttttttttttttgagacaagagtttcgctcttgttgcccaggctggagtgcaatggcgtgatctcggctcacagcaacctctgcctcctgggttcaagccattctcctgcctcagcctccagagtagctgggattataggcatgctccaccacgcctggctaattttgtatttttagtagagacagggtttctccatgttggtcagcctggtcttgaactccagacctcaggtgatccgcccacctcggactcccaaaatactgggattacaggcgtgagccaccgtgcctggctggttttctttagataaaacctgagaggtgctcctggccgatttttttggtcaaaagcgctttctcttacagactaagaggatatattggttttagggtgagggggtttatcagaagcttggaatgtttatgtgtagggagaagcttatggcagggttggaatctctctgggaggaggggaggttattttggggcagacatctttccggcctggtgtggggttatcttggggctagcatgtctgtggtcagggaggagtttggaatgtttctgtctggagatgttatttgtggtttatggtcatgctgaccttagccattaggctgatgccctttggattaagcagttttttattaaggtgaactttagaatgaggggcttgtccaagatggcgatgctcctgctctgtcaaacatgacccatttttggtgcaagtttggctttgggaagtgctttggagcttcttcttggtccaatcactgagttggtcatcgctggttgtataaaatacacttttgttgcatgttacaatccgatcgagaaatggttcattgttgtgtagaataagagaagatgacacttcaaaatgacgatttttaaagttttcatcagctcatgagccacccacttatcgagctttttcacctttccaatttgctgcaaatgtgaatgagcatagaatggtagatgttgagttcttcagcagcttttcaggtagctgtaagaggatcagcttcgatgattgttctcagttggtagttgtcagtttctgacggccagccactattctcctcatcttgaaggctctcatctcctttgcaaaacttcttgaaccaccactgcactgtacgttcattagcagctcctgggccaaatgcattgatgtgagttgtctctgttactttctgatccattttgaactccagtaagaaaactgccagaatttgctttttgtctaacatcatttccatagtctaaaataaacagcaagtaacaagtcataagcaaaaaaacataaagtgagaaatgcccattaaaatgatgtataacataaccacatttatttaagaatgtattctaatatcaaacagtgagttctaaaaatgcaaaaaccataattatttttgcactcacctaatataatacaatatctgggtaatttataaacaacagaaagtatttctcacagttctggaggctgagaagcatattgtgtctggagagggcctgttcctcatagatagtggcttctgtgtccttgtaaccacccaacagtttcaccttgcccgttgcccagacagctgatttatcaagacaggggaattgcaatagagaaaaagtaattcatgcagagccagctgtgtgggagaacggagttttattattactcagatcagtctcctaaagcattcagggatcagagttttaaggataagttggtgggtaggggccagtgagtcgcgagtgctgattggttgggtgggagatgaaatcatagggagttgaagctgttctcttgcactgagtcagttcctgggtggggccacaagatcagatgagccagtttatcaatctgggtggtgcaagctgatccattaagtgtctgtaaaatatcttaagcactgatcttaggttcttaaaatcaaaatatcttaagcacttagatcccaggagtgatttggggaggatcagaatcttgtagactctggctgcatgctaaactggaatttctaatcttttggctgatttgttagtcctgcaaaggcagtctgtctaggccccagacaagaaggggatttgttttgggaaagggctgttaactctttgtttcaaactataagttagttcagcctacgcccaggaaggaacaaggacagcttgaaggttagaagcaagatggaatcggttaggtcagatctctttcactggctcagttacaattttgcaatggcggttcatcctcacttaatggaaggggcaaagaagcttccttgggcttcttttctaaaaacatgaatcccatttaagagggctttaccctcatgacttaatcatctcctaattataattttggggacacattcacaccataataggtccccactgcagactgtaataactccgaactttcttactgaaaccgcctttccaaaattatgattgagacagtaaaagagatctaacttaactgactccatcttgcttctaacctccaagctgttgtttttcattcctgtgtgtaggctaagctaactttgggagaaacttagtttatagtttacggtttaaaacagatggtaacagccttttcccagaacagaccaccttcttgtctggggactagactgcctttgtaggactaacattagccacaagattagaaattatgttttaggagccatgcagctggaggctacaagattctgaccctccctaaactgcttctaagatcagtgtctgagatattttgcagacccttttcttgatggatcagctggtaccatccagattgatgaactggctcatctgatcttgtggcccccacccaggaactgactcagtgcaagaagacagcttcgactccctgtgatttcatctctgaccaatcagcattcctggctcactggcttcccccaacccaccaagttgtctttaaaaactctgctcccttaatgctggaagagactgatttgagtaataataaaattctggtctcctgcacagctggctctgtgtgaattacactttctctattgcgattcccttgtcttgataaattggctctgtctaggcagtggtcaaggtgaactccttgtgtggttacaaatttgggggctcatctgggattgcccttgtggctacctgcctgggtttggtggcccctctctagcaatggatccagaggccagcccaagcggctgcctagttcttttggactgggggccgactctggtactctactggtagggtgctgctgacccaatgtgcatggatttaattgtagtagagaaacagtcctggggagatgtccctcaactgtagccctgtcacagggtgtctgtagccccgttgcagggtgtctgggttggcgagtatcctaggctctgccaatgcctccttccttctcctgactggttctgtagttccatggtagggtgtctatagccccattgcaggatggggtgtctgtctcggtttggctcctggcagggggtggttggctctccctaactagtaggaagagccttggttcaggagacctccacattcaggaagattttgaggtgatttctcagacaaagaataggatagtttggaagggatactcttagagttcttggttaggtatctgattcggaaggccttctgtccttgtctttgtgtgtgtttgtatatgtggaggggatctcagaaggaattgctgatggacgtccagcaggcctacctcaaagaaccctccttatttgtctggttacgttcaatgagccctgaagaaagctcaacaggcctgtcttgggtgactatctgctctttgccttgcccagagaccccattgtgaatcattcggaggtcatccttccccacctggagtagatcaaagacaacaaggaccaacaggaagaatgttgagcgttgccaggttgatactgggtgctgaaaaaggtgactaatgtctgttttgttatgtgtattttcctgggatggaaaatgttaattcggtttgctcctcaggcagtgcctcccatgtctcttctgcaggacagaaacttttatctaaatagatgaaataattctattatatattgagtacctttatgttgaataatcctataatatgaatgattttggaatgccacccatcttagcctgggtcatctaaaaaacagagcttgggtcaaggattaaggtggctgtggaggctaaagcaactccatcttggatgccaacctgccatgttgacttctgattaacccctgttcaaagaatgcctctaagacttctaatttatctactgctaccataaaccctgctcctaggtcaaaacaatcttattttttgttttggggagcgtaaatcctccccttaggcagattcacataatacttttgcctttccctgcagggccaacttcagttgtcctacacattctttccctatggtatataagcccttggtctgggggataatggcagggctccaccatctcctcttgcagctactgagacaatggcttctgtgcctaagttattattaaatgtttctttcagagaaactacatttgtcagcctctgtctttggcctctcagcttcctcagcctttagggataggtttacatagggctgctccccgggaacagtgccaatactttatctgggagatgccagcccaggatggtgagagtgaagaatgagggaagtaaggccagggcagatggaatgcaaagtggctgatgtgctactgtgctggccacagcttcatggctagcctgggtgagacacagcaggtcgctcagcaggcatgtcgctctgcatggggacttgtccagagggatgcagggaactgcaccttggagcagtccaaggagagaaaaaggagggagaacttaccttcccagttccttcccatctcctgtttctcataggtcaggtttcacctggcaggtgcggggagctaactcatccatacttttgtgtttcatcaccgaactcctcagtagccagtttcataccttttttgatgtggaatgttatccagttctaaaaacggaggagtgacctggcactggtcttatgccaatcaagagaaatgaagcagattgctgggggaatctgaacaggcacccagggtttgcatctccagtttttggggctccaaaattttggagttccacaaattactctgaggccagtagaggttggtgtaatgagttcatcatgggttgacacacagtttctccatctatgaaatgagggggctggctaaggatgagcttcctccacatcgccaccgtccctgccccccacagttctgtttcctggggaagaaggccagcaaaggcccagcacagtcacctacttttccctaccatgtcgccacaaaccactctctcaacacagcccgccaaggcccaagagttccatccacatttcccagtaccacatcctgtgtaccagaaaaagcacacagaagtgagtcagaccttctctctactatctgattgctaatgataataatagccaccctgtttccatcctgtggtattgagcgccagctctgtgtccaacatctacacatgaacataaacacaggcaacttgtttaatactcaactcaatcctgaagatatgcatcatgttcccattttacacatggagaaagtgaggctcagatacgccctgggatttgcccaaaatcactaaggagtacacagggccaggtttagactcaaacagcctatggtttgagtttctctcttatttttttctttttttttgagacagggtctcgctctgttgcccaggctggagtacagtggcatggccacggctcactgcaactttgacctctcaggttcaagtgatcccccagccttagcctccccagtagctaggactacaggcatgtgccaccatggccggctaattaaaaaaaaaaaatgtttgtagagaggggggctctcactatgttgcttaggctggtcttcaactcctgggctcaaacaatctttccagctttagcctcccaaagtgctgggattacaggcatgcgccatggcgcccagcctatggtttgaatttctgtggggaaacctatagaagaacatgctggagaaggcccactattccttcaccatgtggcttttatcaacatgccatggaggtggtttgtgtccactgcacctgcacacacttcaggacaaggttccccggctgcttcctgcctgtatgtctgtatgtttctgtgagtgctgacctgccccagtgaggctcctgcccttctttcacaatgcaacacagtcctgagagccatgggctgggcctgggctcccagcagcgggattaccatctggacagagctgggggtatgcagagtggggctgcttgcatcaacaggctgtgggggcgtctcgtcctctgcccacatttgcagccctcttccctggtgagacaccccttccagcagctggcccagagcatctggccactcctgagaaatggaaactataccttcctggactggggccagcgtggtttgagaagcgcccctttcaaattccctttgtcaggaagttgatgcctgggccatcactcattcatgtcaagggaatgattattcttgatacatggaaatatttcttaagccaaaaagctgttgttctagatttactaaaactaggtcaataatttggcttcaatccccaggacaaatatcagtatggagaaaacttttacagttgtgggtattctctagaccaacgaatgcaaccaattatacattgcacagatgggcagtgaattgagtgtttcaaaatgttatctttcacctgtttagaaacaaaaggtcaatttttggaaagtatttctcaaaaagagaaaagcggcaccatgcagatataaaaatggaagcaatggtgcagatggtggatgataaatttctgtaacaaaggctgtatttttttgtttgacaagtttttgccaagttgcgtgcatgcttccccaaagtaggggagatttctgaggagggaggtgagtcacctggcctttacttccctcaaggcacccaggtttctctaatgtggggactaaaagactaaagttcctaaggaatgatcctgctgggccactctttttttttttttttttgagatggagtctcactctgtcacccaggctggagtgccgtggtgcaatctcggctcactgcaacctccgcctcccgggttcaagcaattctcctgccttagcctcctgagtagctggaattataggtgcatgccatcacgcctggctaatttttgtatttttagtagagacagggtttcaccatgttaatcaggctggtctcgatctcctgacctcagctgattcacccgcctcggcctcccaaagtgctgggattacaagcatgtgccaccatgcccagccaacctgcccacccattcttatctcacttggataacacatatagtaaggcccccttcagtgcagcccacagacagagccctgcacttggaagggcccaaccaagcttggttgaatgcactaggaccaagcagtactttgaaattcttcgtaatttaactttgaatttgtcttttttttttttttttttttgagacagagtcttgctctgtcacccaggctggagtgcagtggcgcaatcttggctcactgcaacctctgcctcctgggttcaaatgattatcctgcctcagcctctgagtagctggagctgggattacaggcacgtgccaccatgcccggctaatttttgtattttcagtagaaacggggtttcaccatcttggccaggctggtcttgaactcctgacctcaggtgatccacctgtctcggcctcccagagtgctgggattacaagtgtaagccatcatgcccagccaaatttgtcttttgtaagtgaagtccaatggggtcatgtagcacgtgctgagggcttggaatcttggcctgaagcatggtcatgcctcctgccacctccatgcttccctggaatgagttcttggctatccactccctcaacctctggtgccccagtgccacccagcccccttgtcacccctgccctgcaacactgccaccctttgctcccttgagggcctgggtgggggtgggtgcgccagggccaagtacatgcaccccacagtgtcagagcggacaggtggtggccgtcctgtcccaggctggcagcaatatgccatgttcagtgggtggcttagggagggtgagcctctctccactcctatcccagtccctagtgcctcctggctacgaggttgggacatagttgggactgtgggcctttaggaagggaagatgcctgcctctacttcccaataagtctgtctggtggctgctggaacggggagcctggtagttactaggttccacatgtgccacctccccgatctgtgaaggtccgctcttgccctgtgcgtgtcccgagctggagggagtaagaacattaagtgtaaattaccaaaaaacgcaacaccatgacaggttgtgagaggcatcatggaaaaaagggaagacattcccccatgcattttgaacagggaacctgcaatttcattttgtattgggccttgcaaattatatagcaaatcccacaggcagtgctgtgttgtggcctgccagctctcactaggtcacagttcactttctgtgatgtcatgttggtagctttgaaatggccacggtgggccgggcgcggtagctcacgtctataattccagcactttgggaggctgaggctggtggatcatctgatgtcaggagttcgagaccagcctggccaatgtggcgaacccgtctctactaaaatacgaaaattagctgggtgtggtggtggacgcttgtagtcccagctactcagcaggctgaggcaggagaatagcttgaacccaggaggttgaggttggagtaagccaagatcttgccattgcactccggcctaggcaacaagagcgaaacttgtctcagaaaaaaagaaaaaaagaaatggccatggtgagtattaacagcacggaaatagggcaaacactgcaaaacagaacttttattttattttattttattttagatgtagtctcactctattgcccaggctggagtgcggtggtgtgatctcagctcactgcaacctctgcctctcagattcaagtgattctcctgtctcagccttttgagtagctaggactacaggtgcgtgccaccttgaacacccagctaatttttgtatttttagtagagatggggtttcaccatattgatcagactagtcttgaactcctgacctcaggtgatccacctgcctcggcctcccagaatgctgggattataggcatgagccactgcgcctggcctagaactttaaaaaaatgtatgtagagctggtttttaacatttaccagcatagcactgtatagagtacccaataaaagtcggaaacttcttatccttgttaatttaattggttaaatagggcaggcccaaacttctaggaagacagtgcagaggcatggaaggaaggctaaggaagaaaacagcttagtaagtgccaggcactggtccaaaccatttcaccaccttttcaggaatgaggaaataagctcagaaaagtagtgggactcaaccaaaaccacacatcaggccagctactgagctaacattcggacccaatgtcctagctcttctcacagcaaaaggagaggtgttctttttaaaactagagatagggtctcactatgttgcccaggttgttctcaaactcctgggcttaagcaatcctcctatcttgggctcccaaagtgctgggattacaggcatgagccaccatgcccagagaggttctttagagtcacatgtctctctctctctcttcctttcctttctttctttttttttctttttttttctttctttctttttttttttttttgaaacggagtctcactctgttgcccaggctggagtgcaatggcacaatctcggctcactggcaacctccacctcccaggttcaagcaattctcctgccttgccctcccaagtagctgggactatgactataggcacatgccaccacgcctggctaatttttgtatttttagtagagatggggtttcaccacgttggccaggctggtctcgaactcctgacctcaggtgatccacctgccttagcctcccaaagtgcacagggcctcgcacagggttctgaactccaggaataaactggggctcaggagtaggcaggaggggggctggcgaaggacctagaagttcccaccctgggctcttgatctcttgcagtaacttcacagcctgaggcagaagcctagatgaatgagaagcaggacagaatgttccagcagccaccaactagagcagagacacaaatatttactaagcctaggggcctccccaacatgccggcagagttggagggaacaagtgtatgaggcctctctctgtaagggcagggaatacatggcagggagaagccccatggagaggtctcccctgactccagcctatccgtcacattggtatatgagtccctcacaccctcaagtatgtaaagccagtcacaaagcaccttctcagccatgggcagcgtggggagctgatctccatcttataaatgaggaaactgaggcccacagagggaagataacatacccaaagccagagggctgggaaatgctagagtctgcagtggaaggctggactggaaatgctgcccccaataccagtagtctccaatcctgcatctgcccaccacaccccctccccaggaacttctcttgaccctggctggcctcctccctgactgacccccagaccctcttctttggtgagatcttttgcacccttacttcctgcagctcccgggctgttctcttcccaggttaacctcccctttcttcttttttttgagacaaggtctcactctgtcacccagacaggagtgcagtggcacgatcatggctcattacagccttgacctccagggcccaagcaatcctcccatgtcagcctctcaggtagctgggaccacaggcatgtgccacatttttaatttttggtagagatggtggtctcactatattgcccaaactggtctgaaacaatccccttccccagcctcccaaagtgctgggattacaggtgagtgctatcccacccagcccatcccctttcttcctatttcccacctcagagaagccttctcacctcacacctctctctccaaatcgtgcccctcctccctcatctagctgaggcctggcctcttatccaggaagccctcctggactgctcccagttacagggctcttgggctctcaagattgcatgaagtatgttcatattgtactgtctatttaaaaaaaaaaaagcgcatgagagactagcacacgggtttaggtcctagttgcagctgtcgccaacttcctagggtgacctcaggctcccctgctctctctgagcctcagctccctcatctgtaggcagcctgcctgcctcaccagggaatggagagtctagatgagaaaaccctggcagtgggcacaggtcacagctgttggggtttttgctggcatcagcattgcaccctctagatctgttcccatccattaccatctggccacacactgccttgttcttgctctcccctaggggtgggaggcctgtgtctggctggagagcccagttcgagagggtgctgtgtgtgcagggagccctgctgttccccactggccccagtgagccaggccctggcttggggctggaaagagcccaggactgggaatcgctgccctaagtgaggagccccaacccctaagcagttctgcccttcagcccttcagggtgttaactttgcctagccaagagcaaactctctttctctgtgccaggagtagtagagcccctgggaaatgctgtttttgtcccctgaggcagacttttggggagtccaaaaaagggctccccacggtgccggctatcacagaacaggagacaggagcaggagacaggccgggaagatgcggcgactgggggaccggataggagggcccttgtcctgaggctgcgtaggcatagcaagctccgggattttacttcgttggaatgttcttttgagctactttgggggccgtgactgagagagctcgtgggggactcaggccctttcagagtcacccgtgtggctcggccactgcgccaggtcttggaacatctaaggcagaaacaggaccaacacccgcaagcctccaacagcccctggggctccgtccagccgttggggtggaggggttggggggaggtgcaggggcgggcactgtggggggtggggcggggccggtggccgcgactccaccccgcgcccctagtcgagtaaacaagccacgggcggcgcctgggggccgctcctgcaagccggggcgctgggttacatcacggttccctggagactcccgccccagcggccgggtccctgaggcccgcgcccgcccgccgcctgtgtccgagaagcagagagctggcaagggcccgccagggcgggaaggctcccacgttttctccggaggcccctgggactttgttgcaattgggttcagcccgggcatgggctgaacgtggacgcgcgggaaccgcgcctcggtttccccatctgtgaaacctggaggctgtattaggattctgtgcctcctattaggattcagctgggggaaggagagcggcagccagggccagggccagggccagtcccaggcaggctgtgactggagccgggctttctacgttagggttttggtgggtacccgctcagccacgtgccagaatgcaccctccctctgaggggacatggagaccactcgctgggccaaggcacagcaaggacgaccttgtatcctagcattctcctgtccccacttgctgctggacacggaccctctaggtaaaattcaacaatagttcctgccagccaccctcacggcgggtttgtgccagtgctttgggaaagatgttgggttgcccacttaggcgggagggagatttctgctcaacatcaacaactcaatctaccacggagcctgagccactggtctggaggaagctgcgggggaggcaggggtcgtgggcacccagcttggggacactcaagcagagtacgggctaggcacggggaagaaggtggcagagggcatgcttgccagcgtctccaggagctgtcctgccctggggttccatgatttaatgattctgcacctgcaccatctgataaggtagccgcatatgactgttgagcacttgaaatgtgtgggaacccactaggagccccagagttggcataaacattattttaagctgaagacatttgagattcaacagacgcagaaaaaagcctcctaggagcttcctttatctgacaaaaagcagtaacttctgggaagtaaggctaccataaactctgtcataggggtagtttcatggccccaagaagacagagcgaccactcatacctatatagacaaatatttcacaaactttatcacctgtcggttctcttaaaaccccatttgtctttgctaaagaaacctatttgtttttcccacagaagccctttctttcccctcccttttccctactaagttaggtatataagccttcaactctatttaaccagccagctacgtcctttgttggtacggtatgcagacataataaacttcttctcctgttaatctgtcttttgtcagtttaattcgaaagctgcaatcacagaacaagagagtgtagaggaaaagttttttcctctcctgcaggggctagtacacattgatatgggcagtaagtgtaacatatacacaggatttaggagacttagcatgaaacaaaagaatgtgaaatatcttaataattttgtatatgattaaatattgaaatggtaacacagggttccattagataaattgggttctcttaaatatattgctaaaattgatttcatctgtttctccttactgtctgctagaaaatttcagataacatatggctcctattttatttccattgaatagcattgctaaatgtcaggtgaccttgtgtctttgggttggcttttcccaagcaacaccaccacatctctattaactgaatgctcttgtgtcgagtcctgagcagcgtgggcagtggagagtggaagaggagggggcgcagtgccagccctcggggagctgccaagcccctcttggcttccaacttggtctggccacatcctcctgcagtcctgcttcccctcctccacaggacagtcaggccagcagaaagctgggcagagggttctggggctggccagggctctgagaactcaaggagggagttctgtgtgggccaaggattcagaagacagtgtggccagcagccaggaactatgactgcaccgagtgctgttcccatgcccaggaccacagatgcatcccgggcctcactgcccagcacctcccggcttagtggccacagagtcctcttcctgctctgccaagcaccatctggctgtggtggaacaggctcccctgctctcccatcctctctgccatctcccattccctaggccttgctggattaaaacattttcctgataatcattcagggatataggctaaggtctgagaaagtaagctaccctaaggcccctgaaaaaataaaacaaaataacaaactgtagttggtatttctgatgaacagcccacacctggcaatttagagggatggtcccggttggtgtgacccaggtttaacccctgcagctgatatgaatgtgacagctttacagccctgtaaagctaaccagacctgtacatagttaaacaaccttatctaacattcctccttcttctcctatataaacttgctcataacagccaacactcacaccatgcttattgtgtgctaggcactgctttggggatcttacatgcttttttgtgtgtgtgtgtgtgtttttttttttttttttttttttgagacggagtctcgctctctcccccaggctggagtgcagtggcccgatctcggctcactgcaagctccacctcccaggttcacgccattctcctgtctcagcctcccaagtagctgggactacaggcgcccaccaccacgcctggctaattttttgtatttttagtagagagggggtttcaccgtgttagccaggatggtctccatctcctgacctcgtgatctgcccatctcggcctcccaaagtgctgggattacaggcatgagccacagtgcctggccgggatcttacatgtattaattcatttaaggctgggtgcggtggctcacgtctgtaatcccagctactcaggaggctgaggacggaagaattgcttgagcccaggagtttgagactagcctgggcaacataatgagaccctgtctctacaaaacataaaacatttacctgggtgtggttgagtgcatctgtaatcccagctacttgggaggctgaggtgggaggatcttttgaagctgggagtttaagaccagcctgggtaacacagcaagacactccccctacaaaaattaaaattaaaattaatacatgtaatttggattaaattggatttcaggcacaacaaacccgtgaagtgagtgctattattatctgctgttcacaagtgagaagctgaggcacggagaggttaagtaaacttgctcaaggtcacacagctacaaagaggcaaaaccaggattgcaacccaggccatctggctcagtatccgtgctccaaatcactgcatgacatagcttttcccgcaatgctggaggactcgattgtgttttgttttcctaaacttgttcccttttgttttcctaaacttgttcccaacttatgataaacctgtgacaggtgttcatgatccaaaaagtgtctgagattggctttaacaaattaaacatgagatgggaaagtgaccaaatgcatgaggaagaagaaaaaaattccagaagaataaatctttctaccatcctttgtccatgtgtctgtgtgggtggacaagggaatactgtgtaagaatgggtgcagcttgttcaaagataaactgtagttgaaagttgcagcctgcattgatagttgcccctagtttagcaagctgcctgagtgggctccgaaatggagacctatctgatttgcagaggcagggcaggagggctaaattgccacaaataagaataaaagaacaggcgtttcaaacaggaatgggggtgggtagaaacccaagaaggcgtcagcaagctgtgacctgagtggggtgtagcagcacaggaaacagctctgatgggttttcaaacaaggacggctactgtttaatcgtccccgttgcttgtgctgagctgcgatgtcattcttctcaatctcctgacctttggtcaaagcctaacatcaaccctgctttatgaccatccgtgctgagacagtcagtgctaaggggtgagggggcatgaagcctggggaggaccgggcctggaggccatgggcactgggcaagttgctgagtggggagttggcctggagaaacataagcccctttgccatcctcagagtcactaggggcgccagattcctgccaggcacaggatgtccagccagagtagcatctagctcctgaaatccagcacatgctctcctcccaagtcaggtgtcctggcccggggctctgtctgcagagagtggtgcctttgggctggcagtggtcctgcatggatcctctgctgaaagctaaggaccttgggtcccaggcacagggcaggccctgggctactgctctagacttcctgagtcagagaaagccccgctggacctcccaaggcctcatcctggcacctgagtcagcctcctccctctttctgagccaccctcggctgacctcccccagccagcctgcctctaaaagtggggcttcatagggacattgtaatgggggagcagactccaggtctagttcatttatttatccatcctttcctgttgtttatattgacctgtatgccagatacataggttttctttttctttttttcattgcactcaggctggagtgcaatgccatgatcttggctcactgcaacctccgcctcctgggttccagagattctcccgcctcagcctcctgagtagttgggattacaggcacctgccaccacacccagctaatttttgtatttttagtagagagggggtttcaccatgttggtcaggctggtctcaatctcctgacctcaggtgatccactcaccttggcctcccaaagtgctgagattataggtacgaaccactgcacccgactgatacataggttttctaatttagtcctacaatacaccaaaacataggttgtgtttttgtttttttgagacagggtcttgccgtgttgcttagactggagtgcagtagcatgatcacagctcactgcagccttgacctcccaggctcaagtgatcctccaacctcagcctcctgaatagctgggaccataggtgtatgccaccgcacccaggtaatttttaaaatttttgtacagatagggtctcactatattgcccgggctggtctcaaactcctgggctcaagaagtcctcctgtctcccaaagtgctggaattataggcatgaaccactgcacccgaatggtatttttattcttttcttttttttttttttttttgagacagagtcttgctctgtcgcccaggttggagtgcagtggcatgatctcggctcactgcaacctctacctcctgggttcacaccattcttttgcctcagcctccggagtagctgggactacaggcgcccgcaaccatgcccggctaatttttttctatttttttctagtagagacggggtttcaccatgttagccagaatggtcttgatctcctgacctcgtgatccacccacctcagcctcccaaagtgctgggattacaggcgtgagccaccgtgcccagccggcatttttattcttaaattacagatgaggaaactgaggggccaggggtagctgggacacaagtcctgtctgaattgtgctggtcttccagcttggtggggtgggatggaggcagcctgggctggggacctgaaagcagaagaggggatgaagggaactgggtaggcttgtggaccacaggcccacatgggagccacaccctggcaagagaggggattgtgaaagagaaggcaggtggggttcaggacaaagatgggaaaatgggggcagggagcaagagaccctccaggccttgcagatgcaggagttgagcaggtagaggatagatggggtggaagggaggtgggtgcccaacagggatgaccctgcaggtgaggtcccgggcagtaagcgatgaaactactttgagtgggggcagcccacccaatacctcctcctctgggctaaagaggagggaggggaactagctgggcgatctgtgcattcagccatccctaggggctgtccaggggcacttgtccccagagaggaaggccagctctgtctttggaggatgagagtgagtaagcagacaagcaccgtgctagttgcgtttcattcaagatcttcccaccacacccagtaagaaaggcatgacactaggagtttgaaaccagcctgggcaacagagcgagaccttgtctctacaaaaaatttttaaaaattagccaggtgtggtggcacatgcctatagtttcttttttttttttttttttttttttttctgagacggagtctcgctctgtcgcccaggctggaatgcagtggcgcgatcttggctcactgcaaggtccgcctccagggttcacgccattcttccacttcagcctcccaagtagctgggaccacaggcacccgccaccacggctggctaattttttgtatttttagtagagacggggtttcaccatgttagccaggatggtctcgatctcctgagctcgtgatctgcccacctcggcctcccaaagtgctgggattacaggcatgagccaccgcgcctggccaatgcctgtagtttcagttacttgggaggctgaagtgggaggatcacttgagcccaggagttcaaggctgcagtgagccatggtggcaccaccacctccagcctgggtgacagaatgagaccctgtctctaaagaaaaaaaaaaggcatgacagccccattttagagatgagaaaactttggccagccatgtccaatggcctgcctgaggtcacagagttaggctggagtgcagccaggatgcaaacttgcctttgctagtctggtgaaagagctaggtataaatagaaaccccaaagcagtgggtgccaggcacaggactggaggctatgaggggagcaggggtgactgaatacccccaccccaatactacccccaaggcatctgcttattctggacccagaaggagaggctgggggcatttctaggtatcctgtggataccacagaggttatgcacactctggcatagtaagccaggcagagtggtctgagggaagggagtggggatgggggagggggtagaagagaaggtagggaaggaagtgggaggagggactgagggggagatggagaacgggcgggggaaggagggaagggagggagggagaggtggaggggaagggaggaagagggggagggggagggagggaagtaaggaaggaaggaaagagggagggagggaaagaaggaagtggggagggagggagggagggagggaaggttggttgccggccatggttgcacgtgtgtgcctggctggttctgtgtccctctgtgtgtgtgcatgcatgtgttcgcatgtgcatgtgtacatgagtgcaacagttttttctccttggtcctctaagctcctgtgagtcctgccgggccaggaagtctccatttggggcatggcattgggatcccagtcaatagccctagacttgtccactggcattgggggtgggcaggagggttggacaggcaatggggaggggtaggagcagtgaagccttcaggcttggggtggctgggaggggcagtgaatgccccaggcaggcctatactctggggggctttcttggttgttccaggccagacagtccccaacacgcatgtgtattccaggctgcacggaccagctgggatccttccccaccccttaggcttactttctccagaagcactgggcattgctgtgcccattctgcactgggttcttcatattcacagtcagttgatctgcctgattatcccttgatgtggttaatgcttatcctcatttttttttttaaagaatatcactgtatttattttcctacaggtaatttttctatggcttcagcattttctcttcaaatcaaaagaaaaatttcccaaagtttagaactggatcacttggccctttctcttatctccttccagttcaaaatgcttgcatctcttaatggccagcatcctcttggatctgcagttaggctcaacacattccagccttagcacaaccttctttgtggtcttagccttcttccagaaaattggctatgtctgcccaccatggctactctgcttccgatcatagcacctctttccctgggcatacaaggaatccttgctcttcttatactgtgtcactttgtgaggctgatgcttgccacacttcttaccgaaggctcttcgggttttaggtacattgaccatctttgcagcacggctgttctgtctatatgatgaaaacaagaaacagcgtctgagacccttacctcgcacagctctcccctaacaggaaagggccttctttttttttttttttaattttttttttgagacagagtctccctctgttacccaggctggagtgcagtggcacaatctcagctcactgcaacctccacctcctggcttcaaatgattctcttgccttagtctccagagtagctgggactacaggcacgcaccatcatgccctgctaagttttatatttttagtagagacgggcactccatgttggccaggctggtctcgaactcctacctcaggtaatccacccaccttggcctcccaaagtgctaggattacaggtgtgagccaccacgcccggccatcctcattttttttttttttttttttttgagacagtgtcttgctctgttgccctagctggagtacagtggtgtgatcatggctcactgcagccttgacttcctgggctcaatgatcctcccatctcagtctcctgagctgggaccacaggcacatgccactaccatgcccagttaatttttttttttttttttttgccagggggagatgggggtcttgctatgttgcctaggctggccttgaactcctaggctcaggcaatcctcccacctcggcctcccaaagtgctaggattacaggtgaaagccaccttgcctggccttatccttttttttttttttttttttttttgagacggagtctcgctctgtcgcccaggctggagtgcagtagtgcaatcttggctctccgcaagctccgcctcctgagttcacgccattctcctgcctcagcctaccaagtagctgggactacaggcgtgagccaacacacccggctaattttttgtatttttagtagagacgggatttcactgtgttagccaggatggtctccatctcctgacctcgcctgatccgcccgcctcggcctcccaaaatgctaggattacaggggtgagccaccgtgcccggccctcattttttatatctgtgtaaactgagccccagagagatgaagtgacttgcctatggcagcacagctaagaagtagcagaagcaggatttgaacccaggaagacagggcaccaatctcagcccccagccccttcagcatagagtgagggtcccctgccttctactccaccctaccctcccagcctcaggagcacattcacaagtacaggttgggcccctcttctgttctgtgaggcctgtatcaatttgtcatggggtggagagcccagctccctggtggaatcacatcaggtcatagtgacagagtcctggctccccagggactgactcccagccacagcactgggagctgggatagcactctaccccactgaacctgcagcacagggccagccagtcatggagcccctcaaatccattggtgcactgggggccagagggcttgcaggagtggatgagaggtggctcagccttcagtaggccctggctgagaaataaagaggctgttcatgagcgcagatgtggttctggtcggctgggccccagggatcctgagcaggcctttcttgtctgaacccaaatctacttcttgggtttgtcagcattccctaccaccaccctcagccccacagcctggccgagcagtgggcgcagtctctcaacttgccctgaatgccttcgcaggcctcttgccttcaggagttgcatgctgcaccttctggaaacaaacagggaccatgataccaggcggggctaggctgccactcctgccctcccactggctgcagtcagatgtcagcacatggcactgggggtgtgggtcacaggaaggccctgtgggcctctggaaggttctgctcagaagaaacatcatgggcaaggaggtctgtgcaggggctgcaggggctgcagtcacccctccgattgcctgttacagatggggagctgtggaggtttctgtgtcccttccttttaactaaacaaccccagctggacacggtggttcacacctgtaatcccagtactttgggaggccgaggcaggtggatcacctgagatcaggagttcgaggcaagcctgaccaatatggtgaaaccctgtctctactaaaaatacaaaaaaattagccgggcagctacttgggaggctgagacaggagaattgcttgaacctgggagacagaggttgcagtgagccgagatctcaccgctgcactccaagctgggagacagagtgagactttctctcaaaaaaaaaaaaaaaaattgaacaacccctttccaggccttttgtccccattaggagtgtcctgttgtggtccctggctactgccccagacttaggttaggaatggggacagaactgggcctgggagctgggattagaatgggctgggattgggatgaagatggtctagtctgggctgggcagagcttgggatgggggtgggaggcctgaaagcagagggctttactggaatgactgtttatcccctgcccactctgcattgagcctgtcaacctgaatgatgagattcaggcaatatgattaaatactgagtttattggagtgcaaagtttgaggaaggcacagtctccaaaaaaatggggtccaaggtgctctgaagtggagagatttgaggatcatttatataggcaaggatgtaaacaggattacatcatttttcatacatagttacagcaattgattggttaaaggcagtgtttctttttcgggaaaagtatatttgacattccacataaggatgtaatagttaaggggtctttcatctcagtcaaggggtcttctatcttagggccatctggtctaagccaggaacaaggaaggaaattaatttataacaaaagttcagtaattaagaggtcaagttctgtgactcagtctccaaaggcaaccttcctcagagcctagtaactgttatttttgttcttgttgttttgtttttgtttttgagacagggtcttgctctgtctcccaggctggggtgcagtggcgcaatcacggctcactgaaaccccgacctcctgggctgggcttaagcaatcctcccacctcagcctcctgagtagctggaactacaggtgtgcatcatcacgcctggcttttttttctttctttctttttttggtatagagaaggtctcattatgttacccaggctggtctcaaactcctgggcctgagcaatcctctaggtttggtctcccaaagtgctaggattacaggtgtgagccactgcacctggcccctaataacttttagaagccctaaacagatgatccagttcctttcacaagcctgtggaaaaatggcagactgaggaggtggttttggctctctggccttcacagaacttcttcctagagaagggaaagcagacttcagccccacgttgttgggaacaggcccccaaatctggccataaacaggccccaaaactggccataaacaaaatatctgcagcactgtgacatgctcgtgacggccacgatgcccatgttgaaggttattgttttaccggaatgagggcaaggaatacctggcccacccagagcggaaaaccgcttaaggcattactgaaccacaaacaatagcatgagcgatctgtgccttaaggacatgctcctgctgcagataactagctagacccatccctttattacggcccatccctttgtttcccatataggatacttttagttaatctataatctatagaaacaatgcttatcactcgcttgctgtcaataaatatgtgggtaaatctctgttcatggctctcagctctgaaggctgtgagtcccctgatttcccactctgcactctatatttttgtgtgtgagtctttaattcctctagcgctgctgggttagggtctccacgaccaagctggtctcagcaccacatcttctcagagtcctgcctgcttcctaggaattggcctgaggaaggaggaacacgggttcactgaggctcactgcctgccgggactgatccagtggcattagaacactgggcacctgaccctaccacaaacctgggggcacaattcatcatcccacagtcaaagaccctggagctcagagaggttaagaagcttgcttcaagtcccacagccaagagtgcaagttgggatctgggcctggataaggtggctggtgctggttttgtcaccagagtatccctaagaaggcaatactaatccaagcaaggagacactaacagggggtgtcagcaccaggagagtgatgcagcagtttcccagcagtgggacttttctggaaggagctggaggcccattctggggtcaaatgctgctgcagccaagcctcctccacagctgcagggcatttgcctggctcctgctgctggggttctaatctcatgactggcctcggctcagggtcagcccaaggacacctctcagtctgggggctgaggtcaaggctgacttctggcctgtctgggtaacctgcacctctcacctgcactgttcacactggttccctgggcctgacctgtgttcccttcaccaagcccgagttatacagtgtggactcccaccccccatcaagacccctctccctggccagtgctgctctatgtcagggagggagacaacagggggcttccctggaatgctcaccttctgccctgtgccactgctgctggcttcccaccacgttgctccgttgctcaccacactacccacctcttgccatcatctccggaagctgggggctatgaccattcttgttccaatgttaaagatggggaatctgagctcagcaagaggaagccttgacctccccttactcctgagccactccactgtgacacggtgcccacacgtccactggcagcacctcacctctcctttcctttcttggctggaggctcgctctgaccccaccacacaggctgtcccctactccccgctctcagctctggcagcctttctagccagagcccatagttcggccacttgcagcctgaccatgggctgggctggggggcattctactctcttcaagagctgagggactgtcaggtgaaagatggatgccagggactgaggggtcatcagggggtgacgcccgagagagccaggaggccccggatggaggcctgaagggataagccaagcttctttctaaatccctggctgtgccaaagccacccatggagactttcccttactgacctgacctcagctggatttggcatcctcctggcttccccagccagccagggcacactgactagacagagatggctgaggaaggtgtgtgtggagctgacacacgggccccggaagtgctggagaaggctcgttctgggtgtggaccctcttctccctgccccttacccaattccctgggggattcttttgttcccctgccctatgctggggtgcagggaggccacctggggccttgccagcctggacttgcctgagctctgggccctgaggtcatggagacctcctgaaaccctccccaggggagctgttcgcaggcagacaggcccaatgaggtgctaattactgaactaattggaacctgagccatagatgacctggttgacaggaggtggggactgctggagcagagggggctgtggaatagggtctggagggaggttgagggagcccagagctggtgcagggtgggctgtgtttgttcaggaattgttgatttattagcaagatcagctctttgaaatgcgttctggtctcctccatatctctcctggtcctgggtttctctctgggaaaagattggtgttctgaagccactgcttgttgggaggggttcatcaagaatttgggggcagaatgttctgctctggggagtgactcgagccggagggaggcccacggcctgtcctgaggattccaggcctgctgcagccagcagacgtggcactgggtggtcttggagatgggctgtgagaacagagtgacaccactgagccgggtcaccttggagggttctgggactcaccccacacctggctcttttggaccttggcctgctcctgcccctctgtgaatagctggtaaggggccagtgactctagaggcctcacaaattggagatgacactgtctgctccctaaggggcaggggagctaaggagtctaccttgctgcatccagaaaggaaaagcctagcaccctctcccctctccgagactcccttcttcacagcccacccttctggcacaagtcattctcagcaccctggacccagggaagactttggccacattgggccagaccccaactctcagcagggtagcatgtggctgtcactcacccatctctagccccattggctccccagggctcctggcacactctgcactttctctggtcttcagacctttggctgcctccagctctgccccctgggctgctttctgcctagtcaagtcctctccactccacaggcaggctccgggttcatctgcatagcagctgagcagtgacctcctgcctgatcttctgcagcatcccctgcccccgcccctccacactccacacacggcccaggacccagactgttggttatgaaagctgggaggctaaccccctgcctgctctgaaggcttgtcctcctctctcccagaatgctctgagaactgaatgaaatgatggataagagaggaccgtggcagtaactgtgacaattgctccaattgtatgagtgcctatttctgagccaggcatggtgctgtgtactttctgcacaggtctcatagcaaccctccagggctggaagttttcctatccccacttctcaatgaggaaactgaggctcagagaggccaagcaactgattcaaagtcacacagttcctaagtgacagtttggggactccaaagtcaccatctctcacaatgggaagggggttgttgttattttttggccagcctgcttccttccccctttcccctccctccctgcctgccatcatctgcctggtgagtttgcatcactcctagggcccaggggtccaattaggggactcccccagggaagctgactgaggcaatccatgccccaagggggcctccctgagctgaagttttaattagccatcactgctctccctgaaactctgacctgcccatagctctaccatcccaggctggccttgtggcaggaggcagaaggcaggactggcgttcaacccagctgcgcagcagaagctgccctggcagagcagagagatgtggccaggcttccctcccacacagctctctgtatccacctcagcatcacctcatttagtccagtaaatggattacaaaataaatggactaagcgacttcatccattaaatagattaaatacattaaatgagctaatatttgtgaagcatttaaacagcgcccggtacatagtaaagactaggagtgtttgttaaattaaaaaaacaagtcagcaaggatgaggggaacaaggtaccacccagggcccagaactattcttggacataaagatggcacattcctgggtcacttggcaatggtgggtggcccatgtgtgggcggtcagcatctgtaatcctgccccctgcaatgtgggaagcttggggtgtggagggagggaatggatgggtatgtgccaggcactgcactaagcattcatgccctacaagccatcttaggagatgggttaccatcccatttttcagaggaggtggtcaaggttcacagaagcaatcaacatgtccacagctggcaaggtggctcatgcctgtaatcctagcactttgaggggccaagtcaggaggtttgcttgaggccaggaatttgagactggcctggtcaacatggcaaaaccgcatctctacaaaaaaaatagaaaaattaggtgggcgtggtgatgcacacctgtagttccagctacttgggaggctgaggtgggaggatcacttgagcccaggaggtggaggttgcagtgagctgagatcgcaccattgcactccagcctgagccacagagccagactccatctcaaaaaaacaaaaaaacaaaacaaaaaaaaccatgtccaagaaagcacaaccatgagaggcagggcaggatttattgtttattatcattattattttttgttttctttctgtttatttgtttttgtttagggcaggatttagatccaaaacctaagccctgcacaccagaaaatccgactccttgtgcccctcccacacctactcagggcaagaaggccacagggccacacccccagatgcaaaagggagaagggtgcctttctctgctcccactcagcttcccctcaacctccaggaaacctgagggctctgagtatggctgtttgtgttgaggacccaaaaccccttttctggggccaggctgtgagtctaaggtgagatgataacagggagtttctgaagcactgcacccctactctggggagcaggaggcctcctgaccgtgaccccagtctcccaccctgcttggctgctcacctcccgcctcagcagcagcgccgctgtgccagccctgagccagagccaagccctccttggacgcggttgcctggtaaccagccctaagtgacggcaaccccagcgggccgctaatgagggggcagcagccaaccacctggccagacccagccgcctcagccagccttagaaaggcttccacgatagtccacctggcctgcccacggtaggaggggagggtgccccagcactgggggaggggacatggtggggcgaggaggagctgggttggcggccccccaaaacctttgaactggggatctgggggaaggtgactcccgatgaaggccaagtcttgaccaaagcgcggggcgggcactgggctggagtcagggctgcgggtagggcccgcccaggccccaaccaccaccctggaaacagctgtgatggctctgcccagggcgccgaggccgggggaagggatctccagggagaggccctggatggggagaggaggtgatgagggcggctggcaggagtccaggctctgggtaggggagcagctcctgcagcacggggggaaatgcatcagcccctcccctctttgcaggggtccccctcctcttctcctcacacccctaccccaggctgatggcctccaaggagggggctgcaggcagcatgaggcaggcaggtggagctcggccaggtgtttttccatcctaggtctgacaggggaggaggggatagagaggcagtggcagaaccaggaggaggcctggtgtatggactggacaggccttcaggagacctgggttctggagctgcctgcctgagaccccaggcaggtagctggccctctctgcgtctcatttgccccatgttgaaataggggctagaaacaggctactgctggtgtcctgggtcctaagaggctgagacggggagtccaggggctttaggggagctctgggcagcagaggttccttcaggctctcatctctgggcctgggtaggtttttctgcctttcttccctttcagatgtgcatagccctccttcaccattaaaccttcactccataactacagcctgactcagccctgtggtgggcactagagtcacagcccaagggcagacccaggccccaccctggaagaggtccctccccagtataagagagaagccaggcttatagccaggcaatttcagcacaggaagctgaggctaaaatggaggtgagttcaaaatgctctgggacctcagaagagatgaccaaacccagcctggagctcagggaaggcttcctggaggagggatcccaagccgatttttttttttgacgggggctgtgtcaggtcttggtttgttgcccagcctgaagtgcagtgacctgatcacagcttagtgcagcctgaacctcctgggctcaagtcatcctcccacctcagcctcccgagtagctgggaccacaggtgtgtgccaccatgcctggaaattttttttatttgtcctgctctgttgcccaggccagtcttgaactcctgggctcaagtgatcctccagcctctgccttccaaagtgtgggaggatttcaggcatgagctaccgtgcccagcctctgagctgagtctgaaaggccaacaggaattagcaaggaaagccagacaagcagccaaggcagatggagagcatattccaaagtgtggaggtgtgacctgaaaggaaccttggctggctggggagacaatcgggacaatcaggagacatgccaaagccagactggggaactggaacctgaggccaccgaggaaccacaggagactccaagctaggagtgaccggttacacacaggcattagaaagctctctgtggaggcaggcagggaatatttcctgctgcctccagcaccaagcctccaatggctgggctttggcacagccagagtgagacatcacagtccccccctccctgagtccaaggcccagcagtcctgttcctgaggcctctctcccactgtggcagacccacctccacacaagcacccatctcactggaggcaatggtctgtttgaagcctgggagacagcactgggacccatctactgctgtaccctcaatgccagcataaaacctggagatcctcaatatgtgacagaaggaaggatgggaaggagagaaggaaaatcagcccaccctagctgttaattaaagaatgttcccctcctctgcaggagtccctaaatctttttttttttttttttttttttttgagatacagtcttactctgttgcccaggctagagtgcagaggcacgatctcagctcactgcaacctctgcctcccgggttcaagttcctctgcctcctgagtagctgggattacaggcttgtgcaccatgccggctaatttttgttttttagtagacatggggtttccccatgttggccaggctgatctcaaactcctgaccttaagtgatctgtctgcctcagcctccccaagtgctgggattaaaggcgtgagccactgcacctggccagggtccctaaattattgtgcatggtttgttgttgttgttgttgttgttttcctagccaacaggccagcagatgcagtcttccagaggggcccagtgaaagcctgccccacttctcagtcttagggcctcccctctgagcaagtctgattttctctggaggtagtggggggggggctccttcggagtttgagaggctcccactccctgctcactgtggcaaagcagcaggctgcccccacccccagcctcccctgcagaaggatgccctgatttcccagtacacctttggaaagtggctcacctcaccccaatcagaccccatggccctgtcctcctgcccaggtcctatccaacccagatccctacgacgctctgagtccatgctgatggccaccgacgcagcccagcttcaggctctgcttgctttagtggcagcgggttcctgaacaacaattgtgtctgagccctccctcagaaggcactggagtcacacagtcctccagggacaatcctagctctccatttcttggctatgtggacaagtggcctccccctcctcctctagagctactgttactggttgagggtagttgcccaggttcttggtgttttgaacaaagaattggacaaaaggcacaagcaaggcagcaaaacctccagcaagaggctcaggagcactggttacagaattttctggggtttatataccctctagaggtttcccattggttcaccctagtagcccgcaaccagtctgattggttgaagagtaggcccacgaccagtctgatgggttgtgggaggggaccaatcagaggcactttcactttccagctgccactcagcaactgccatacagcaaaaggagggattgcaactaccatgcagcaactgccaccttgaaagagaaggggttgaagagtagtctctaatatccagcaccagttggccttaggttccctgcctccagaccttattctcctgcaacatcaccactggttgaaaccttactacaaatcaagctgtgaagtcactggagccctgtagcaagtcatgtccctgtaacgatgagtgagctgacagctaaggggcttgcctaaaccacacaggtcagtggatcaaaccccagtgtgcttgtttttcaaactcctgcttcacatggttgtaagaattaaatgagatatcaattatctcatagatagatgtaggagctccatgcccaaccactgacactgagatatccctcttctgggaggggagagggagcaatgaggaaatagagggcagacagggcagcaaaagcagtctgaggggcctctcaggaggaggcagtgtctatagctgggtctgcaaggatggaagggggcattgctgtgtgtcttagggaaaggtgccatacttctctgtttctctgcctgtagagtagctgccagctccacctcacacgcctctggggtaagggagctcctccaaggaaggagatttgtaaatagcaggtgtggcctcattagagggagcaccattgttattaataaccataaaataatgagccaaggctcaggatctgaccttttaccttgcattcccagggagccaggagaagtaactggtgtctggggtggggtggaagaggagtgtgtgtgttgcatgtgaaacctgggcagacctggtagtggtaggggtggggtggggtgaggagaaacctcctttttacactactttctttttctgtgttaactctactcgggaaggccatataaggacagactgttcccttctctgcttttattcacactattccttctgattagaatatcacatctctgcaagaccacagtcctgataaaaacatgtggagctcccaaggcagttatcttgtattgattgccttcattctctataggctccacagacgaccattggtatagggaggaaaatggcaaggtcagagccttcaggagctcatagtctggggacactctatgagcttcctagagtttacaagcaatttcccacactgatgttggccgacaccacagttgctaaggcaggtctctcactgctctctttttgcaatgaggaaatttgaggctcagaaagttacaaagtagctcccaagtcccccagtgttgcctcctttctttggcagtccagggtgtttaagtgatgccgaaaaggaacagacatactgttgagtggggctgctgtctgtgtgaggtgtccctgaattaacacaaggctcagcagtgctgcaaatcttaactagcccctattgtctcagatggctgctcatcctggcctggttgggtcccattccaactcagggaaattggagagaccactgggcacatctgagcacacaacctgagcgtcctagaccccaagggctaagaacacagccctccttccaccccactagcagggcagggacagggtcgccggcgcggtgctggaggaggaggggcgagcagagttggtaaggggcaagagcagtgaatagcctgtgacccacggggctgcaggctggggttaagggtatgatgtttggtgtgacccctagctgtccgcgcgcagatgtattttcctgacgctaaggtgtggctgcaggaagggccccaggctgggagccaggagatctgggattttgtcccagcctgctgagtgacctggggaaagccccaaccctctctgagtgtctctccctatatggttcccgactctatttctaaggtccttccagctctaaatgaagtgacactctccccccacctcccgcccccgctccccaggtgacctcacttcctcttcctacctgcagcgcccagcccctcctcctcagctccagctgctccagctgcttggtgattcttggaacctgcagcctcaggcctgctctgctctgactcaggcagaacttacctttgggatctgaggggatagttttgcttcctgaactgactctgacctttggcatgtccacctgccctccccttccccactgcacacacctgttcccagtcctcgggcagcccaggagctttgacggaccagattccttcagataaagtagcagcactgaggggctctcatccacagtcagatggtccagggagaggcaccccttcccccctccagcctctctttgcaacacaccattcctggctgggcgtgctccactccacccgcctcacaggctgcgcgccggtctgcctcatggagggagcctcacccaggctactttgcaaatcccccagcaccctcattcccggcccttccagggatggggagattgccgcttcctcagacagttgccgtgccctagcaggagtctggaaattgccctcattgactacaacgaaatgaggggacagatcaaggagcccttctccagccccctaatacactagtgctggacaggggaatgccggcacctactgtgtgccagatatttgcaaacacccttttccaagcttacaccgccaccgctatgaggaagacagaattccacttttgcaaataaggaaactgaagctcagcgaggtcaagcggcaggcgcaaggtcacatcgcagcaagtggcagtgaatgaacgatctaagggagcgactgagggcgcgtgacgggcccgccgggcactggttcgtggagcgtggcggttacgggcggtgcacagcgcccgcagcccgctcctagcgagctggccccacgcgggccctccgcacccgctgcccacaggagcgcaggctcccagaggcggggccgggctcttccccaaccctgcgagtcgccccgcccccgccccgcccccagcccgccccgcccgggaccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtaggagctcgcccgctcggcgggcgcggaaacttgggccgagtttgcgggcggcgcgtggagaaggggcgggtggcgctgccccagggcgcccctaccggccggcccggggactgagggagccgcgcctgggccgaggggctgcggcttctggctgccgccggccccccgcgaacgggctgcggggcaggggtggcgctgctgctccgactttccccggacttcgaggctcccgggacctggtagcgctctgggtctccggcggagaacaggcgcctaatctggcgagaaggaactcaggccgagccctccggcctcccgcaggaccctgtcacgtggattgctgggggatggcgttgaggaggaggtatggggacaagggggcactggagggctgggcctgggggcgccgggcgctgaggcaccgcggggccctggacgcgccctgctgggatgggacggccctgcggttttctcgccacctcttgactcacccctctggcctcagcccaggctggcaggatcgccctgaggcggaggctgcccggaccctgtcgccgggccgcccctgttccgggacctcccgccggtccgcgggcgtcggtgtggggctgggtgcgcgggcctgcctgcgtgcacacgtatgcccggggcccgagcgaggggagagcgcagttctggaatggcgtgtgtgcagatgtgggccatgcacgtacgtgcaggcacgggtttgcatgcgtggcggcggcctgtgtgtcagcctgctggatgcacgtgcgtctcggcgccgccgggaggggcttggggacacccggaagcccgccaggtcgggtgcggcggcagcctctaagcgaaatcggctgtgggccctaggcacccgagttatgttcagggcgggtaggggaaaggggatagagaccgatcccgttcgctttcccctccactggagactttgggctgccccaggttgggttgtagcgtctggagagcccagagcctcaggtagggaaggtgggagatgggagaacactcggcgaggcccgatccagccctccgggagaatccagatgctggccacaattgggcaggaatcgcgctcttcttcctggtctttgccatcggccatcccgaggcccctagaaggtgaaagtgggaacagagagctgtttcctttcccactgcgtaaggcaggggcggtgctgcggtggtgggctcttctccgggaccctggcctgggtgctggctgagtgacgttggagcttggcagagaggatcaacagagctgcctctcaaggatgatctgagcctgctccctgggcacctgccctttccgagagcttgcttgcctcagtatgggtcagggaaggaggcacctacattttggcaactgtcttgagtggaggagtcgtctcccttgagagagtgtatcctgggctttccacctcctactggcaggagatcaggtcattcccacacccctaagagttctctgttggctccctgaagccgccacccctcccacaaagactcctgagggtcccaggtggtttcctgtctattgactgggtcccagataggggcctcaagaagtctccagagcaaagggtattccatgggctgagacccaggagagagggactcctggggtgggggtggggacccagcagaccccaagaagcatgtgggggaggtgagaccaaagtcagtacttaacccagagtgtcccaagggtggaggtggggaggatccacacttcaaaaccctacagttccttctcacagcattgctgtggagtgagatgggggctttcacccctcgatagcaggtttctatcataggacactgctgttgggactgtcacctgtgtcctaatggcccctctgtgtcttctctaggctggcctgaggtgtggggttctgtccaggagatgaaccagcttgctttctgggtctgccttggtggaagtgggcattggcccccacactagccttgtgttttctaaccccaaaatgtgccggtctaactcagcctgtggctgtcattggctccaaccagaagaggcaaggagagggctggtccttgcttgccagtcactgaaacctgtgacactttgccctaatcatagcaagattgagctaggtggtcctttctaagctactgagagtttccaggaatagggtgctggctgggggaggtagaggtaggtcagtgtggccccagaagacaggcttcagatgagcccctaacgggttactgggtgcctgctgccctgaggggcctcagtccccatccttccttggtcttgtcttagagctttgtcttttttcagcacatagtttttccatcaatacaatgggagtagtggctaagtagcactctggcccctggggcctccctccctggacttttttcttttcttttcttttctttttttttgttttgttttttgttttttgtgtttttttgaggtggagtctcactctgctgcccaggctggaagtgcagtagcacaatcttggctcactgcaacctctgcctcctgagttcacgcaattctcctgcctcagccttcagcgtagctgggattacaggcatgcacaaccatgcctggctaatttttttgtatttttagtagagacagcgtttcaccatgttggtcaggttggtcttgaactcctgacctcaaatgatccgcacacctcggcttcccaaagtgctgggattacaggtgtgagccacagcacctagccacctccctggactttcacacacgcccctgacgctgtcttggccccaccctgccatgtgcctaggaatcgccatctgcagcttgggggctgggggtggatccaggctcctcatgctctgggaccttcctgctggtgctgcagcaccatctgctgggctgccctgactcctgcggagggggaggagtggggcgagaggggtgtggcttgtacagactgatgtccccagttacctctcctaggggactgctctccagagccaagtccagtatctcagcattggctttgggcctagggacctgggctggaggcccgactctgccatttttgacaagatcagcaggtcagaggagtgtcacaagaaatctgtgaatttgtagacaatactcagattccatgttttggctgcagtgggcatcactgtggcatcttggaataggaccctgtggtgggaggcaggaggcctgcttctcgttgtgtctatttcattggtgactttgggatgaatgggtctcctcatctgtatatgagggggtggcggcagggtatgtcaagtgaccctgagacccagtgcccctacaaattctgaaatcccaagaaggaggggatcttgggagttgtatggaggaaaatcgaacagaaggggctcctggagtggggatgggtgggggttctgtgtagaataattcattaaacaaagggttctgcagcttaaaatatacgagttggggtcaggagcagtaggtggttcatgcctgtgatttcagcattttgggaggccaagatgggaggatcacatgagtccaggagttcaagaccagcctgggtaacatagtaagaccctgtttctacataaaatactaaaatgagccgggtgtggtagcaggcacctgtggtcccagcaacctgggagttgggagaatcacttgagcccaggaggttgagactgcggtgagccaagttcatgtcattgcactccagcccgggcaacagagtgagaccctgcctcaaaaaatacatacacgagttggaaacctctgtcacgtggctcatgcactcacagtcttaactgagcatcatttaagcgccaggttcttaggtgtagccgtgagctgatgagagcagcagccctctgttgctttgcctgtagcctgttttcctgacagcccctgcctttctctctctatcccaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcaggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgcgggctgtgccacagcctggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggagggcgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgtgtgtgctgtgtgagtgcgtcacagctggggctgagtgattccaaggactcctgcccgggtagggggctttaggatgagctctaggtacccccaccccttgaccctccagacaatcagtgagcaccttcatagcctcttttgtaggcttctgaacatgccagctgctctgtccccatggaaactcctcggcctcccctggtgctgcaccttcttggattccctcctcctctgcctgtgccttctccatctttggtgcagtgtttccggcactctggttaggccctgttttctagctgagataatttccctgatctccagcctagcatcccctttgtgagctctagccctaaataacccactgcatgctgggcctcagcccctgggtctctctcccacactgaactcatcccaaatcacactcccgagccttcccctcagctcacttcccacaaccagttcttttccatgtcagtgaagggcaccccctttcacaaagctcctcatgctctagacctggtgagggccacagctgcctttttgaacgtgtagttttgcagtcctccccggcccttacatacacagaagtgtgcgcataagtcgcattgttttgtggtttgcttttcctctactaaatgatgtgcctgctgttctccagcttgttttcttttaatgtcctggaggaccacacaactgccgaagtgttgtgtggcgtgtatgatcacacttcttcagctagggatctggtgatgggaccaagtggattctgttattgcccctcctgcgtcagtacacctggcattgcagcctgaggccccctctagtttttctctccctgctgcccccaattccaccctctcccatttccactgcccagcctcttccctgtagaaactgttcctagttccatccccgtagtggcagccttgccccgggcccttacctggttgggatggggaagggcctgtggcagtgaggtgcagatgagcttaggggctggctgaccagaatccctgatccctgagtacttacaaaattggagcagatgccttaatgggatgcaaaggaaatccagactcaggcgatctgttactgagtgagggtcccacatcactcagggctgggctgcccagctcagtcctctccccatacagttgggctgtctggggcccagagagggtcaggtctgtttctcctgggctgcctgatcagcagtggagtctgggcactccacacagtccgaggtgctctgactggagcttgcaacaatcggggggcctgggaagcaagtgattgagaccaggcttctggcttctggctgaattttgttgcccctgtcctcactccctcccaccttgggggccgtttttctctgtgtgcccctagacagttatccctgccttcctttgttgtgggtgggttcctgtgctcccccagcatggctcttaggacagtccctacctgggctcggcctcgggcttgggcttggtctctggggctggtatggcagaaacatgatggctgtcttatatatggcagggtcctctgttcccatgcctcagttttccatctgagcaatgggtattggaccaggccaatggttcctgacctgctgagcccctttgctctcatccttgtacccaaacagcctctcctgagtggtgccctcatcagatagagttctggtgtcacctggggagaagcacatcttttttgcttggatggtctggccagtgggcatgtgtggggaagagttgtgatgccagcctgacttggggcagagcagaagcactgtttggatggctttggaagccaggaggtgggacctgagggtatggggtctgcaggctgactatgtgttcgttttccaggtgactttgacactgaggctggagctgtgtcctcctcagagcccactgtggccagaggtgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctgctccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaagtggggcctgtccgtgtgtttggggatggtcggtttcatgttccgtcactgtgtgcttagccctttgctcgcaggctgctctccctgctcccagtccagaaggtgcttctgcaccctcgtgcagatggctgtggctctgtggacccctctcacacacatacttgcttgctctgggaaagccctctctcctgagaccccgtgggtcctcgtggttgttggtctgtgggctactgcctggtgagaaatgctggtcattagacccagcacgtgcctctctcccagggccagacatgtctttcatggtctgggtagaactgttacagcctccccattgctggtgaccatgcatcccactgaccttagcttggagggtggggggtagtgtgctgggcccaccctctggagaccctgcccctgctgggctctgttcccccagaggcttgttctcagggcagctaaggtggcttcctgggcctgtcttcccactccccctgggccaggggccagtccactggggcttgttggacctgtgtggcatcctggtggtggtcactgagcccagctgcactgtccctcctgtgccagcctggccttaacactaggctgggatttggagtggcagctgccattgtccccttccattgttcatataggcccaagaagagctactgggctgtgaagggataggtaaccacaacacattgtggctgctgcagtgacaaccagggtggagggtccttgggtcccagaagaggtgatacctgaattggaccttgaagacaaatacaaaatcacatgcaaagtggggtctgggtagagagagccgcacgtgcagagtcttggtgagtctggaacaggaaaatccccaggcgaggctggagctcccagaaccagaaggggcaggagcagggcttggaagcctggctagaaatccagcaacccagggactcagtcccacaacctgaagaatggggatgtgagccacgtggaatcatttgacactactacagggaggaaagaattgcagtggaggtggagtttctgaactctgggccccccgggccctgggcagccatgggcacctcgtcagccccatcagtcacatccatctcatcgtcagcaccttaatggagtgagcgctttattccttttccttcggtcctcccttcccgccgtcctctcctctccctccctcccttcacacctgtgcccctgctgtatgcctgacacacatcttaccaatggtgaccaggcagagtgagggctcagaacaggtagggcttcgcacctgggttcctctgtggccccagaggactcagaatggtgcagaggccaggctggggtggtggagagccaggcctggctggggtggtggagagccaggcctggctggagtgaggtgctgctctgcgacgacagctctatgcagggaggccctctcttcccctgcaccagtctgagggaagagacttaacccggacttgggagttctagtctaaggaaggagatatgacagtgtcccagggacccccagtctgaggtggtgggggcaggaaccagactctgcccaggactcctagtctgagggaagcagcgccctacctagggctgccacccctagggcaaggaaggagtgagggcagtggagtgtgctggccccgcccccacccccaaggagacccgagcaggtccacctaagaatggggctcaggtgagacccagcctcaccatgccccacctggcaccctagcccaatacaaaaggcaaagggcctgggcggccggctttgctgacaggagtggagctagcaaggtagtgagtgggaaggatgacagccctgtcttgggggactcggagagtaggagctgggaaggggagaggggctccccggacagagtcgtctcatagggaacagcacctccagccaggctcagcactacaccaccccaacctggccttggcagggaccctggtgctgagccctgcttgtcctgaggcctcattctgccctgtcgctgctggcaacgcccatgtctggggtgttgtgaagaccccaaagccccttcgtgactccagacgcctctttccctctgtcattcctggcctcattgatgttcctcttcccgtgagtttgttctcactaagggggttgagtcgagccagctgagtcttccctcaaacctcctttggggatcctcggagcaggacccgactctgacctgactggctgtgactcttctcatcctgcagttcctgtgccggagaagggagggccgaaccccgagcccagcctgctgccccagctggtggtgggaggcgggccatggggacgcttcagcccgtggacatggccttgctgctggctatatgctgtgctctctccatgggcagctccccaagaccccacctccagacaccccctcagtggggagcacccagtgcagctcttctggagccctgtctgcccaggagatgggaatgggggaatgctgccaagcccctcctgtctctcctgctgcacatggaccccttttccagggtggcgggaagctgggggcctccttgaggacgctgctgcctccatggggactccaactctggatgttctagctatggcccactcagaggtgcctgtgtcgatgagccctccacccctcctgccacagcccctagcctcagcctgcctggccactgttcctcccacaccctgcctttgtccaagaggggcccagcttccaggtccctgtgatttcttaggacaattggaacccagggtcctaggaaggggtgctgagccccttggaaggacctcaaggggcctcttctatgatttctgggtttgtcaggggatcccttgcttcttcaagagcctctgataaggcatctgcagacccttttcctcctcagatttggatgatgggaccagggcaggcccctcctgtatcccctagctcctctccatataattcagaacttggggtcccaagcttggctgcacctcctcaaaccctgtaaacctcttagacccaatcccactacaccctcagaggggctggggcttcagcttgggccctactacacagaaagctagtgcttctctgcctcctgctgaggccttgatgactcctcagtgaggcctgggctcccagctgccttaagtaggcaagagaccctggagacagccgctactcaaggaggcctgggttctccaacagacctggggagcccgcctgcctttccacaaggcttggtacctcccttgggctagatctggggtatccctgtccatcctttgctgccacccttctgcttgccacttcctggccccgcggacataccaggaccctagcttccagaggccaggtcttccccagccccaccctgccatctgctgccaccctggcatctctaagcccagcaggccacaagagtccctagctactaaaagactggtccccaccagatctgcccagtgcttccccagaggccagtgagcatgcccagcccccagcccttggtagcccagccccttctgggtgttgccagcttggagctttcttctagacctgtggatgctatcctatctggagttagcttagacctctcccctggcctcctgggcacttctggccctaatcccctggcagcctgttttccagcattcctgggactggtggggaggcctctgccagctcagcgggtgcccctctgcacaccagacttgctttccttgcaaccccagcaggaagcctcattctttgtggcatccagcccacccctctgatgtgggccctaaacctccagctggcccagccctgcagagtaggtgcccaaaggtatcttcagcggttcctgtcatgctggtctccccccagggtccccttctggagcctggcaccatagatctcggtggggtggggagtacagctcagtctcccttccccctcacaccactcatagggggccctgtccaccaaggcccctgactgctgggggacccacacccacagcccccttctttctgactgctggcccttccccagcctggatactcgagccctgggcagaggggtaacgatcccaggactgtcttcgcaggcagagaggccacttggtaccaggccctgactccttgggctgagctcagcagcaggcgtgtcaccaaggccccctgggcagaaggggctcagccctgagggcccatcactcgccacgcctgcatgttcctgctaggcatccaccctgaggacccagcttccccctgcccccagctgctggcagccccgtcttgactcatccagggttctggaggccacgccaggaagtagcctgcagctggaagaagcacctggtgtttctgcgtcgcccaggctggagtgcagtggcgcgatctcagctcactgcaagctccgcctcccaggttcacgcagttctcccgcctcagcctcctgagtagctgggactacaggctcccaccaccacacctggctaattttgtttttgtatttttagtagagatggtgcttcaccgtgttaaccaggatggtctcgatctcctgacctcgtgatctgcctgcctcggcctcccaaagtgctgggattacaggcgtgagccgccgtgcccggcctctgcatctttttttatggagctgacttgggtgggaggggctacagactcaagggagactgcaggccaccccttccccactccctggctgggtgggtttccagctcaggagtctgattggaaggatgggaccgtcctgtcacagaggcaggtctgagtagtccaggcccagttttaccctccagcagggcccctttcattcatttgtccagctggctttgcccaaagcacaagtgatgtctatgtggactgtgtcccctgtccccaaggggagtctggctccagtcctggcctggaactcggagaccttagaattagaggccacatctggcagggtggaccagccagggcaggtaccatgttggcagccccagacctgacaccacggctcccgtgtgccctctccacttccgtcctgcacatcacctatactacgtgctgtccctgatgaatccaagctgtcagcttccatcagcttggctgggaagtcaagctgaccaaaggggaatggtgcagcctgagttgggggctgagtaggaatgggcctggtgtggggtgggggaggtgggggtgaggcgggtgtctggcacctctctgcttatcttcccttctcccttgcccataaaggaggcatcttctccatgtccctctgccaccctggggacataaaatactgccccaggtctgtcttcccttggacatagcccacctaccttcctgtgggactcagggctttgttttgtcctgtggcccacatgagaagcagttatccctgctctgctcagctgagagaggacaaactgaggcagagcaggggaacaactctgtcatagtctggctgttaatggcagagtcaagaccactgagtgtctagtggaccaccaggtccactggacaccaaacgtggaggctgtattagcccgttttgtgttgctctagaggaatacctgagactgggttatttatttatttatttatttatttatttatttatttatttttgagatgaagtctagctctgtcacccaggctggagtgcagtggtacgatctcaggctgctgcaacctctgcctcctgggttcaggctattctcctgcctcagcctgctgagtagctgggattacaggcatggaccaccatgcctggctaattttttgtatttttagtagaggcagggttttgagatagagtttcgctcttgtagcccaggctacagtgcagtggtgcaatatcggctcactgcaacctccgcctccagggttcaagcaattctcatgcctcagccacccaagtagctgggattataggcgtgcaccaccatgcctggctaattttgtatttttagtagagacagggttttaccaggttggccagcctagtcttgaactcctgatctcaagtaatttactcgccttggcctctcaaagtgctgggattacaggcgtgagcaccgctcctggccctgagactgggtaatttataaaagaagtttatttgcctcatagttctgcaggctgtacaagcatctgctaggcttctggtgaagcgtcaggaagcttttactcctggcgggaggcaaagagggagcagacgtgtcgcatggtgagagagggagcaagagagaggaggcatcaggctctcctgtgaactaatagaaaactcactcattgaatcacttgaacccaggaggtggaggttgcagtgagccaagatcgcgctactgcactccagcctgggctgtgagtgagactctgtctcaaaaaaaaaggaaggaaagaaagagaaaaaaaaattagaaattagaaaactcactcattaccatggggagggcactaagccattcatgagggatcccccaccatgacccaaacacctcacactataggccccacctccagcactggggatcacatttcaacacgagatgtggatgggacaagtatccacactatgtcagaggcctccctgtcatcagagtcttctgtcctcggttcaggtgcatgctggcttccatgcctggcttcctaggaagtcatcttggccccatggggttgggccgggccactaggctgagggttggagccctatctctcctagtcccagcctgggtctccatcactgactagcccgctctgcttgctgcattctctccacacctgttccctgtagcccaggggtcagtctgggtgcaggcctgggtagaggtccaggagcagattctgccccccagctcatacctcctgtgcaccatggcagccaaaatgcaccagcatgaccaggagtgctggcttgtccctgtaatcccagtgtttttgggaggctgaggtggaaagatcacttgagaccagcctaggcaacatagccagaccctgtctctacaaaaaataaaattaggcatggtggcgtgtgcctgtagtcccagtatagcaggacaagccgcagacaaaacttcgtagacaccgagttgtagaagaagggctttattcagctgggagcatcggcaagctactgccttaaaatccgagctgagtgcacaatttttgtcccttttaaggcctcacaacactaaagatttcacatgaaagggtcgtgattgatttgagcaagcaaggggtacgtgacaggggctgtatgcaccggtggtcagagtgaaacagaacagagcagggagtttcacaatgttcttccatacaatgcctgaaatctatgggtaacatcgggttctaagtcatgagttgatttttaactactaggtttaggccaggcaggcccaggcctggctttgggcctggcgctgggctgcctgtctttgatttcacttccttgtttttttcttaaaacaggtactgagtataaaacaatatgagagagcctctctcttccctcaccagctactcaggaggctgaggtgggaagattgcatgaacccaggaggtcagggctgcagtgagctatgattgtgccaccacattccagcctgggcaacagagcaagaccctgtctctaaaacaagaaacaaagtgcaccagtgtgtggattccagcttctcctggtgtgtggacatgacctcactcggccccatcagtgagtgggaggctgcctgctgtcttccagaacgttctcatcactacacctgtgttcctcctgcattctctggcaggctttgtgaggggacctgtcacctacctctctggctgccctaaggcccagctcaaaccttccctgcccctgagaaccttttcctgaagagtcttttccccactggcaggccttcttatttcagagcttttggtagggtgagtaaaaggatcgactctctgctaccagcctgggaggaattgtccctagggttgggtctctggatggcatatgagggtctagaccaggacccagatgactgtaacctgaagggcaggacctcagctgccccagcttgacacagccccttgtccagcctgaccttctgggacaggcccgacccctgcatcctttggtcttggtccctactgggaactctggttaccctggcttacctactttgactccaaaggcaatgctgacatcccccgtgagacacagtgacagactgagactaacgtagggttacctggctcagagtcaccatggccaggcagaggtcaggtcctggcctggttcaagatcttccccaatgcccttctagctctggtgccctgcagggtctaccttggagcacctggagcccgagaagctgcccctcacctttgagatcccagggaccccctccctgatcatgatgaaggcggaaccaaacccgctgaggtgcctgaaggaggaagggtcagcctctgcctcccacggcctctctgatggggaggatgttatcgcagcagcgtgagctgggagcggaatcgggaggataggggttttctctatgggtagctctgggctccagggtggagcccttttaacctggcccctcccctgtgactctccttggccccaagcaaagaaagcagcttgcccgaggtcacctgacaggtaggaacagagtgggacctgggttctttctcacccagctgcagctcccccggcttgccccacagccccttccaccaggtgacacagaacctggcaggctgtgccccatagaagagttcactttccttctggtgagggatgggaaccaccttggggcgggagggatgaggggtctgggggctctcccagccctgcctcacatttgaaggatggcatctgggtggcagcatggtttaggctacacagggcggccccgaggtttatagcctggcctcgggcggatgctgccatgccaccttctcttttgcacatcctgacctggcaccctacctagttaaaggtcctcaggtctcctgggcattgcccccactccctgcccagacacagctgtccttgtcctggactaatcttcagagattcttgtccagcccacagctttgctggacatcgcaggctgggccaggtcccctgcccagcactaacatctctttgtgagtctcaaccagactgagctgtagcgtcagggtcagggtaggctctgacttaattgatggtgtcaataaacccccaggacaggggggtttattgatggtgtcacatctgcttacattcttggcctctatggtctctttggggcatgatacccctctgtcccatgcttaggtgcccacatgtggccacaagtgcctttcctaccactatccctacttgaggccggtgtccaggaacctgtggctccaggcagaaggctgagcgcagagccaggcctgggcagacattccgcaggggctgcaggagctgacagccctgaccacccagcccgtggccatccattccccttcaccgtggctggcccctcatccaccatccttccaggggccaggcctgggcccaaactgacttttgcctgccccagtccccctcgtgttcttggctgagtgtgatggtcttgcccgtttccttgattatcctcaatcagaggtttatagagccacttggggacatcacatctatctaccaggtcctcaccagagacatgactgccttgggccgggcctgggatagtcaggggtcagactcacctgttgggacctggcttcagcggcttcaatgtgggcaatggcctgatgggcggctgccccttctcctctgcttgggggaggtaggagaggaaggtcaggcaggagatctgcttccggcccacctgacgctggttggaagcagggcgcccacctgtgcctgtctcacctcgctgcaggtgcatcggaggctgaaccgctctcctgatctcctgcaggtgcagattccacatttccagtgggtgtcggggtgggctccagagctctcctggccctagggaaccctgggctccatgaggccttggcctagccagattgtttcccacactgtcacctccccataccgtcacctcctcaaacatggggctgcatgctctgtgccctgggtgggacattggaaggagttccaccttccaggtttggatcacagtaaagcctctgccatggggatgtgctggctgagacagatggggttgaaccagccctgtcactttggccttgggcaagtcacctgtgccttgcttccctttccccagcagccagacggggataatagcacccatttcacccgtactcaggtgctcacttgttagcgggaactgagtcccagaggaggtgcaggcagagccatcgagaaagcactgcagctggacctgggtctgagtcgcagttcctggctgtgagatgcgtctctccctctgtttattcatctgaaggacagggctgtgctgttctggggtcactgtgacaattcagctggcctgtgtgagttggtggtggcttcctgagatggtttgaggtgggctggaggtgtgtcttgaatgccccctcgcctccatggggaagacccacttagggaagactcgtggctgtatggaggaacccacgttccctgccccccagctgtcctctgtcctttcccagccccctctgctgtcctgcagtttctggcagtggccatccagcttgttggtcatctggctggtccactcttccaggtggaccctctctcctcatgtggtgcaggtcccattgcaccaccaccagacaggccatgctagccccagggccccctttccctgttacccagcccccacccccagctatgtgccccctccctaaagcccactgtgtccaccagctgtgtttgaactgtctgtgtgcaagacctcatgcaaagcctgaaacagcctggcttgtagagggccaggagaccaaagcttgaagagagagtgacggtctcccagagcccacttagcctcagccccagggctgtgtccatgctggtcctggctccattgagccaattctctcccatgacgcctgtaagggctccagtggtgatggaggtagctggagagaacaaggctgccataaccctccctccctgagaaggcccaatggggaacgttttaggcatcagggcattctgggggcatcttccagggacccctcctacaccctgccctgccctggctctctagtgagaaattgcagttgcttggacagtggggctgacccaggacaaatgcatatattgggctggtctttggggtgctggggtgggggcatgggcgcttcagggataggaaggagaggcctgtgtattccagaagtacagaggaacctggtgccggccacagtcaatcccgatgtgatgatctttctacccgccctctttgatgtcttggtgctggctgctgtctttggccacataagctcatggtctgggttcctggggtcccctcgctgggcctccacactgcctgcaggtagaggagccttcaggccaggactatccttggctcccctttccaggtcatgggttcaaagaccattcctgggttccaccaccgccaagcctcaatggtgtcctgatgggcacgggagctgctggggcgttctgggttaagacccttgcctatcccagtgttcccccctgcagtggggctgcaggggttggcctcagtctctgccctgggagcctgcctcaccttggcctggcggccccacacctgccctggaagacccccccacactcagtggctctgattcactgtagagcagccagggcccccgttgctcacaccctctggcctgaggctgactggctctgtggctgggtttgggggtcagggaggggggtgggccttgccctcagcagcccccattcccactccgaccccttttcagtcttcctcctcttgtgggctctaccctggggcgcccccagctcctcacaccatatgaccgtctaagtatctagaaatcagttttttaaataccaactttggattgcttcctgacttttccatacccccaaagggccagtgtttgtcttaggactgacagtccctccagctctactgggccagaccaggcgggcgtaagggtgcccctgccccagccctctttggggcgggcttctgtccccttcctgctgcctctgcagctgagttcctgccccagggagagaaacttaacccagctctgtggggatgaaggtgccctgcaaagcgccacgggagggctgccaggctgccgtgttctgctgtctgaggcccgccatgctgggccacgcccagagccggcctgagtgcccccacctcagtgggctttgtgatgtgtatgtacaggatcacaccttgccctttcctccggtctgacccttccctatctccccgcctcaaccccatgtcctgtgtgtgagcacccagctcactctcgttcctccctctccaaagtgtggtccctggcagcacgagtggcaagagggtcagcagagactgcggacacctgagctgtgcctaagtcctctgtgtggtctagctgtgtgtgctgggggaggctcttggccaccatttccccctctgtaaatgagaccgatacctgtggcatggagggcgggaggctggtgtgagtgccaagcacttggagcagggccctgagtgagcatggacgtgggagcaggggtgtttctcaactttgtgcaccttggggatgggagtggggctccccgcgtgggttgacaaggcattgctttcccccaccccacctctgtcccagccctgcaagtccaatccttgggggttttggagggaagaagccctggctgtgtgtcctcgagctggtccttggccctctctggctctgagttctggggaaagtcagtggtgctggaactccggattcattcctcagggttgaggcaccgtctgtggaagccatggggcaaggtgaaggcagggagaggagaggtttggagtttgggtttcagcagagggagcagcagcatgaggggtcacctgtgtgtagaggaaagggagtgaaggccaggagtggggaatgagtctgagtgcacccaggacggtgctgcgcctcctcccacatccacttggccccgggggagggagaagaaaggccataagacaaaggggaagctgagttgggtccacacatgtccttccaggacctggaggtgccactgtctggccctcatgcagtgggaagtgggggaaggaagattccctccccacacctcctgttctctgtcccaggtctcctggcctcctgtgctcctaagttcagtctctgtcggcccccaacatcatttctagtgttggtgggagggagctgggaacaggcgaggggtaggtggggcctgcttgggggagtctgcctgactgcctgggccactgcccacagtactggggagcttttctggcacaccaactgcaccccccaggcactgccaatgacagcccccggggagtgtttgcagaaggccttggcaggaggcgcggtggaccccacccagaacaaacaattggggtggggtcagggagaaccgccctccacttacctgtctggagagggtcctctgtaccacactgtgtgcttctacacacccaggctgaacaccccatgggaggccctccactttagcaccttgacaagaagggtggggacactgggatcaggcccagccccctggccccaaaccgtgcaaccccagctggaggatgaggagatgctgggcttgggtgggggaatcaggggtgtaaaggggcctgctcacccctcagcttggcttaaaggctcaagaggtcaaaggcttaggctgcccctcaggaaggcgcccgggcccagccagacactcaccaggacaagggccagtgtgacgagcaggaggcccaggatgaggagagccacggcatagcaagggatggaggcgtccagcggactggagacttcagggctgggggtgcctggagcagagcaagaaggccatggccaggcggggccctgcctcccagacttctgagaaggcagaatctgggctcagaaggtgctgcgggaccagggagctggggctaggagcaccttggagggctccatgaggaggggaggcaggcttcagatcagggcatgtggaggcagcgagcccaagggaggaggcagatggacagagggagggggcctgcagagggaaggaggtactgaccgaggtctgggatgaccatctccaccaagaggccctctgccttccccagggtgtgcagaccctggcgcaaacggtcccacatgagagcctgggctggcgccgccctgaagaaggtggcacccattctggcagtcagtggctccggcctggtgggaggatcatcacagacttcagggggctgggcagccttgggggactaggggaggtcatctcttccagcctcctgccctcaaccccagaacccaggtctgagccctgggtcacccagggccaccctgaacccacgggaattcctccaccaccacttggtcaaagttctgcagaggtctgaggatgaagttcagctggggggtcaggagaggatgaagagggtcacagctctaccaaagtcttgtccagtcatcccccatcttcccgaggcctcttcctcgaccccccacttcatcccgccacttcacccatctcgtcagctgcccttgaagtgcccagaactcagggctggttttgtcctccaaagccttggtgtagggctggaccaggatctgcagccaaacttcatacagcaccagctctgccttctcccctagagtgatgggggtggaggtggcatcagcctgcatcccctctcctggaagccctggagtgggacacacacccaagctcttatgctccatccaggggtcagctgccactggtctaaaaaccaaatttcttgctgcctgtttttgtgtggcccatgaattaagaatggcttttacatgtttaaatggttgaaaacatggaaagtagaatcgtatcttgtgacacatgagaagtacgtgagatgcaaacttccatgtccataaagaaaggtttccgggaacgtggccacgctcatttgttgacatgttgcctagggctgctttcttgctaagaggagggtttgagtaggtggtgacagagacccagtggcctgcagagccttaaagagttcccatcgggccctttacagaaaatgcttgctaacccctgtactaatccatctaatggaatacactgcccactccgtgagttgatcctagtaggaaatgttgctgataatttaacagctgctgcttttatgttttattttgtccctgatccggtgggagacacgtaagaaaattcactccctgggtggaggtcatggtggggcttgtggccatcaatggtgaagcctctttaagaggacacatggggagctctaccatctgttgagagggttgtgaggggccctctgtgttgaggaatgaagagggaacgctgcctgtgtgctgggagctggctttctggggagcagaagagatggtggttcgggcctgcggaggcagaggcccaaaccaatctggtctctggggctgccggcagggagagtagttgtgtaggagtgagtgcaggggcaaagcccgaaggagggcacccctgaacgcacccccgaccgcacccccaggaggctgtggtggtgggggtggggcagcactgtaggaggaccagcaccttctgtggctgaggggtcctcggagagcagctctgggctgtgcgtagctggaggggactgatttgacccagcgctctcctaacttgggtgtggaacagctctccctgtttgaatggcaacaagcttgcagaagtcatcctgcaggaggccccaagaggagatatgggcttcttgcagcccctgcactggggcagagctgagggcttttgcccctgacttggtgggacagatcttgtcatgcatgtgaggactcagtgaggtcctgggcaatcagggaggtgacgggaccctctcatccttctgatcttgactgcttctcgcctctgtccagctccttgctaaagctctatgccccattcctctctgtggccccaacacatgagcaagtgttgtctgaaggaaattctgcccattctctagaaggggaacaccaaggtttagagagggaaagagcctgctggcccagagacacacagggattgcagccccgactcaccattggccacgatgctggatttctggaggatgggatctgttatgttttgggccaagtgattagccaggccttggaggtgggtagtgatgggagtctggaacttgtattcgatataaacacccacccactggtccgcattgctagagaagcacaaggggagagtgcagaggtcacaagctctttgccagcacgtttctagagcaggtagagtcccccaaaatgcacaccctctggcgtgggggccccctaccttctaggcagagctagcttacacagccaagctacagctacctggggcaaagtcctttcccagctagccccaaacctacacccccacatcctggttctgggtcacagagctgcctccctctgtcccagggcagcccccaagagagcagcagggcaggctgagtggatgggagggggactcgacccacctgaagaggagcaggggcctctcctggggactcgccttgtagaatcctgacaccaccggtgtgacctgtgggaaaccctggaggtcagggcgggcctgggagctgtatctcctgagacccagtgtgggatggggaccaggtgaggtgggaggcaggacctgggagggagcgcacccttaaacacggcgtcctgggtaggagtgtctgcttacagagcctggctgtgttcccattcggacagtcacctcctccttcagagaaccctctcccccagggtgccctctatgactgccttccgccatagtgccatggctgggtgctgcctccatgctgggaggcctgcttcaagggaggtatagtgagtgtcctcactatgccacctcacctgttggaggatctgcctttccagcaggacaaaggaaacagaacccggtacgaggagctgcggcaggaaggacctcatggctgtgaagcggatgctgatggtctcccgggccagggtgatcaagtcggcccctgtagagccatgggtgagagttccggaggcgccaagaccctccttgcccaccgcaccaccaggtgcttcggggtcagggcagaagttggatccctccaggaagtccacccagtgctccccctggggaggtgaaaaggcactgcggtaggggcggctggggatgggactcaccatcagaggtgaggctgttctcagccaatgagaggttccccagcatgtgccctgaggtcttcactttgcgatacaaagcccagaggagttcacagggagaggggcctggggcacggcccccaaatacaagggaggcgttcaccgctacagagccaggcctgtgggggcagagccacgtcctcagccagggccagtgggggcatgaggggtcctgtgcacccggtgggggccaggctggtgcacgagttggcatcccaagggagggaagtccacaggggaagtcatgggtcacgcagagaagagcctccctgtgtaactcaaggcaagtcacctcacccgtctgggccttggctgcctcctcagtaaaagggagataatgatccctttcccagaggattgctgtgaggcctgaatgactcagccaccagcatccaaagcaggcactcagtgaaactgagttcccttggacaccccaacaagccggctgtcatgggaataccatgaatcccacccagggagctcccagggcagggttactcagccaggctgcagctggctgtgagctctcagggtgataatctgggtcacactgagaaaaacatctttggctgcatcacaaggagcaggggctctggagagagggagatgacaggcctgaagaatctctgaaagccagtgggagatggaccaattgcccatggcctgaggaggtaccctggcctcagtaaggcactgaaggagctttcggggagagaccaggaaacaaataagaatccagaataacttttgtccttcccctgagcacttgcgtgctgtgcatcttgggggtggggagagaaaacttctcttcaggcccagggcagggaagtcatagaaggcttccatttattaaaagggaaaactgtctgagcagctcaggagcatggcctggagagagagtgagcttcctgtcactgggagcatttgagcctttaaattacttacaggattcaaagcccacagtgagctcacaactcaagtggggctgcagtgatttggaccttctcagcctttctcatgacatggcagggctgctctccgctggcaaatatggtctcggtctccctcaacatcctcttcccccagacgcttagagtggagggccctgcccaagggatttgcatccctttgcatgtcatttacaagcctgctgcccttgctgcctctgccttccccactgcactcagacaatgcctgatgttcctgcccacatcctgcagctggaatcagggctcagggcaggccaaagggcatatgaggtcacacagcatagccagtggcagaatcagacgtgggcctcctccctgcctgtccagggctcttcctgcctctgtccccaggtgctcctgaacagggggtgggacgggcagagctaggcatctgggacagtgcctttgtggctgagaagggtcagagcagctggtgggtgatgggtgggccctgagagccacgtgcactcacctgaagaccaggacaccgatgccctggaagccggggaaggcctcgtggtagaggggctggagctgaggatgggcagaggcatggaaggccggcacgtgccaccccccaccttccctcctgccctaacccaccccctctctgaccctaccacctaccctcgtccaccctccatcatcttggcatggtccctgcaatggtccctcacggaccacctgggattcccaggccccgcccaagctgttcctcacacagtggccagagataacctgccagtcatcctctgctgaaagcctcaaggtctgtctgggcgtcgtggctcatgcctgtaatcccaacactttgggaggctgaggcgggaggatcgcttgagcccaggagttcaagaccagcctgggcagcatgacgaaatcccttctctaccaaaaataccaaaattagcccggcatggtagtgtgtgcctgtagtcccagctactcgggaagctgaggtgggaggatggtttgagcccaggaggcagaggctgcagcaaacacccagccttcctaggttttttcctctctgccgttttcttgaaaatcgctctccaatgcagtcattctcagctctgcattggacagctgccatgttggcctgccatccagacctctctcacctggacgactgccctgctcctaacaggcctccccttctccctctcccacccctgttccaaatgcttctctttacagcccctctccccggtgtccctgtgcctctgctgcctccaaccacctcttcacctcagggtcatcacaggtgctgttctctgcctagaaagcccctctgtgtttcatctggccaccttcggtgtcccagttaaaattcccagttctcagaaaggtgtggtctgggcagccccctctccccagcagccccctctcgctgctatcctgtctgcacttcccctttccatagcttatcacaactacgatgacatctggattcatttgatcactccttgtagggctgtcctctcctccagactgcaggctccctgagggcaggggccatgcttgctttgcttactgtggtgttcccagcacttagcaccatacctggtaccgtaggtgctcagttagtggtaggaagaaatgagttagttgactaaatgaagggatgaactaataaattaatggacagagactcagagttccccctggatgccagtcaagaaatggcacttgctggctagggcacccatggttccagaaccaaggcggaggcggatttggttttggctgcaggaactctgcctcgctttgccttactggccacctgcacgctggaggaggggccctcacctggtggtggatgatcttacgcagcagctggtgcttccaggaggcagggttcaagagtgcagccgagaaggcttcattggtgattgtgaaggtcacggagcgcgtcatgtgactgggtcctggggtagaggagactgagtcctggaatgagaaggtctggctgcgataaggcagggcggaagactggatggggtcagcacccccagggacccttggggagctggggctgggtggggcagagggaaggcgggaggaacatctgagagggagggtggctgtggtggctgggctggcagggacccctggcccaggctggactgtcccctgaagtgtggctggctctgcaaccatcaagggtggtagggtgggtgggaggctggaggatcagtgggagaatctgtgcttgtgtgtgggaatagacacagaagggtctgcagaggttctggctctagtacttacaggggaaactggggccaggattggggatagtgatgcagttggtgactgaaatggccattgtggtggggaaagtgacagtgacagcgacaaagatggaacaatgtgtagtggggacgaggacggggccaacacaggtgagaggcatggggagaaggacagtgatggctgtgaaggtggtgctgctgagggcgatggcaacgtcaaaggaacactgggccccgggccccggctggaagccacagcctctctgggtgaccctgaatcccctatgaggactggggagggacctacaggggtaagaggctctgtgacagccaacgtgttaacgatcgacgcaagcacaaatgggctggggggttctgaggacacagccttccccgtggtccctggagccaatgtcagcgatgaggaggcttctgggccaaagctgctagcccctgacgcaggcagcatccaggcatggggactgaaggtgtgcctgcttgggagccagggcatccgcggtggggatcccaatatgggtgcagaggtggtgggggcagaggatgttccagatggctgctgggtaggtctgggggtgccagaggtcctcagggttgcaggggcaagagcatgaattgtcacagacaactcaggggcctcactggacttttgcccagacccgagataccttgggccaagagaagctgatggtggtaatggggcagcaatctctggagatccagggaccaacatctcctctgcaggtccagccacagatccagacacaagtccggccacagaggacactggctgggattcaggggttctgtgggctgtgggccaggccagtgctgatggggctggtccaggtggggccctgcctgggaccccagcagttcctgaagggacagcctggtccgaggaggaatccaaagacaaggcgagaggagcttcctggtccccagatacctcgggagagagggcttctgcccttgtgctaggagcctcccctttcctctccgctgagagagagactccatcaacgatggctggcaggatgttcagtgacaggagtgtcttcttgctgttgccttgcaaagcggacgtgccaggggctgagggaggccagccggggtctttgtgagtagaaggaaggttcagggcggaagctgagaccatccagagagctgcaaacaggagatgcctgttctgcctgccacccgggggactggggggtgggactgcccacagcctgtcagatgccacaccttccctgccacctccctcgtttgggaaggggcctgcggagatccaaaccctggcccagctccggccccaaaccactgagctaccccaggaaaacatgctgatcctaacccaccagagctgagggaagcaggaggggacactgacactcctcaaggacccctccctgtgcctcccaccccaacaccacccatcgcagggtccctccccaagggcctcaagagctccccagggcgatgctgtctccaggctgggggccctggactgttctgtttgaatgacctgtgaggtccacgccagcctgagggtgccaggaagtgctgcccaatcctcatcataagacaaggctgttgccttatcacatcctcagaacacagcaggctgacagctggaccttaaagtattttgtggggagggcgggggccatctctgaaagccctgggggctaattccacacctacctacaagtgtacactgagatccatgcggggtctgccctgtgccaggctccccaaagctggtcaccctgagtgccctctgggagccccaagcctgggggactgaggagtggaccctggccatgtcttggtatcccccaggctgttcatggccagacccacatgaggacaatgaaggccaagccagatgtggaaattgattgagaaagaggacccctggtccaggcccagcccaccctaatcccttaccagccaggagaatcccagcagccagaagccactgcacgcccatgctgaaggctctcaaggcttctaaggcttcagaagcaggtggcaaacacgaagacactctcgaatttcccttcaagaaaggactgatgttgcccagcctttcccacatttccacccctgtggctgggggtgcaagcctggctgccctaactcgccgggtgcccttcagcaaagcccttgacctctggggctgcagagtcttgaatgggggcagcctgtgcctgccccacagcctgggaggttatgggcctgaaaacacattgaggaggagttcagagtcctatccagtcttcaaatggaggtggtgaccatgccggtgatgggggtatgagtgtgggtttgggtgtgatgtggaatgactgtggtgagtgtagttgtgaggacagtggctgcagggatgctggaggtgctgattgtggctgtggtgggagctctatgtccaggtggtatggagctcgctggggaggggttggtccatgtcccatcccctggccagctcctgtcccagtttggtcctgctcctattccatcgggctgcgtgggggtttggagaggggaagatcagaagagaatagtcctcctcctgcagtgcttttcccgtgtggaatcctgatcagagccctggactgggcagggtgagtgtggaggtgggcgcacctggatagaaccatccttctcgggtcccctgcgcattcctctcatgcccctgccccctccccagcctctgacacaggagagggccatggcagccctaagaggcttagagagctgccaaaggacaggcagggtgggaggctggcgcctcgtgggatggctcaggtctcagatctagcctcccaccccacctgctggggtcctggggagtttccaaagcctctcccaccaggctcctggtgtctgtgtgaccctgccatgatttgtcccaggtcaccagagcctcctctggtgggaagataatggctggaaaccttcaataggaaatcagacctggagagggccttggccagactcctgtcctccccacccagctccttctacctggataccccttcccccatctcctgggtcctcatctcctgtcccctccagatcaggctggctggagccaaagctggggggcagggctgtctcccctccccgttggagctattttccaagggttggggaaagcaatcctccacaacccacccctccaccgcaaggcctgtaacccaggctgtacacacctcccaaagcagcccctcttcctcccagttcaccacaactcatctgtttggaaaccttgcatcctccgctgtttcctggctcctctgggagaagctgttaaggggccagcctggccaggtcggggtggggacggatggcttcccaacgacagggagggaggcttgggcctttggcaacttctacctcgagtcctggtttcattggccccattctcccccaagcccttccacaggccacccatctaggggcccgtgaccccatctccaggccagccaacccactctagcacccccattctgcctcccttccctgtgcccccaggatgcccaggtctcacctggtggacctggtgctgctgagaagcctctgtctgtggaggcgctggtgtcccacagaggcagggtgaaagcagcatcagcaccctctgcccaacccctgctgggcctggaagggccacccctttccctggcacactcagggccaggaagatctgctctctgatggctctgcccacaccctaggacactgggtcctcatctcctgtaccctccagatcaggccggctggagccaaagctggggggcagggctctggcattgctgggcctctgccgagagtctgtcagtgctgaggcctgcttggcaacagtggggaaagcagcagctccctgggacatgatgagtgataagggacagaaacacacctgaaggccattccatgccatcgggcagagggctcaggatccaggagtggggaggtgatgcaggaagccaggcacacgctcccttttcccaccaacaccctgtcctgaccaaggacaattttggagaaaactcaaccaagaactggagatccaggctctctgtgggccagggtcagggttcagtctatgtctaagatcagggctcagagaatggccaggatcagggctgagtctgtgacaagtgtcagggctcagtgtggggtcaggggtaggcgagtctggaatttgaatgcttgccaggctagacctaggctctctctcacactgttcttcccctgccctaccctctcatcagagggcatctgaagacctgaaataacccatcctgatacctgaaataaattggatgggaactctggcctcacatcaataaatgtttcaacaataatactttgaaaacagccacagtgtccaggacaggatgggggttgggccccgagggttgggtgatattccttctgtcatgagccagcttcagccccctgggccagggcctccctggccctctagtccacgacagcattccccttctcctctgagctccagagccttgctaggcctgcagtccaggtgcagttacaccctgctgttccatggtagagtcctgcccctctccacacccctccatgcgcctccctgcacagctgagcacagaggggacccttctcccactgaccgttcagggccgtggcttcccagctgctccattccacttggctccctggggcaggaggagggggctgcacgaggctcatcctgtatccctcctccagggccagaggaggggctgtgtggaaccccaaagggtcctggagagtagtggggggcagcgggcaaggtggggccccaaggggaggagcagaacagaagcaggtcactcgggggctgagccaggaagacatttgcctagacaaacgggccatggggccagcagatgatgcactttgcctgtgtaccttccagggcaggcttccctagctgcagggatggggggccaggctggcctgctctttcctgcctcccagcccaagctccggtggaggcggggcggcattccatcttactctcctgtgtggcccttggcaagtgcctgccagatccagaccttaatctcctatctgttaccttactcatcagagagaagtgctctgaaggtctgggggcccaggccccttgatcaggacagaacttggggctcacaggaagaacagggaagaaagggttggggaacctgggaccctgcacatcgtctgcaaattctgaattctccatgtggcattcaaggcctcggtgcttcagctgcagcctgccttgctgacctcagtcctggggctgggtggaccaggaagtgctcacagtcccatctctcccccatccctctggtcacatgccagagccctccagttccctccctaacccagggacccagtcaaggctctctgagggcctgggaagggtcttgggtttacagccctgctcactgcctcatcacccagatatcgagaatggatgtcacacacatcttccaagcaggttgacaggatcggaattggtctgtgagccactgttgggggcagggatgagtggatgtccccgctgaacgaggcagactacctgcctccctgcccagccttagtcccactggctgcctgtcccttctccctgggaataatggtgtcccaggcaggaaactcggccccaaaaccaagactttccctttatctccaaaggcacttcttcctggtcagggccctgacacccaatgtcactcactcctcctgagctctcaggccaggctggtatctgtcctgctagagcctctgcctggatcctctatgcatggtgttgaaagatcatttttttaagaaaggaaaatcttgattctcatatagataaaaattgaacatatgtaaaagattgtatttaactcattattaacgagggaacctggagatgttacaaccagttcaaaggagaagtcaaagaagcatatatttatatggagtcaaggaatgttgaaataaatttacaaacagatatataaagctggcttttttacttgggggagggagtcaatttaacctccactggaccatttacttgcatgattatagagatgaatgattttgcattgcgatctgtcatctgcaaggtacagagttgtaaaacagctagaaggcaatgaagggctagaatcattagtcagaagggtgggctctaattgaaacaatgcagttttccattggagacatccaataatgtttttttcttattccaaattttcttacagtggtctgtctctctgagctgtggggcagaagaagagggacttaggaagtattggagatgtcagggcaggcttcctcgaggaagagaagacaagggaggagaggagagggactagcagagatcactagttgtccccaagtaatcctcttattaaaataattaattgggagcatgactgaggtggctatagtactctgagttcttttttttattattaaaaaaaattgaaacagggtctcgctctgttgcccaggctggtcttgaactcctggcctcaagtgatcctcctgcctcagctttccaaaatgctaggattacaggtatgagccaccatgcctggccataccctaggttcttttgtaagcaaactgaaaccccactcatcatgaacagccatatcctagaaaacaaaattttacaaaatcagaaactgccaactaacctctatctagggacttcaccaatcagaaaccaccaactaacctctaactagggacttcaccaatcagaaactaccaactaacctctcactagggacttcaccaatcagaaaacaccaactgtcctatagggattttaccaatcagaaaccaccaactaacctctaactagggacttcaccaatcagaaatcacccactaatcactaactagggacttcaccaatcagaaaccaccaactgacttctaaggacattaaggccactgctccactttaaccaatcaaatgttttctttgccttgcttttgtgtgcaccttatacaagctttcccctcgagctccaaaccactcgctgtctggcactgcctgattcttgaatcactgtctgctccaactcctaaaattctaagtgcttaggtctctctctctccctctctctctctctctctctctctctctctctctctctccccccctccctccctccctccctccctctctctctccctccctccctccctccccccccctccctctctctctctctctctctctctctctctctctctctctctttctttctttcttttgagacggaatttcgctcttgtcccccaggctggaacgcaatggcacgatcttggctcactgcaacctccacctcccaggttcaagggattctcctgtctcagcctcccaagtagctgagattacatgcatgtcccaccacgcccagctaatttttatattttcagtagaggcggggtttcgccatgttggccaggctggtctcaactcctgacctcaaagcgatctgcctgcctcagcctcccaaagtgctgggattataggcatgagccactgtgcctggccaggtttatcttttaacacatccttaattagtaacagtgttcctgctttttaactgggcacatggtgctccagaataaagactatattccccagcctcccttgtaggtcggtgtgcctgtgtgacgcagttctagccaataggataaagtgtcatgaggctgtaagtgcactagacatccttgttaagtcaccttaccaattgtgaactgccaccttcagacttgtgttggtgtgagagagaaataaacttctctctcatttgagccactattatttggggctttctgttcttccctgtcctcgcctgagttatacatccacgcagggcagaagtcttgcctgacacgcacccctgccccaccttggcagcactcaactcagccaacgtaagtaggactcactcagtggaggcggagggcagtcagtggacaggcattcccttccagtcagcctacccttccaagccttcttggcctttcataattttctttaccgttctgcatgtctggagtgaacacctttcactctagatgagggtacccctcattcttcccaggctcattcctacctccatgcttttgcttctgactcaaggagcaggcagtatgaatagacttaaccaaggaaaaaaatgggaaaagctgtgcaatttttacctttaataaaaactggctacaaaaaaaaccccaaaatctgtttgaaggcatcaaagagttaacacaatagtgaagaatttctagactaagacacaggaagagacagcaatccagagaggtaactcagtactcggagctacttttcacatgcggttgttccccacctctaaaaaggcagctgagaagctgggcagtacatgttgaacagcgtctaggtgcaatggggacaaaagtttgagtccagggactgccaaagcctggggcagggtattgtgtgtagctctcataaacccacagaccataaggtggggacaatgaaaggctgtaccttgagagttagggtattctgaaagtaaactgaacctcgcagagactgcagtccagctttgagtcgcaattcccccagttttttatgtttattttattattattatttttgagacagtctcactctattgcccaggctggagtgtagtgacacaatctcagctcactgcaacctccacctcccaagttcaagtgattctcctgcctcagcctcccaagtagctgggattacagtcacctgccaccatgcccatctaatttttttgtatttttagtagagatggggtttcaccatattggccaggctggtctcgaactcctgacctcaggtgatccacccgccttggcctcccaaagtgctgagattacaggtgtgagccaccgcacccggcctcaatccccaaaattgaatttaaaatttttggattgctagtgtattcaggtatgtggaatgggaaaacagaattgtctctggaggaagacaacattatcgtaagcctcaaagcattacaaactgatttttaaaaaatgtttggcacacaactaaggtagctagactcagtaggacacaacacaacatgaaccaagaactatcagaaagaagcaacgatagaaacatgctcggagattccagatattggaatcagacacaggctacaaaataactatacttaatatgttcaaggaagtaaaatataagatgcaagagtttagaaaactacaaaaaaaatagcaccacaggtatttaaaaagtaaattctaaattgaaaagtacaatagcattaacttggggctcagtggctcatgcctataatcccaatactttgggaggccgaggcagggttactgcttgaggcccaggaatttgagaccagctggtggtctgtgcctataggtctggctactcaggagggtgaggcgggagaatcacctaagcccagaagtttgaggttacattgagctatgatcgcaccactacactccatcctgggtggtagaagaaggctctctcttagaaaaagaaagaaagacaaaatacaataactaaaattaataattccattcatggtttccagagccaattagacacagttgagagagaattaatgaactggaagatattgaaagtaatggctggccaggcgcggtggctcatgcctgtaatcccagcactttgggagacagaggtgggcagatcacctgaggtcaggagttcaagaccagcctggccaacatggtgaaaccccatctctactaaaaatacaaaaattagccaggagtggtggcacaagcctgtaatcacagctactcaggaagctgaggcaggagaattgctcgaacccaggaggtggaggttgcagtgagctgagattgtgccaccgcactccagcctgggcgacagagtgaaactccatctcaaaaaaataaaataaaataaaataaaataaaatggcaaaaactgcaattactttttcaccaacctagtaattcagaagaaaatattcagaatgaaacatgaagggacaaaaaaaataaaacacacagaagagaaagtaagtgatacagaggatacactagggatcctctagagatatattttcataatttaaaaatattttgtcatttaaaaaaaaaaatagtgctaagataacaggcgtgagccatcacacctggcccaaatatctttattttgcctttttatctgacagatattttcgctaagaatggaacttgaggctggcagttattttcttttggtacggtgaaggtgtcattccatggtcttctggttcctgaggtttctgttgagaagttgactgtcagcctaattattgctcctttgaaggcaacctgaattttttctcagatacttctggggttgcggggggacaaaaaagggatcatacactcccagagtgctggattacagggtctcactttgtcacccaggctggagtgtagtggtgcgatctcagctcactgcagcctggatctcctgggctcaagcaatgcttccaccttagcccttcaagtagctgggactacaggtgcacaccaccacatatttgactaggccaaatatacctttaatcagcatcccagaaaaaaaggaaagaggggccaggcgcagtggctcacagaatcccagcactttgggaggccaaagcaggcagatcgcctgagcccaggagttcaatactagcctgggcaacatggtgtaaccccgactctacaaaaaatacgaaaattagccaggtgtggtggtgcacgcccgtggtcccagctactagagaggctgatctgggagcatctcttgggcctgggagctctaggctgcagtgagcacttcagcctgggcaacagagcaagaccctgtctcaaaataaataaataaagggatagaaagagataatgaggcagaagcaatattttaaaaaaataatgacagagaatactttttaaattatgaaaaacaatagttcacagatttaagaagcctcatgaaccccaagcaggacaaataaaaataatagtacacctagacacgttatggtaaaattgcagaaagccaaaggcaaaaactttctttaatcttaaaagtatccgagccagtcatgttggctcatgcctgtaatgccagcactttgagaggctgaggtgggtggtttgcttgagctcaggagttaaaggctggcctaggcaacatggtgaaaccctgtctctacaaaaaatagaaaaaattagtcaagtgtggtggtgtatgcctggagtcccagctacttgaagtgctgaggtcgaaggattgcttgagaccaggaggtctgggctgcagtgagctgagattgcaccactgcacttcagcctgggtgacaaagtgagaccctgtaatccagcactttggtagtgcatgacccctttttttggtcccctaccaaaaaagagtatctgagaaaaaattcagattgccttcaaaggagcaacaattaggctgtcagtcaacagaaacctcaggaaccagaagaccatggaatgacaccttcactgtaccaaaagaaaataactgccagcctcaagttccattcttagtgaaaatatctgtcagataagaagacaaaataaagatatttgggctaggtgtggtggctcatgcctgtaatcccagcactttgggaggctgaggtgggtgaatcacctgatgtcaggagtttgagaccagcctgaccaatatggtgaaaccctatctctactaaaaatacaaaaattagccagccatggtggcatgtggctgtagtcccagctactcgggaggctgaggcaggagaatcacttgaacctgggaggtggaggttgcagtgagctgagatcatgccactgtactccagcctgggtgacagagcgagactccatctcaaaaataataataaaaataaaataaaaattttttaaaaattttaaaaagtagccctagagagtagacttttaggacaggatcctggaactcactaatcaggtggcaacaggatccattgttggtggtaagtggggtagtgatgtgctggtgggctatagcaataccatcactaggaaactcacctactgtggattgggatatggtacaggtggaagggcaggcattgctgatgcagtagcgctagaacaaagttctccaaatctggttcctggatcatcagcagcagcacggctgcatgcttgagacctggcgctggagaccggcctgggcaacataggtagaccctgtccacaaaatatttaaaattagctaggtgtggtggcacatgcctgtggttccagctactcaggaggctgaggtgggaggattgcttgagcccaggaggttgaggctgcagcaagccatgatcacaccactccactccagccggggtaacagagcaagacctcatgtcaaaaaaaaaaaaaacaaacaaacaaaaaaaaaagaagacaaagaaagggctgggcacagtggctcacacttgtaacccaacacttcaggaggccagggtgggtggacctcttgagttcaggagtttgagaccagactgggcaacatggcaaaaccccatctttaccaaaaatacaaaaaattagccaggcatggtgttgcgcacctgtggtcccagctattcaagaggctgaggtgggaaggattgcttgagcctgggaggtggaggttgcagtcagttgagaacatgccactgcactccagcctgggtgacagagtgagatcccatctcaaaataaagaaaagaaaagaaatgaaacaaaacgaaatgaaacaaaatgaaaagaaaagggatcctgatatctgatatggagaaacttaagtggatacatctgagaactttgaacctccagtttccactaaatgctctggtctaaaggaagtagccccctttccttgctaagagaagggcagctgccccttgcctggagactaggcaaagagcctccaacaaggccttacagcaggatgaggtgtgtcgtcattgctgccccacattgacaccaggctatggtcatttctcatcatggcccaaggtcacaggcacaatctgctctgggagaatgatttttttttttttttttttgccaaaaatgcaggagctgccaagtgcctactggcagaatctaggagaggaggtgaagaagtggacataagggtgttggaccagggggagactaaaggctgtatacatgagaatatactaacctgggggcactctcaagatttaatggcttggcaaagacacctggggctccaacacagtgctggagtggctccttgaaatgtggacggaacagttgctgcagtgaattaggaggagattatagaattgcatttgcaaagcgtcaaagaagccagaaagtacagggaggtaggaatgttggaatggttcattatatgccaggagattcggaatccaccacttgactatgtgcccttggagggctcacaggaactcccctctctaggcaagcaaggaaggcactagtgagaagggcacctgaatctttgagggactcagtggcactatccttggtaggccaggatcgacaagaggagatgctgccatgagaccaggcttcgtggtgtcagtgggaacggtggaaggcgagaacagcggatgccaggtggtggcccttcaccatcatccacaaggtggatgtaattaacttaattggtaggaaggctagagtgacagccaggatgccttgacctccagggagctgttgtgttagctacaaactgatggcattcatgcatactgctgcactccagcctgggcaacacagtgagacgctgtctcaaaaacaaaacaaaacaaaaaaagtgttgctataatggcaccaattgtatatgaagttcctgaaattctgacctccactaatattattgtgtgattaaaaaaaattccatacttgaaagcaacacaccaatagaggcaagcaaaccatgttttgcaccaaacaactatcaatggtgatggcacgtggatctccctttcagaaccctgggcttctcagtaccctaaaggctttctgcagacaaggtaactatcagaatcacatggagaagaccagagcctggaaggaaacctgagaattttttatttcaaccttcttcattttacacagagacaaaactgaaattcagaagagttctggtttctcaaggcacaccactagtcaataaacacacagagccagaagctagatctagctcagtgttcttttaaagctttaaaaattgctctctgctagtaaagcttacaacctgacaataacataatatatacacacacaaatacagttatttccaaaatagatttcggggttgggggggcagaccctgcattttcacaaattataatttaagaattgcaaaatctgtctccagtattcgtaacaggatgtcattaaccagtccccatagtgggttggacgtctaggttgtttccaactatttgcttttataattatccattataatggtgaaaaattggaaacaacctaaatgtccaacaatacaggcattaattctctaaaaagtgaatatcaaatagccataaaaaagacattaaagacccagaagtgttgctaattgagcaaaaatacattaaagaccatttcagttcagatgcagtggctcacacctgtaatcccagcactttgggaggctaaggcgggcagatcacttgaggccaggagtttgagaccagcctggccaacatggcgaaaccacactgtaaggtacatggatgtgctttggtcaaggaataggctgaggcggatatccaggcctgcgtgactcaggagtttggcgtgcaaatgcacacctccacttgtcatataacctgtttgtgtaagttcatgcttggctttatgccactattgtatgtaaaaggtataactgacctgttgacgttgtgcataagagacatggctcttgggggcttggctggtctcagctcaacatggcttgacatggcaggcgcactggtgcccagagaaagagagagcacgccaaagctgtccatcttgccgatggatgggagggagccaggatgcagctgggcttgctcatgcccagagagagaaagagttaagctgctgaccctgaaggtaagggagagccggctgcacagctgtgtgtgggggcagctggctcaagccgccaagacagggtgaacggtaagctgctaatcagagggctagtgtaagaaagctgttaatgagagctgctgctgaatgaaactatctttcacctgcctacggccccttgagtgttctttcagctcacccaccccctttcctcagacttcagcatgggctggacctggaccccgggatctgacacacatctctaccaaaaatacaaaaattagctggtgtggtggcacatgcctgtaattccagctactagggtggctgaggcacgatgatcgcttgaacccaggaggcagaggttgcagagtcaagatcgcaccactgcactccagcctgtgcaacaaagcattaccctgtctcaaaaactgaaaaagttaaagactgtttgtacagtataaactctttcaaaatatatactcaagcatagaaaagtctagaaatgtcatcaatggtgatttcaggaaagaattctaaggtgactttttttggttatctgcattttttttcttttatttttttgacgtagggtcacctctgtcacccaggctggagtgcagtgacgtgatcagagctaactgcagtctcgacctcccaggcttaagcgatcctcccacctcagtctcctgagtagctgggactacaggtgcacgctaccatgcagggctaatttctgtattcttgtatttcttgcagagatggggttttgccatgttgcccaagctggtctcacgtgatccacccacctcagcctcccagtgtgctgggattacaagtgtgagccatgtgtgctgggtctgtcttcttttctataatgatcatgaccatggatttcatgtaccaacatttttctaacagtaatatttacaaagcatactatgaaaaatgttcagagaaaaagaatacaaaattgtaaaaatcatatataacgagtttttttttttaaaggcaagaaagaaagtagattgtccaggaagatagttacttccactttgtatttttccggtgaactcattaaaaggtccaggagtagaatcatgggtcaaagtaccccggctttaacttctggttcagagaatcctaacaactgacattgtcaccagcaaggtcttcgactacctgagcaactctcacctcaaagcaattcttatctgacattagctgctcagctttccgctgatacgttgactccaggaggctccttgagttctgtgtgttcagctggcctctggtggccccattattattttctgccaggtaaagatcagtcacctgcacacagatctcatcactcacgatatgctgcagctggaatcaaacaaacgcaagcttttagtgaacacagaaaacatttctccattatacagtcaacgttcctttgactgatccagtcaatcaactcaaaaaaggttttggttttttttggctggcaattttagaaaattaatcacactgtgtcattttcttggagaaaaatcaagccaagattttcaaccatatcagtggtccactgtaaaactttcatacctatttaaaatacaaaccatagagaactcaggttaatgtactgtttatctaaaattctgaggatctttaaataattttccatgggtcatacttctattacattttcaaatcatttagaatttgatttcacacatattctctctcatttgatcctcacaacagccctgggaagcaggttggagacagacttggggccggttaggagacaaatttacacaatgcataagaaagctcactgtgaaccggggtgaggaagggaggcttggagaatcatgaatgcagtatctatgtctatattcccagcccaactacaaagcctgaaattcattaggtatttaagaaatagctgctgaattattgcctcagggtgctcagccgaagaagcaggattgggactaacagtcaagctccctgactcctagccgaatacttttccaaacccaccacctatttttctatatctgataaaatgtatagtgcttaagttgtacataatgttaactcactttcaatacaggccaatcatgattgactatcagtagcttttgtgacaatcttagtaaattagaaagttaaacctttcagagttcccattctcatgtcgtatgctatttctattttgaaataaaaatccttccaattgaaactttatccatcaaaatgacagagaagtgaaaaatagatacaagaataaaacaaaacattaatttcaacatcaatttgtctattttgctttaaaattatcataaccacaaagccttcctatttttaggaagatactttctttttaagtgttaggaaccatgataactatttgttcttaagtcctaaatgaccagtatggatattagtagataactggacacagtgaaaggtcagaacgtgactgagtgtggcagaaagggcagtatctccagcaactgcagatggataaatgacaatgagtccagataatggattatgatacaaccattcaaataatgcttatgagtacttgctaacatgaggacaatcttaagatatagtgtttgagagagaaaaaaggaaaggtggaaaaaaatagatggaaagcatgacttcaatcatgcatagagatgctgccactttatccttttttttttttttttttttttgcgacaatgtcccactctgttgcccaggctggggtgcagtgacatcatgatctcggctcactgcagcctctacttcctgggctcaagcaatatgcccacttcagcctcctaagtacctgggactacaggcatgtgccaccatgcccagctaattttttgtattattagtagagatggggttttaccatgttgcccagtctcaaactcctgagctcaagtgatctgcctgcctcagcctcctaaagtgctgggattgcaggtatgagccgccgcctctactttatactttcttgttgaagtggactgtattgctgattcccacccacactctctttttggatatccggcccctcctcgagtctctggaaagggcagcactacaaatccagggacaactagggaactcccagccccactgccaggcagatcagattctctatcctgctcagtggaaatgacacatagagtgttcgatagattttttgcagagacgcatctgtatggaaaggtccagtaacactgggaccagggatactgccagggcaagccaaagcctcagaggctggaggagcctggagcacatgccatatgttcatctgcagagcaaagcacaagcatggagcagaagtccagagtgaaggcatgcaggagagaaaaatcacctcccagcccagtccttccatggtgtggtcgtattttgagttctgtacttggatgtctgtgaggttgcctattgtattcttaatacaaatcccacttaagccagcctacaataggtaagataaatgtaatgacttgacttggctggagtgcagtggcgtgatcacggctcactgtagcctcaacttcctgggctcaggtgatccacttcagcctcccgagtagatgggactacaggcatgaacaaccatgcccagctaattttttgtatttttctcataaaaatattgttcagaagaaatcttacatataatacattgaaaatcactgattgctttttcttcgtcttcttttctgtgaatatgtaggtgtttgagtctcttgtatttcttcttttacacaggatacgggctgtttgaaaactatttcattatcttcatcatcatcattcatttcagccacttcagattttcatctctttaaaaatgttgatgtacaaaccggtgtggggccctaggtatccacagtcttctcaggagtgtcaggagtacctaaaacctttttcttcttcttacataaaacctggccttttgtagacatctgacgatttgtttttgaaatactttccattttctgtaaaatcaaagaaggaaaatcataatcaattcctttttaagctaatttcttctcgagtaatccttctttctttttaaatcactcctccatccgtagctcttgtgtaagtgcaggttctgattatacatttcactgatggatatgattgctgcttaaatggaatattccagtcttgaaagagttctttctgtactttttcaggtggcataaaatgactctccaagagtctttcaccaaacatgtagttgttcattgtttcagcaactatcttagcaacatcctcagactcaaactccacaaatgcatagcctttgctatttccagtccttttctttctggatagtctgaaccttgtaacagtgccacactgggagaaataggaaaggatctgggtttcattcagtaggttaggtaggtggcgcacataggctactccaggagaaagttgttctttttttttcttttttttttttttttttgagacagagtttcactcttgttgcccaggctggagtgcaatggcaagatctcaactcacctcaacgtctgcctcctgggttcaagcgattctcctgcctcagcctcctgagtagctgagattacaggcatgtgccaccacacccggctaatttttgtatttttaggagagacggggtttctccatgttggtcaggctggtctcgaactctcaacctcaggtgatctgcttgcctcagcctcccaaagtgttgggattacaggcatgagccaccgtgaccggccagttgttattgtttttttcgttgggttatgcgcttgcaaacctgtgccacctcctgaaactcagcatctacctgtgggttcagtgacaggataggcccagccaggctggaaaaggccgccatgccaaaagcggctgacaccaactccatgcagcactcccggaaatgcccaattttttgtatttttaatataagcagggtttcgccgtgttgcccacactggtctagaactcctggactcaagtgatctgccagccctggtctcccaaagtgctaggattataggcatgagccaccacacccaggcttgactttgaaacgtatgttgtacatccagacagcagtgaactcagggggaacaccaaagatgaggagaatgagagaagggatacctccaattaaaggagttaagaagagatgcttgaacttacatttcaaaaaatcactgcaggttgggcacagtggctcacacctgtagacacagcactttgggaggctgaagtgggtgaacggcttgagcctagaagtttgagaccaccctgggcaacatggcaaaaccccatctgtacaaaaaatacagtaattagccaggcacggtggtgcctgtggtcccagctactcgggaggctgaggtgggaggtcaaggctgcatgagctgagatccaccactccactgcagcctgggcgacagaatgacaccctgtctttaaaaaaaaaaaaaagtcactgttttggggttttctgggtgaaacctctgtttccatttaaaaaaaaagggtcaagacagtatgtattactgattcaaaatcataacctgatgcttagagtaaatcattgtatctattatttcaaaaaccaacctcaggattattaaaagttaattttattgggtttttctttaagcttggctgattcactcaggtctgtcacatccaagcccatgttttactactttgtaaccctatttggaaggaaaacttcagctcacattatgatccatcctgagatgaagagtttcacacatatacaccacatataccccccaccacagtatgatgacacagcaacccaaccttgggcaaatggtaccactgccagcaaatgcatttttttctttatttaaaattttttttctgtatttcttctaacagcagcaaatgcatttaacattttattgagattctcaacagctgccatttggtttgtttagcaaattgtttacaaagtaacttttttccattgttgatatttgaatgaaaattatgttcttcagttttaaagccccatccctctcccaaagaaaggttaataactaactaccaagtaatgattatttaggaaaagaagaaaagcaaaaccagcttgtaaacacttctggaacgtgggtaaggggccaaagtcaagaccttctgggcccagtgcaggtgctaggcttgcctcgggacaccatcagcacttccccatccacaacatcctcaacagctgggagccatgcgcagaccccagggggcttcctgttccacaagctcccctctctttttcctctccacccttgctgttgggccttccttccaaatctgcctaacaaaggcagcaggatctttaatactgttcagctttgtcaatggagacaggatactctagaaagttgagagattccctggtccagtctgggggaggaaaaaatatgcagtgtagcatagatggttgtacttgtccactcagacacatgctcatacttattagatggatgtatcagatgcttcaaaagtcctgatgtgtaatagcacaaaagctgcttgtaaaaaggaagttgcaaaatgataaaaatttctgcagcagttcaggctcctgatgacaaagctggttctgataagtagttcttttgacatgcacagcagctttcactgtaagtcctgtgttccagcggtttcatttagaccataggaagttgaaagcaaagtttaaatgttctctgctgacaaaatgtggtatatatccatcaatggacttctactcagtaatgaaaggaacaaactaccaaaacctgttatatgtcatggaccaacctcaaaaaccttagctaagtaaaaagccagacatgtgaccacatattgtataattctattgatttgaaatgtccaaaaaaggcaagttgatagagacagaaatggtctgatttacctcaagaagtagggattcaagctcttagggtacatgtgatacatacattagaagaaataaggaaaagaaaagaaatttatatgtaaataaatgaaaataatacttctccctgattataaagaaaattgcattctttttgtaataatttggaagacaaaatatgaagaaaagtctttaattttgccactgaaagcattctggtttgttgctttttatatttttttatgcatatgaacattttaaaaagtagaatcgtaatatatagtcttttgtcactatgttttgggcatatttatatggcagtaaatatatccttggcatcatctttttaaaagctcgatgtatattaagttaatcattgccaccccagaagtaaattttcttatatatatattttaatggacgcaagcaagcattttggggctgaagtcatagaagtagaatttctggagaaaaataacataaaatagttttaagatttttaatagaaattttcaaattatcctgcagaaaaattggttcagtttatactcccaacaggggcagagctccagtatcccgtttccatttgtcctctttgctgatatttaaggagaaaatctcattgttttcattgtatttctttggtttctagtgcttttgaaactttttttttttttttgagatggagtcttgctctatggcccaggctggtgtgcaacagtgcaatctcggataactgcaacctctgcctcctgggttcaagcgattctcctgcctcagcttcccgagtagctgggattacaggtgcccaccgccatgcctggctaatttttgtattttttagtagagatgggatttcaccatgttggtcaggcccgtctcaaactcttgacctcaggtgatccacccacctcggcctcctaaagtgctgggattacaggcgtgagccacggccctggccttgaatcatttttatgtgcttattggccatttttattcttgtgggaagtgcctgtttctccattgcctattttctggccaagctcccaagtcacatttcacttaatttttatcctgctgattgaaagcattttaacataaacaggagcaggacagactgtaattatctagatcttgctctgtcacccaggctggagtgcagtggcatgatcatagctaccacagcgtcgtactcctgagctgaagcagttttcatacatcagccttccaagtagctaggactacaggtgtgtgccaccacccccagctaatttttaagattttttgtagagatgcgaattcactatgctgcccaggctggtcttgaactcctgacttaaagtgatcctcccaccttggcttgccaaagtgttgggattacaggtgtgaactactgctcctggccgagggctcattttgtttgctagtggtgatattggtatctgtttatatttgaggctttggtgctagtgctgaagtattacactcaccatccgaggtttgcaggacttttgttttaatattgaatagatggaactgtttacttctgcatctttgcaggcatacaaaatgtgcctaccaggactctgctttatatctattgaaagcaagaagtaatacagtaaaactttgcctggctagaggctttggaagaatggagtattctgatttaatgctattgaagtgtgaaggtgaaaagaatgaaaaacttacatttcctgttgaatgcaacttgaaaatacagccagtgattccacttttcttctctagtaagtttggacattctgatctacttggtgttttattatagaactgctagtgtgcccgagacttacattgtgaagacactttttaaaaaacttgagaggtaagagggtgtaaatggtattgtgtgagatcaggctggatgagaactgacacttgtaaacatactttttaggctgaatctctgattgccgtttgttttcttatttaactcataaaaataaaacacattggatggagggtgggagcaggaaggagatttatgtcttttaattgcatgccattgtttcatatcaagacagaacatatggtatccctggctttggacctacagaaggaaacacatttttctgcctgctgtatgccagaggttcttgaacacctggagggatgactgcagcacagattgctgagccctactccagagtttctgattcaccatgtccagggtggggcctgagaatttgcacttataaaaggttctcaggttctgctgctgctgctagtccagagactacatttttgagaaccactcttgtctactaactgtaaattgtagaactctagaacaaagcttagtttggtgtaggaaaagaagctcacaggttatggagcaaatcatgaaagattcaacccttgatcccagcctagtgtggaattcaggtaacaatcaatacacagtgacataacacaattcttggttttcatgattgcaagtcatagccaagtatcaagtgagaaattcagtttcatttgcaaggcttagagaggccaggtgattctagaaaaataggccttgtatttgctttaaaccagtaaagagctttgagtgcttattaaatggaaagctttgtgtttttatttatttttgactattttattttatttttttgagatggagtctcagtctgtcacccaggctggagtgcagtggcgtgaccttggctcactgcaacttccgcctcccgggttcaagtgattctcctgcctcagcctccccagtagctgggattacgggtacccaccaccacacctggctagtttttgtatttcgagtagagacagggtttcaccatgttggccaggctggtcttgaactcctgacctaaggtgatccacccacctaggcctcccaaagtgctgggattacaggtgtgagccaccacacccggcccaaaagctttgtgtttttaaagatattagacatgtttcttgttttttaaaaaatcttaataatgtaggagaataagagaaatgttttttccaaagccgagaaatcattgtgattattttaccttattgggatgttggataatatagtccacttcattcattaatcatcaaacatgctatggattttccatttttataggatttgtatcttcactggggtaatactggtaattcttatactccctctgaagatgaaaaatgtaggccaaaatcatagaccatgcatagaagctggataatgaagacagctctggaggaacatgtagacacacacacactgacacacatatatataaagtataaatacatatttttttaaagtttatttttaacattttaaagcaaaaaccagccctcccctctcccagagtaggcaggccccgcccctctccccaagtgggcagggacagcagtcgcatgggcagctttccttgtgatgtcacaggttcctctgggcacactgctgcctggccacgcctcctttccctttcatctttctcattgaccaatgggattggagcattaaggccacacccctattctgcattctagtgtggccctggttacgcctcctctggctcagtcacacagcagccttgtaggtgactggaggtgttcgctgatgtggccccaaccctacctccctccccaccccatgatgttagaagaatctcgacagaataaattggcagcagccaagaaaaaggtaaaaagccaagaaaaaggtcatggccccccaacctagccagagatcccctctgatgacaagaccactcccagagtccataccactcctgaggcacaccgggctgggcccccctaccccggcgcctctgggctccccccaccaaagtcttgtcagtcagccccgccccttcagcaagcagcccagcctctgccctcgccaatcaccctgcggtgactttgggcggatgactactggggatacctgctccatattcagccctcacgtcctgccaccccaagcccaacctccctgggttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctgggctggcacctccaaggacctgggtcccagccccacgtcccccctcccccatcgtggatcggcaactcagccattgcactgatgaggtttcccccacccccaggaggagtggaatgtagtgatgtcacagtcctcctaggaactgtcattactgctgcaagaccggcctttgatcttataacccagtcccctaagcattctcaccccatttctggttcctctggtcacagcacaaatttccagctagaagggaaatggggaccatgggacctaggagcaagaggtttcaggctgccttactcccttcacatagacatcgacagtgtgaaaagcctacacttcccctgtgagctcaaaacgttgacagtatctctgggtggtaatgggagaatgggtttggtttggttttctcccaggcttctactctccagagagactttaacatttttttccgagttctccacctcatattctaattctccacggttctgggaccagactgcccttcagtcagtggtctctgaagtgagatttgctcatcttctgtggaataggtcttgggaaactgaacttgacagcttgaatcttcctcatatcatctcaacttagggtacattgagtgccacaggataaatgtgggagatctttctgaagcatcagtttcccttgattctcttgagagagaaaaaacattaatgtacttaggggtgaccctcacataggtttctaagagtataccagacttctctctgaaatgagacttgggttgtcctctttctgataaattcccagatttaacaaaaaagctgccttctgccatgaggacacattgatataaaagtttgagagatactggtgcacttcttcacactaacagacatttgaggatgtatgactctaaaccacacagcgtgtagttcatgcctatgtaatgtttacttttctacctctgcgtctggttttggtccccggcagctgctgattcatggcaaaaccccagagcttggagtcagaagactgagtttaagttccattattgcccccccacacttttttttttagccataatatccatccctctcagtcacttaagtgattgtgacaacaccttgtacagttgttggtggcattaaatcagatggtgtataagagtattttgcaaaaactgtaaggagggtgtggctgtaagggctggtagttctcatgtgtattactgctcttctttcccacagctaaaagaatatcagcaaaggaagagccctggtattccagcaggagcaaagacaaaaaagaaaaaaactgacagtagccctgagacaaccacttccggtggtggccactcacctggggatgtgagtcttggctggccaggctcctggggacagggggcccaaggggcagtagagggtaattgttgagattgctgggtactggttaagaattctgggtttgaatcctgcttcttcatctgctagcgatctgatttatggcaagttgcttgagctctttgagcctctcttttcacatctgtgaaataggggtagtattgtttgacttccatttgtgaagtttaaatgagattccttattgttgttgttttcatgttaacccctagtacgtggcctgctgtaaacacccaggatacccaggaaatggtcattgctgtttgattttcctgatccccactcgcaaggggaagctgggctaatgagtacagccacttgccatcaggctgtccctctaggagtcactgaagggggcccagggtgtggtgaggagagcccaaggcactaggagcaagagaaggtctaacttgccaccagcttgctgggtgaccacagaaaaatcacttcttctgctgggcctcagtttcctcctctgtaagatgatactggataagatcagtgtctttcaaacttgttttttagctgaagtccccttagttcaagtgaactcttactcaggagtctgtttttttttaatggaggtggaggtctggagctctaccagattcatcgcccatgtcctgggcctgaggagaggggtccagtgagcgtattaagatctgcattggtcagctgactccactctgtgactgcgtcactcgggggacttttccatctattttttcctgcccctggcaaggcagcaggtggccatttggaagaatggcacaggccatggttttaatctcctctgctcttcttcagcgtttccttttcctgaacccacatcttcctcctaccctgactttcttgcttctctctaagccacttctgtctttcaccccctgcccttgtttttcccttgtcacctcctgtagattcaggacattctgaaggtgcgggtgtccaaccttaaccactccaatggggtagtgctcccccattggacaagtggaaggtgaggcagtgccaagacccctctctggcttgctgtctacagctgtgcatggccctgaggcttctctggcttgggggatgcttggcctctgccttgttttatgttgctgccattaaccttcagcctgtttctgtctgcttcttcacctgcttgattgattgggttttttccttccccgcgtcttttattatcttggaaatggtgatgcctaaaagtttaaaagtaatctgggaataacgtacagagcaggcatgtgggatttgggctctttttttttttttttttttttttgagacagagtctcactctgtcactcagactggagtggagtggtgcgatctcggctcactacaacctctgcctcccgggttcaagtgattctcttgccttagcctcctgagtagctgggattacaggcacctgccactacgcctggctaatctttgtatttttagtagagatgcagtttcaccatgtcggccaggctgatcttgatctcctgacctcaagtgatccacttgtctcagcctcctgaactgctgggattacatgtgtgagccactgtgcccggctccttgctgtttttatactttctccatatacataactatttcccatgtaagtttttttttaatttctcatttttattactcctgcatcatctgttaccctgaaggatctggaagtaagaggccctgggctgaggtgcagtgactttgcaggccagccctccaacctcctctcacagtgggggctgggtgaccctctgccagctgagacagcccacacacaccccagccctaatgattgttctctctacctctccccacaatcctcttccaactcctcctctctgcatgtgcctcagagccagtaccaagaactagcagtagccctggagtcaagctcagtgacaatcaatcagctcaatgaaaacatagaatcattggtaagtccagtggggtcccctgattccatgctgccaatcctgggctttagtttccccttggggccctgaagaaaggggctgggggcccctggtgccaagggcaaatggggagctggagcacccaggcctcacctggagggaccccagagcaaggagcacgcagcatggctcttctgtcactgccctctttgccgactctctcttctccagacacccctgctccagtccttgccacacacgccctgaggttgtcacctctcagggaagcgctagcctgactggttgtcaggggccctgtatttctgccctgactcagtccctaatttgctttgagtctggacaagccacctgtcctccttgggcttgtgtttctggaggaggtagagcatcaaagttctctgttagctctgagagtctgagatttaaaggcccctagaatggaaacctgagggccaagggctcctgtctgtccttttccatcctatatctgctgtgaagaaccgtagctggcccgtatgtgttcagtaaatgtttgttgaatgaaggcacctttctaaatcacaagctggcagaagggtgggccttcctgagactccctctctagaggtttatgttactgtcctttcaagagaatccagattcaggctttgagttctgtggctgtgggcaaaaaccaacaaagacccaagtcctctgtccttgggagcttgaggagggttgaccagtttgtgttgccattggttctgagaatgttgcctttaaaatccattcctggaccctgcctaccgcttccaggtctggggaatagagttgagggggccactctcagtcacctgaatttgactctccccacagaaacagcagaagaaacaagtggaacatcagctggaagaagtaacgtgatttctttgctcacaacatgactgctgggtttgggggacactcagatgcagaggcgccagtctcatcttgcccactcccagcctggggaagaaggctcacccatcagattccaccccatccccatagggtccctgataacctggtcccatgggtgggcctgtcctggggcattggtggcattctgggggcatgtctcttgctgtgccatctctgcctccctgtgataagagctctgtcttcctcttcctacaggcaaagaaaacaaacaatgaaatacacaaagcacaaatggagcagttagaggtgagtggagggtggggagctttctcctgtcctctggagaatgtttctttccttctctttcagcatttccttggcttttctcccaaacgttcaattccagacaatcaacatcctcacattggaaaaggcagacttgaagaccaccctttaccatactaaacgtgctgcccgacacttcgaaggtgggaatctgggcatcccgtcatccttcaacctggcactttgacaggtctttagggggagtcttttgggccccatctcaacctctctcattacagaagagtccaaggatctggctggccgcctgcaatactccttacagcgtattcaagaattggagcgggctctctctgctgtgtctacacagcagcaggaagaggacagggtgagtccaaccagctgccccatcccctggcagcctggcttcccagatagaggagtgagcctaaaggtcccttctgcaggatggagtgtcctgcccagaaggcagcatggtcatttctcactacttttgtgtatggttgttagaggcagcctggggctgagtcagctgctgtgggtgagttggggggcactgtggggagtgagcactggatgcagagctcagaggccaagtgcctgccctgccctttcctggctgtggccttggccaagtcctaggtggggtattgggtagttgttctgtgaaggtacagaagagcacatttagtatgttaccatttctgtagagagaggaaaggggtgtgtgtgtgtgtgtgtgtgtgtgtgtgtgtgtgtgtactatgataatatacaaaaacatgtctgcaagcattcataaaaaactcaggagagagtaacagggtgcctggagacacctcccttctgtaccttctgagttttggactatatgaatgtatcatcctttcaaaaagtgaacaaaagattaatttcccccttcctatctgtgtccccacccccagcaagaaaaatgggcttagagaataggatagacctgggtgttcaaatcccagctctgtctaagtgatcttaggcaagcacttaaccttgaacactcgatgtttttcatctacacaatagaggtaatcctagtaaccgtctcatatggtggttgtgaggattaaatgggattgctagcatggaacctggtgaagcactccataacggttcaaacagtggtagtaataacagtaataacaatagcaatattatctgatctctctgggcctctgttagccagctgtaaattcgatctctttccctctcccttccaactttactgagttcttttaataaccaggccacgggcttggaaatgccttgacctttactaaccgagttgtatattgagcctagccctagcccttttaaggggcactgcccgggctccccagatcaaaacttctcactcttcaccatccagtcctcgagctgcagagaagcggtcctccagcggcggttacagcagaccataaaggagcgggcgctgctgaacgcacacgtgacacaggtgaggctttgcagagggagggatgtggaaggaagatgaccccaggtggccaggagcaggtgaggaccagtgacagcccttcctaacttctgtgcccatttcttgcaggtgacagagtcactaaaacaagtccagctagagcgggacgaatatgctaaacacataaaaggagagagggcccggtggcaggagaggatgtggaaaatgtcggtggaggtgaggtctgacccttcagcccccactttagataggtcactggatctttctgggcatctgtaaaatgggaatagtacagccagaggtggtcatgggtctgggctttgtggagatggggacagagaatgagatggtagcctgtccagccaccagcccctctctccagggccctttcccctgtgctttgggcaggctcgaacattgaaggaagagaagaagcgtgacatacatcggatacaggagctggagaggagcttgtccgaactcaaaaaccagatgggtaagatggggctggtgtgacctcggagcaggactggcatcagaggtctgtgggggtggcttagaatgccccagggaggtgggtgggtggaagggctttgaggcagagggaaagaggtctgtgccaggagacggcaagttttgtcatctccatgagcctcagggtccccatcagcaaagagggaggagtgcccgttgtcagccacccacagtgctctctatgtgaaagtggcttggaaattggctaccattgggtgcgaggaatgattagcagtgaggccaagtttgggaagcctgagaggagctgtgcatcaagaggaggtttttttttttttttgagggggatgtgggtagaggggttggggaatccagaggcccttattgtctgcttcatttctcagctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctggtgggttgccccacctggggagcctgccctcatccctatccctccaggcctttgtttccccacctgtaaaatgggccagtgtagccctcacatgaaatgctacttctaaaggcacctgtgagctacagctcatcgggctctgctctgatggctgtgggggagaagggatgatttttctaacctgcctccacccttcctggtgatatgggaggcagacaccaaggtctggtgtctccagctgcagtggatggccactgattgcttctctctgtccagaacaacgagaaaaagagcgcactgcagttggagcagcaagtaaaggagctgcaggagaagctagacgaggtgaaggagatggtaacctccaccccatccaagaagggctgggaggcgggcaccagcctctggggaggggaggtgccaggccaaaggcagctccagctgggaggcaggtgaccccagcaccctccagtgcagctctatgactgtttcttgcttcctgccctctgacttttagaggtgggtagccctgggctcctcccaggtctggacatcatcatcccagctagagacatggagcccccaatcacaggggaagagacagtggtacaagaggctccttatccaggcacggtggctcgcacctgtaatcccagcactttgggaggctgaggcaggagaatcacttgaggtcaggagtttgagaccagcctggccaacgtggcgaaacctcacccctactaaaattacaacaacaacaacaaaaaattagccaggcatggtggcgcatgcctgtaatcccagctactcaggaggctgaggcacgagaatcgcttgagcccacgtggtggaggctgcagtgagctgagattgcaccactgcactccagcctgggccacagagtgacactgtctcaaaacaaaacaaaaaaggctccttagattcaaactggattctggcctgggttccactggtcaccattcaactactgttcatctctaagtctctgtttctgtgacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatttgaggctggggaaggaggtatggggttctaggcaagggaggaagcctcttaggcctggagcaagggaccagggtcctgggcaggtgacagagccccacggtgccctcgctaccctattaatgggcccagaatctggaagccagccaccatgtgccctcatgcccagggtcttcctgcaggtggagctgaagagccaagagtctcagagtctgcagcagcagcgagactagtacctgggtcacctgcagcagtacatggccacctatcagcagctgacctctgagaaggaggcgctgcacaggcagttactgctgcagacccagttcgtggaccagctgcagcagcaggaagcttggggcaaagcggtggctgagatggccggccaaaagttgcaggagacccaggggagggagttgctgaggacggggccccgagggggatgacctggcaacctccgtgccttctcactctgtttcccgtccccttaggagcacctagaagctgccagccagcggaaccaacagctagagacccagctaagcctcgtggctctccctggagaaggtacaggagaccactcagaggaagaggagagagccccaggaggaaggggggactgttagcagcataggattgaggggttggaagagacctttagaacagctggtcgttatgccaaccgggtgtccgcactaagttcagcatcaatatggtgacctcctgggagcagggggccaccaggttgcctaaggatgaatgaactggaccagatcagaaagggagcaggtcaggactcccgcaccgaccggtagtgggactgtgcctgggcaatatagcaagatcttggttcttaaaaggaaaaataaagaacagcagctcactcccctctggggagaggctggctcagggttacacagtcagggtggggacagaggtaggcccacagtaccttccttgttgggttgtctgaggacccctctggccacctccccacaggagatggaggacaacatctggacagtgaggaggaggaggcgcctcggcccacgccaaacatcccagaggacctggagagccgggaggccacggtgagcctgactttccctgccccgctttgccaccttcctctgtggtccctcccagagcccgttatgctcttggttttcccaccttctgatttctctggcccctcaccccttccgggagccagtggtcagacactttgtcacctgtgaccaacaggtgcactctctgaggccccaagggaaggggttgttctccacctccctgcctcatttgttctgtctatgcccctacaagaatactcacctcttgccttcaagtggcatttttcaactccgctggagccagttcccaggaggagcaggcacggctatgtgggcagcggaaggtgcgaaggctgtgccgcctgcacctggctcatctggtggccttggcctggaaggagccagaggcagaggccccagccccagggaggactggagatgagtttgtgtgtggggagagctaccgggccctgaaggaggccatggtgaagctgaaagggagtgagtcctggcatgggccaagaaaagtgggggcggggcagaacaggtcactcccgaggtgtgaccccattattttggctccagagcagctttatggacctcccgaaggagaaggcggacgggacggagcaggtggagagacgagagcttggattcgtccagccttctggagtgacagacggcatgagtgagcgggaggccagggcacgggcacggggagctgcagggccgtcggagggaccctagtgtctgagctgtgtcctctcacaggagagtccttcaccgtatatgaaagccagggggcagtgccaaacacgcggcaccaggagatggaggatgtcatcaggctggcccagaaggaggaggagatgaaggtagggcgtgcaacatctctgcggggttgggggtgggcatgggcactggtgcaggctccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggtgagtagagctctcaggcggggtgggcaggcaggggcaggggaggctcgcactgtgctcagacccccgcctccctctctccgaagatttttatgaagtgagcctggacaacaacgtggagcctgcaccaggagcggccagggagggttctccccatgacaaccccccggtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacgagtatatgtcccagtacacaaaagggcactggttggcattcttcttaaggtatttagtgaagatcataagaaatcctttaagagtttaaatgtccctggaagaggcatacaggctctagtcaagaatgaatttgagtgaaggaaagctgtgtgacacctggccttcctctatgttcatggagcttctttgaggctagaagattgattttatcatctagacctctctggctaatacctattcttcagccacattagttactctgacataggaatttacttcttttctttgaatggaaaacactttaaaaataataacaaccattattataaaccaatatatgtgagagtacttagttgaaacaaaaaggagttttagtagacagtattatactacacatgaaaatcaaggcgaagtttatgcaacttaaaatgtttacaagctgcagtgcaatctaatgtttgtgaatgtccaagtattatgagaaaaagtgtctatacaatgacagacttatgtttcctcacaaagttcttcacaaagagtgaaatatgtttttatacctctcagtttcagttagaggcatattttgtgccatatttatgttaatgtgcctatacgtgatgagtgaattatttcagtcatacattgcctaaatcataactttaagatgcttgggaaagaatcaacagctaaaagttcatgaagttctaatgtctgtgttccaaaatacgtcacagtattaggatgcagggagagatgtgtgtgcgctccctggggtgggcatttctagttactagaccatctccatttttagcatttggcatcctcatgatacttttatacatatgacattaataggagagcaataatacgattttacagatggaataacagatgtgcctgcattcagtgaaagagtgcaaatattaagtccttgtgacttcaactgactcttccaaattgtatgaatttatcaatgtattagataaactcagttccagaattataaagaaaaactgttagaccaacgaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcataccactgttaattagccaccttatttggtctaacagtttttctttataattctgaaactgggtttacctaatacattgataaattatttcaaaggtatttttatagttcaaatcacttcacttttaccctgataaatataaatgactaggaatgatcttcagctagcctttagcacctgcaaccaatctgacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcatataacaataacttaagtctttcttcaaagtgcatgtggtcctttgcaatacctcattcagccaagtatttgttctcttcctcattcagtttaaggcagctttcaatttgcttagaaggcaacattagaagggtagagtttaatcagaaacatagaattttaaagtgtgggttcaactgaataaatttgaatttctgtaggaagtaaagaattaaaaatctatttaaagattgcaatatataatcatttttaaagtatttgtttaacctgatgggttttccagaaatgaaaacaagtcagttctaaaaccaaagctgatatttagaaaatgtgaaaatataaatcagccctatgcataatatagtttctctaaaactttatcttaaagagtcattttaaaagaatataactattcaaaaatgtaactgctatcttaatgttttgaaataagttaaaacactttaaaatatgaatactgtagtttgaaagaaagaaactgggggaaggaaaagtagagaaagaaatgccaattccaatgcaaggctttatttgccaagttttcttagaatgacttttaccagtttatgaattcttgtaaacagaatgtataatagaaatactgaaacactgttgcctaaagtggcattgttgactgctactgtgatgctactgtaatgtaataaattattaaattgttgcaaagtgctgtttttgccttaaaattttgtgtgtcttgaaaactatagtattacaggtattgagactgtgcaaatgctgggcacgcttggcatgagataatcagtttttatttttacaaaattgtaattaactatgcaagtgtgtttattaaaagaatacaaactaaaaagaagttatgggatttagaaaatgttgtaggatgaaaaagttatgggataaaaaatgtggaaaagtcgtggcaaaaaaagttgtgaaaaaagtatttaaagttttatgaaaagtttaaaaaaagtattatgaaaaagaagttacgggattaaaaaataagtcatgggatataaataaaaataaataaaagcaggcctctgtcagcataagcctggagaagtggggctggagtctgccgccatcgtgtccctaccatcccttcctacccctttatcattagggtagcaagacaagacccctgtctaatggggagagacaaacagaccctttgccaccttgaccagggctgagtccttagatttctggatgatgatgattgttatttaagagccagaggctggtggagtcggtttgtttggaggcggcctgatggcctccctaccctcaccaaagcaacttttccctcagggggctcccatcttcttattcagagaggcagctgaggcagggacaatggggctaactgtagagcaggtgagggcacgggctgctgggaaggccccagtgtacatatagtatctgtgtaacattttgtatattccagggggtagggccaccccctgtatcgtacctagcagaggttggagctggcatatgaggaggaggttctaatcattatttgtggctgggaaacttatttattgatagcatggggcagaggaaggaggcggggatggggttgtggctccctggtgatgcgactcccgtttattttgcttttcattttggaataaatggatttagccatactgctcagcctggtgtgttcctttttccctcactgggtcctggagtttgtgccactgaatgaggagccccagagttgtctgagcatgtccagctgggctgttggtgaccttccaggcctgttacctttatgctgcctagtgacacctggtggatttcattgggactgccatggtgcctatggggcacagtccagccctgacagccaacaggctcagaagcctgatctagcggtggccgggaagacagatactagcacccaagggcactgacttccattcaccccaggagtcttccaggccccctgcccagcactaacatctctttgtgagtctcaaccagactgagctgcagcttcagggtcagggtaggctctgacttaactgatgtgacccaggacaaggggatttattgatggtgtcacatatgcttaagctcttggcctctgtgatttctttggggcatgatacccctctgtcccatgcttaggtgcccacatgtggccacaagtgcctttcctaccaccatccctacttgaggctggtgtccaggcacctgtggctccaggcagaaggctgagcgcagagccaggcctgggcagatgttctgcaggggctgcaggagctgacagtcctgaccacccagcccgtggccatccattccctttcaccgtggctggctcttcatccaccatccttccaggggccaggcctgaacccaaactgacttttacctgccctggtcccccttgtgcctatcaggttcttggctgagcatgatgtttttgcccatttccttgattatcctcaagaggtttatagagccacttggggacatcacatctgtctaccaggtcctcaccagagacatgactgccttgggccgggcctgggatagtcaggggtcacactcacctgttgggacctagcttcagtggcttcaatctgggcaatggcctgatgggcggctgccccttctcctctgcttgggggaggcaggagaggaaggtcagggaggagatctgcttcctgcccacctgacactggttggaagcagggcgcccacctgtgcctgtctcaccttgctgcaggtgcatcggaggccgaacccctctcccgatctcctgcaggtgcagattccaggtttccagtgggtgtcagtgtgggctccagagctctcctggtcctagggaaccctgggctccatgaggccttggcctaaccagattgtttcccacactgtcacctccccaccctgtcacctccccaaacatggggctgcatgctctgtgccctgggtgggacattggaaggagtgccaccttccaggtttggatcacagtaaagcctctgccttggggatgtgctggccgagacagatggggttgaaccagccatgatacgttggccttgggcaagtcatctgtgccttgcttccccagcagccagaagggataatagcacctatttcacccatactcaagtgttcacttgttagcaggaactgagtcccggaggaggtgcaggtggagccattgaggcagcactgcagctggacctgggtctgagtcccagctcctggctgtgatatgcatcactctctccatttatttatctgaaggacagggctgtgctgttctggggtcactgtgacaatgcagctggcctgtgtgagttggtggtggcctcctgagatggtttgaggtgggctggaggtgtgtcttgaatgccccctcacccccatggggaagacccacttagggaagactcaagtgtctgtatggaggaacccacattccctgcccctcagctgtcctctgtcccttcctagccccctctgctgtcctgcaggctctggcggtggccatccagcttggtggccatctggctgatccactcctccaggtggaccctctgtcctcatgtggtgcaggtcccattgtgccacctccagacaggccatgctagccccagggcctccgttccctgttacccagcccccacccccaggtacgtgccccctccctaaagcccactgtgtccaccagctgtgtttcaactctgtctctgagcaaggcctaacgcaaagcctgaaacagcctggcttgtagagggccaggagaccaaagcttgaagagagagtgacggtctcccagagcccacttagcctcagccccagggctgtgtccatgctgttcctggctccagtgagccaattctctcccatgacgcctgtaagggctccagtggtgatggaggtagctggagagaacaaggctgtcttaaccctccctccctgagaaggcccaacggggaacgttttaggcatcagggcattctggggggcatcttccagggacccctcctataccctgccctgccctggctctctagtgagaaattgcagttgcttggacagtggggctgacccaggacaaatgcatatattgggctggtcttcagggtgctggggtaggggcaggggcacttcagggataggaaggaggggcctgtgtgttccagaagtacagaggaacctggtgccggccgcagtcaacccctatgtgatgatctttctacccgccctctttcgtgtcttggtgctggctgctgtctttggccaggtaagctcatggtctgggctcctggggtccactcactgggcctccacactgcctgcaggtaggggagcctttgggccaggactatccttggctccccttccaggtggtgggttcaaagaccattcctgggttccaccaccgccaagcctcaatggtcacaggaactgctggggctttctaggttaagacccttgcctatcctggtgttcctccctgcagtagggggctgcaggggtcagcctcagtctctgccttgggagcctgccttaccttgcctgaactcaagcgatctgcctgccttggactcccaaagtgctgcaattataggcgtgagccactgcacccagcccagccttgactttgaaatatatgttgtacatccagacagcagtgaactctgggggaacaccaaagatgaggagaatgagagaagagatacctccaattaaaggagttaggaagagatgcttgaacttatgttttaaaaagtcaatgcaggttgggcacagtggctcgcacctgtacacacagcaccttgggaggctgaagtgggtgaacggctggagcctagaagtctgagaccaccctgggcaacatggcaaaaccccgtctgtacacaaaatacaataattagccaggcacggtggtgcctgtggtcccagctactcgggaggctgaggtgggaggtcgaggctgcagtgagctgagatccaccactccactgcagcctgggcgacagagtgacaccctgtcttaaaaaaaaaaaaatgtcactgttttggggttttctgggtgaaacctctgtttccataaaaaaagaaaaaggtcgagacagtgtgtattactgattcaaaatcataacctgatgcttagagtaaatcattgtatctattgtttcaaaaaccaacgtcaggattattaaaagttaattttattgggtttttctttaagcttggctgattcactcaggtctgtcacttccaagcccatgttttactactttgtaaccctatttggaaggaaaactgcagctcacattatgatccatcctgagatgaagagtttcacacatatacaccacatataccccccaccacagtatgacgacacagcaacccaaccttgggcaaatggtaccactgccagcaaatttttttctttattttaaatatttttactgtatttcttctaacagcagcaaatgcatttaacactttattgagattctcaacagctgccatttggtttgtatagcaaattgtttacaaagtaacttttttccatttttgatattttaatgaaaattatgttcttcagttttaaagctctgtccctctcccaaagaaaggttaataactaactaccaagtaatgattatttgggaaaagaagaaaagcaaaaccagcttgtaaacacttctggaacgtgggtaaggggccaaagtcaagaccttctgggcccagtgcaggtgctaggcttgcctcgggacaccatcagcacttccccatccacaacatcctcaacagctgggagccatgtgcagaccccagggggcttcctgttccacaagctgccctctctttttcctctccacccttgctgttgggcctcccttccaaatctgcctaacaaaggcagcaggatctttaatactgttcagctttgtcaatggagacaggatactctagaaagttgagagattccctggtccagtctgggggagggaaaaaatatgcagtgtagcatagatggttgtacttgtccactcagacacatgctcatacttattagatggatgtatcagatgcttcaaaagtcctgatgtgtagtagcacaaaagctgcttgtaaaaaggaagttgcaaaatgataaaaatttctgcagcagttcaggctcctgatgacaaagctggttctgataagtagttcttttgacatgcacagcagctttcactgtaagtcctgtgttccagcggtttcatttagaccacgggaagttgaaagcaaagtttaaatgttctctgctgacaaaatgtggtatatatccatcaatggacttctactcagtaatgaaaggaacaaactaccaaaacctgttatatgtcatggaccaacctcaaaaaccttagctaagtaaaaagccagacatgtgaccacatattgtataattctgttgatttgaaatgtccaaaaaaggcaagttgatagagacagaaatggtctgatttacctcaagaagtagggattcaagctcttagggtacatgtgatacatacattagaagaaataaggaaaagaaaagaaatttatatgtaaataaatgaaaataatacttctccctgattataaagaaaattgcattctttttgtaataatttggaagacaaaatatgaagaaaagtctttaattttgccactgaaagcattctggtttgttgctttttatatttttttatgcatatgaacattttaaaaagtagaatcgtaatatatagtcttttgtcactatgttttgggcatatttctatggcagtaaatatatccttggcatcatctttttaaaagctcgatgtgtattaagttaatcattgccaccccagaagtaaattttcttatatatatattttaatggacgcaagcaagcattttggggctgaagtcatagaagtagaatttctggagaaaaataacataaaatagttttaagatttttaatagaaattttcaaattatcctgcagaaaaattggttcagtttatactcccaacaggggcagagctccagtatcccgtttccatttgtcctctttgctgatatttaaggagaaaatctcattgttttcattgtatttctttggtttctagtgcttttgaaacttttttttttttttgagatggagtcttgctctatggcccaggctggtgtgcaacagtgcaatctcggataactgcaacctctgcctcctgggttcaagcgattctcctgcctcagcttcccgagtagctgggattacaggtgcccaccgccatgcctggctaatttttgtattttttagtagagatgggatttcaccatgttggtcaggcccgtctcaaactcttgacctcaggtgatccacccacctcggcctcctaaagtgctgggattacaggcgtgagccacggccctggccttgaatcatttttatgtgcttattggccatttttattcttgtgggaagtgcctgtttctccattgcctattttctggccaagctcccaagtcacatttcacttaatttttatcctgctgattgaaagcattttaacataaacaggagcaggacagactgtaattatctagatcttgctctgtcacccaggctggagtgcagtggcatgatcatagctaccacagcgtcgtactcctgagctgaagcagttttcatacatcagccttccaagtagctaggactacaggtgtgtgccaccacccccagctaatttttaagattttttgtagagatgcgaattcactatgctgcccaggctggtcttgaactcctgacttaaagtgatcctcccaccttggcttgccaaagtgttgggattacaggtgtgaactactgctcctggccgagggctcattttgtttgctagtggtgatattggtatctgtttatatttgaggctttggtgctagtgctgaagtattacactcaccatccgaggtttgcaggacttttgttttaatattgaatagatggaactgtttacttctgcatctttgcaggcatacaaaatgtgcctaccaggactctgctttatatctattgaaagcaagaagtaatacagtaaaactttgcctggctagaggctttggaagaatggagtattctgatttaacgctattgaagtgtgaaggtgaaaagaatgaaaaacttacatttcctgttgaatgcaacttgaaaatacagccagtgattccacttttcttctctagtaagtttggacattctgatctacttggtgttttattatagaactgctagtgtgcccgagacttacattgtgaagacactttttaaaaaacttgagaggtaagagggtgtaaatggtattgtgtgagatcaggctggatgagaactgacacttgtaaacatactttttaggctgaatctctgattgccgtttgttttcttatttaactcataaaaataaaacacattggatggagggtaggagcaggaaggagatttatgtcttttaattgcatgccattgtttcatatcaagacagaacatatggtatccctggctttggacctacagaaggaaacacatttttctgcctgctgtatgccagaggttcttgaacacctggagggatgactgcagcacagattgctgagccctactccagagtttctgattcaccatgtccagggtggggcctgagaatttgcacttataaaaggttctcaggttctgctgctgctgctagtccagagactacatttttgagaaccactcttgtctactaactgtaaattgtagaactctagaacaaagcttagtttggtgtaggaaaagaagctcacaggttatggagcaaatcatgaaagattcaacccttgatcccagcctagtgtggaattcaggtaacaatcaatacacagtgacataacacaattcttggttttcatgattgcaagtcatagccaagtatcaagtgagaaattcagtttcatttgcaaggcttagagaggccaggtgattctagaaaaataggccttgtatttgctttaaaccagtaaagagctttgagtgcttattaaatggaaagctttgtgtttttatttatttttgactattttattttatttttttgagatggagtctcagtctgtcacccaggctggagtgcagtggcgtgaccttggctcactgcaacttccgcctcccgggttcaagtgattctcctgcctcagcctccccagtagctgggattacgggtacccaccaccacacctggctagtttttgtatttcgagtagagacagggtttcaccatgttggccaggctggtcttgaactcctgacctaaggtgatccacccacctaggcctcccaaagtgctgggattacaggtgtgagccaccacacccggcccaaaagctttgtgtttttaaagatattagacatgtttcttgttttttaaaaaatcttaataatgtaggagaataagagaaatgttttttccaaagccgagaaatcattgtgattattttaccttattgggatgttggataatatagtccacttcattcattaatcatcaaacatgctatggattttccatttttataggatttgtgtcttaactggggtaatactggtaattcttatactccctctgaagatgaaaaatgtaggccaaaatcatagaccatgcatagaagctggataatgaagacagctctggaggaacatgtagacacacacacactgacacacatatatataaagtataaatacatatttttttaaagtttatttttaacattttaaagcaaaaaccagccctcccctctcccggagtaggcaggccccgcccctctccccaagtgggcagggacagcagtcgcatgggcagctttccttgtgatgtcacaggttcctctgggcacactgctgcctggccacgcctcctttccctttcatctttctcattgaccaatgggattggagcagtaaggccacacccctattctgcattctagtgtggccctggttacgcctcctctggctcagtcacacagcagccttgtaggtgactggaggtgttcgctgatgtggccccaaccctacctccctccccaccccatgatgttagaagaatctcgacagaataaattggcagcagccaagaaaaaggtaaaaagccaagaaaaaggtcatggccccccaacctagccagagatcccctctgatgacaagaccactcccagagtccataccactcctgaggcacaccgggctgggcccccctaccccggcgcctctggactccccccaccaacgtcttgtcagtcagccccgccccttcagcaagcagcccagcctctgccctcgccaatcaccctgcggtgactttgggcggatgactactggggatacctgctccatattcagccctcacgtcctgccaccccaagcccaacctccctgggttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctggactggcatctccaaggacctgggtcccagccccacgtcccccctcccccatcgtggatcggcaactcagccattgcactgatgaggtttcccccacccccaggaggagtggaatgtagtgatgtcacagtcctcctaggaactgtcattactgctgcaagaccggcctttgatcttataacccagtcccctaagcattctcaccccatttctggttcctctggtcacagcacaaatttccagctagaagggaaatggggaccatgggacctaggagcaagaggtttcaggctgccttactcccttcacatagacatcgacagtgtgaaaagcctacacttcccctgtgagctcaaaacgttgacagtatctctgggtggtaatgggagaatgggtttggtttggttttctcccaggcttctactctccagagagactttaacatttttttccgagttctccacctcatattctaattctccacggttctgggaccagactgcccttcagtcagtggtctctgaagtgagatttgctcatcttctgtggaataggtcttgggaaactgaacttgacagcttgaatcttcctcatatcatctcaacttagggtacattgagtgccacaggataaatgtgggagatctttctgaagcatcagtttcccttgattctcttgagagagaaaaaacattaatgtacttaggggtgaccctcacataggtttctaagagtataccagacttctctctgaaatgagacttgggttgtcctctttctgataaattcccagatttaacaaaaaagctgccttctgccatgaggacacattgatataaaagtttgagagatactggtgcacttcttcacactaacaggcatttgaggatgtatgactctaaaccacacagcgtgtagttcatgcctatgtaatgtttacttttctacctctgcgtctggttttggtccccggcagctgctgattcatggcaaaaccccagagcttggagtcagaagactgagtttaagttccattattgcccccccacacttttttttttagccataatatccatccctctcagtcacttaagtgattgtgacaacaccttgtacagttgttggtggcattaaatcagatggtgtataagagtattttgcaaaaactgtaaggagggtgtggctgtaagggctggtagttctcatgagtattactgctcttctttcccacagctaaaagaatatcagcaaaggaagagccctggtattccagcaggagcaaagacaaaaaagaaaaaaactgacagtagccctgagacaaccacttccggtggtggccactcacctggggatgtgagtcttggctggccaggctcctggggacagggggcccaaggggcagtagagggtaattgttgagattgctgggtactggttaagaattctgggtttgaatcctgcttcttcatctgctagcgatctgatttatggcaagttgcttgagctctttgggcctctcttttcacatctgtaaaataggggtagtattgtttgacttccatttgtgaagtttaaatgagattccttattgttgttgttttcatgttaacccctagtacgtggcctgctgtaaacacccaggatacccaggaaatggtcattgctgtttgattttcctgatccccactcgcaaggggaagctgggctaatgagtacagccacttgccatcaggctgtccctctaggagtcactgaagggggcccagggtgtggtgaggagagcccaaggcactaggagcaagagaaggtctaacttgccaccagcttgctgggtgaccacagaaaaatcacttcttctgctgggcctcagtttcctcctctgtaagatgatactggataagatcagtgtctttcaaacttgttttttagctgaagtccccttagttcaagtgaactcttactcaggagtctgtttttttttaatggaggtggaggtctggagctctaccagattcatcgtccatgtcctgggcctgaggagaggggtccagtgagcgtattaagatctgcattggtcagctgactccactctgtgactgcgtcactcgggggacttttccatctattttttcctgcccctggcaaggcagcaggtggccatttggaagaatggcacaggccatggttttaatctcctctgctcttcttcagcgtttccttttcctgaacccacatcttcctcctaccctgactttcttgcttctctctaagccacttctgtctttcaccccctgcccttgtttttcccttgtcacctcctgtagattcaggacattctgaaggtgcgggtgtccaaccttaaccactccaatggggtagtgctcccccattggacaagtggaaggtgaggcagtgccaagacccctctctggcttgctgtctacagctgtgcatggccctgaggcttctctggcttgggggatgcttggcctctgccttgttttatgttgctgccattaaccttcagcctgtttctgtctgcttcttcacctgcttgattgattgggttttttccttccccgcgtcttttattatcttggaaatggtgacgcctaaaagtttaaaagtaatctgggaataacgtacagagcaggcatgtgggatttgggctctttttttttttttttttttttttttttgagacagagtctcactctgtcactcagactggagtggagtggtgcgatctcggctcactacaacctctgcctcccgggttcaagtgattctcttgccttagcctcctgagtagctgggattacaggcacctgccactacgcctggctaatctttgtatttttagtagagatgcagtttcaccatgtcggccaggctgatcttgatctcctgacctcaagtgatccacttgtctcagcctcctgaactgctgggattacatgtgtgagccactgtgcccggctccttgctgtttttatactttctccatatacataactatttcccatgtaagtttttttttaatttctcatttttattactcctgcatcatctgttaccctgaaggatctggaagtaagaggccctgggctgaggtgcagtgactttgcaggccagccctccaacctcctctcacagtgggggctgggtgaccctctgccagctgagacagcccacacacaccccagccctaatgattgttctctctacctctccccacaatcctcttccaactcctcctctctgcatgtgcctcagagccagtaccaagaactagcagtagccctggagtcaagctcagtgacaatcaatcagctcaatgaaaacatagaatcattggtaagtccagtggggtcccctgattccatgctgccaatcctgggctttagtttccccttggggccctgaagaaaggggctgggggcccctggtgccaagggcaaatggggagctggagcacccaggcctcacctggagggaccccagagcaaggagcacgcagcatggctcttctgtcactgccctctttgccgactctctcttctccagacacccctgctccagtccttgccacacacgccctgaggttgtcacctctcagggaagcgctagcctgactggttgtcaggggccctgtatttctgccctgactcagtccctaatttgctttgagtctggacaagccacctgtcctccttgggcttgtgtttctggaggaggtagagcatcaaagttctctgttagctctgagagtctgagatttaaaggcccctagaatggaaacctgagggccaagggctcctgtctgtccttttccatcctatatctgctgtgaagaaccgtagctggcccgtatgtgttcagtaaatgtttgttgaatgaaggcacctttctaaatcacaagctggcagaagggtgggccttcctgagactccctctctagaggtttatgttactgtcctttcaagagaatccagattcaggctttgagttctgtggctgtgggcaaaaaccaacaaagacccaagtcctctgtccttgggagcttgaggagggttgaccagtttgtgttgccattggttctgagaatgttgcctttaaaatccattcctggaccctgcctaccgcttccaggtctggggaatagagttgagggggccactctcagtcacctgaatttgactctccccacagaaacagcagaagaaacaagtggaacatcagctggaagaagtaacgtgatttctttgctcacaacatgactgctgggtttgggggacactcagatgcagaggcgccagtctcatcttgcccactcccagcctggggaagaaggctcacccatcagattccaccccatccccacagggtccctgataacctggtcccatgggtgggcctgtcctggggcattggtggcattctgggggcatgtctcttgctgtgccatctctgcctccctgtgataagagctctgtcttcctcttcctacaggcaaagaaaacaaacaatgaaatacacaaagcacaaatggagcagttagaggtgagtggagggtggggagctttctcctgtcctctggagaatgtttctttccttctctttcagcatttccttggcttttctcccaaacgttcaattccagacaatcaacatcctcacattggaaaaggcagacttgaagaccaccctttaccatactaaacgtgctgcccgacacttcgaaggtgggaatctgggcatcccgtcatccttcaacctggcactttgacaggtctttagggggagtcttttgggccccatctcaacctctctcattacagaagagtccaaggatctggctggccgcctgcaatactccttacagcatattcaagaattggagcgggctctctgtgctgtgtctacacagcagcaggaagaggacagggtgagtccaaccagctgccccatcccctggcagcctggcttcccagatagaggagtgagcctaaaggtcccttctgcaggatggagtgtcctgcccagaaggcagcatggtcatttctcactacttttgtgtatggttgttagaggcagcctggggctaagtcagctgctgtgggtgagttggggggcactgtggggagtgagcactggatgcagagctcagaggccaagtgcctgccctgccctttcctggctgtggccttggccaagtcctaggtggggtattgggtagttgttctgtgaaggtacagaagagcacctttagtatgttaccatttctgtagagagaggaaaggggtgtgtgtgtgtgtgtgtgtgtgtgtgtgtgtactatgataatatacaaaaacatgtctgcaagcattcataaaaaactcaggagagagtaacagggtgcctggagacacctcccttctgtaccttctgagttttggactgtatgaatgtatcatcctttcaaaaagtgaacaaaagattaatttcccccttcctatctgtgtccccacccccagcaagaaaaatgggcttagagaataggatagacctgggtgttcaaatcccagctctgtctaagtgatcttaggcaagcacttaaccttgaacactcgatgtttttcatctacacaatagaggtaatcctagtaaccgtctcatatggtggttgtgaggattaaatgggattgctagcatggaacctggtgaagcactccataacggttcaaacagtggtagtaataacagtaataacaatagcaatattatctgatctctctgggcctctgttagccagctgtaaattctatctctttccctctcccttccaactttactgagttcttttaataaccaggccacgggcttggaaatgccttgacctttactgaccgagttgtatattgagcctagccctagcccttttaaggggcactgcccgagctccccagatcaaaacttctcactcttcaccatccagtcctcgagctgcagagaagcggtcctccagcggcggttacagcagaccataaaggagcgggcgctgctgaacgcacacgtgacacaggtgaggctttgcagagggagggatgtggaaggaagatgaccccaggtggccaggagcaggtgaggaccagtgacagcccttcctaacttctgtgcccatttcttgcaggtgacagagtcactaaaacaagtccagctagagcgagacgaatatgctaaacacataaaaggagagagggcccggtggcaggagaggatgtggaaaatgtcggtggaggtgaggtctgacccttcagcccccactttagataggtcactggatctttctgggcatctgtaaaatgggaatagtacagccagaggtggtcatgggtctgggctttgtggagatggggacagagaatgagatggtagcctgtccagccaccagcccctctctccagggccctttcccctgtgctttgggcaggctcgaacattgaaggaagagaagaagcgtgacatacatcggatacaggagctggagaggagcttgtccgaactcaaaaaccagatgggtaagatggggctggtgtgacctcggagcaggactggcatcagaggtctgtgggggtggcttagaatgccccagggaggtgggtgggtggaagggctttgaggcagagggaaagaggtctgtgccaggagacggcaagttttgtcatctccatgagcctcagggtccccatcagcaaagagggaggagtgcccgttgtcagccacccacagtgctctctatgtgaaagtggcttggaaattggctaccattgggtgcgaggaatgattagcagtgaggccaagtttgggaagcctgagaggagctgtgcatcaagaggaggttttttttttttttttgagggggatgtgggtagaggggttggggaatccagaggcccttattgtctgcttcatttctcagctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctggtgggttgccccacctggggagcctgccctcatccctatccctccaggcctttgtttccccacctgtaaaatgggccagtgtagccctcacatgaaatgctacttctaaaggcacctgtgagctacagctcatcgggctctgctctgatggctgtgggggagaagggatgatttttctaacctgcctccacccttcctggtgatatgggaggcagacaccaaggtctggtgtctccagctgcagtggatggccactgattgcttctctctgtccagaacaacgagaaaaagagcgcactgcagttggagcagcaagtaaaggagctgcaggagaagctagacgaggtgaaggagatggtaacctccaccccatccaagaagggctgggaggcgggcaccagcctctggggaggggaggtgccaggccaaaggcagctccagctgggaggcaggtgaccccagcaccctccagtgcagctctatgactgtttcttgcttcctgccctctgacttttagaggtgggtagccctgggctcctcccaggtctggacatcatcatcccagctagagacatggagcccccaatcacaggggaagagacagtggtacaagaggctccttatccaggcacggtggctcgcacctgtaatcccagcactttgggaggctgaggcaggagaatcacttgaggtcaggagtttgagaccagcctggccaacgtggcgaaacctcacccctactaaaattacaacaacaacaacaaaaaattagccaggcatggtggcgcatgcctgtaatcccagctactcaggaggctgaggcacgagaatcgcttgagcccacgtggtggaggctgcagtgagctgagattgcaccactgcactccagcctgggccacagagtgacactgtctcaaaacaaaacaaaaaaggctccttagattcaaactggattctggcctgggttccactggtcaccattcaactactgttcatctctaagtctctgtttctgtgacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatttgaggctggggaaggaggtatggggttctaggcaagggaggaagcctcttaggcctggagcaagggaccagggtcctgggcaggtgacagagccccacggtgccctcgctaccctattaatgggcccagaatctggaagccagccaccatgtgccctcatgcccagggtcttcctgcaggtggagctgaagagccaagagtctcagagtctgcagcagcagcgagactagtacctgggtcacctgcagcagtacatggccacctatcagcagctgacctctgagaaggaggcgctgcacaggcagttactgctgcagacccagttcgtggaccagctgcagcagcaggaagcttggggcaaagcggtggctgagatggccggccaaaagttgcaggagacccaggggagggagttgctgaggacggggccccgagggggatgacctggcaacctccgtgccttctcactctgtttcccgtccccttaggagcacctagaagctgccagccagcggaaccaacagctagagacccagctaagcctcgtggctctccctggagaaggtacaggagaccactcagaggaagaggagagagccccaggaggaaggggggactgttagcagcataggattgaggggttggaagagacctttagaacagctggtcgttatgccaaccgggtgtccgcactaagttcagcatcaatatggtgacctcctgggagcagggggccaccaggttgcctaaggatgaatgaactggaccagatcagaaagggagcaggtcaggactcccgcaccgaccggtagtgggactgtgcctgggcaatatagcaagatcttggttcttaaaaggaaaaataaagaacagcagctcactcccctctggggagaggctggctcagggttacacagtcagggtggggacagaggtaggcccacagtaccttccttgttgggttgtctgaggacccctctggccacctccccacaggagatggaggacaacatctggacagtgaggaggaggaggcgcctcggcccacgccaaacatcccagaggacctggagagccgggaggccacggtgagcctgactttccctgccccactttgccaccttcctctgtggtccctcccagagcccgttatgctcttggttttcccaccttctgatttctctggcccctcaccccttccgggagccagtggtcagacactttgtcacctgtgaccaacaggtgcactctctgaggccccaagggaaggggttgttctccacctccctgcctcatttgttctgtctatgcccctacaagaatactcacctcttgccttcaagtggcatttttcaactccgctggagccagttcccaggaggagcaggcacggctatgtgggcagcggaaggtgtgaaggctgtgctgcctgcacctggctcatctggtggccttggcctggaaggagccagaggcagaggccccagccccagggaggactggagatgagtttgtgtgtggggagagctaccgggccctgaaggaggccatggtgaagctgaaagggagtgagtcctggcatgggccaagaaaagtgggggcggggcagaacaggtcactcccgaggtgtgaccccattattttggctccagagcagctttatggacctcccgaaggagaaggcggacgggacggagcaggtggagagacgagagcttggattcgtccagccttctggagtgacagacggcatgagtgagcgggaggccagggcacgggcatggggagctgcagggccgtcggagggaccctagtgtctgagctgtgtcctctcacaggagagtccttcaccgtatatgaaagccagggggcagtgccaaacacgcggcaccaggagatggaggatgtcatcaggctggcccagaaggaggaggagatgaaggtagggcgtgcaacatctctgcggggttgggggtgggcatgggcactggtgcaggctccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggtgagtagagctctcaggcggggtgggcaggcaggggcaggggaggctcgcactgtgctcagacccccgcctccctctctccgaagttttttatgaagtgagcctggacaacaacgtggagcctgcaccaggagtggccagggagggttctccccataacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacttttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgcactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattcttcttaaggtatttagtgaagatcataagaaatcctttaagagtttaaatgtccctggaagaggcatacaggctctagtcaagaatgaattcgagtgaaggaaagctgtgtgacacctggccttcctctatgttcatggagcttctttgaggctagaagattgattttatcatctagacctctctggctaatacctattcttcaaccacactagttactctgacataggaatttacttcttttctttgaatggaaaacactttaaaaataataacaatcattattataaaccaatatatgtgagagtacttagttgaaacaaaaaggagttttagtagacagtattatactacacatgaaaatcaaggtgaagtttatgcaacttaaaatgtttacaagctgccgtgcaatctactgtttgtgagtgtccaagtattatgagaaaaagtgtctatacaatgacagacttatgtttcctcacaaagttcttcacaaagagtgaaatatgtttttatacctctcggtttcagttagaggcatattttgtgccatatttatgttaatgtgcctatacatgatgagtgaattatttcagtcatacattgcctaaatcataactttaagatgcttgggaaagaatcaacagctaaaagttcatgaagttctaatgtctgtgttccaaaatacgtcacattattaggatgcagggagagatgtgtgtgcgctccctggggtgggcatttctagttactagaccatctccatttttagcatttggcatcttcatgatacttttatacatatgacattaataggagagcaataatacgattttacagatggaataacagatgtgcctgcattcactgaaagagtgcaaatattaagtccttgtgacttcaactgactcttccaaattgtatgaatttatcaatgtattagataaacccagtttcagaattataaagaaaaactgttagaccaactaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcatatcactgttaattagccaccttatttggtctaacagtgggtttacctaatacattgataaattatttcaaaggtatttttatagttcaaatcacttcacttttaccctgataaatataaatgactaggaatgatcttcagatagcctttagcacctgcaaccaatctgacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcgtatgacaacaacttaagtctttcttcaaagtgcatgtggtcctttgcaatacctcattcagccaagtatttgttctcttcctcattcagtataaggcagctttcaatttgcttagaaggcaacattagaagggtagagtttaatcagaaacatagaattttaaagtgtgggttcaactgaataaatctgaatttctgtaggaagtaaagaattaaaaaccgatttaaagattgcaatatataatcatttttaaagtatttgattaaatctgataggttttccagaaatgaaaaaaagtcagttctaaaaccaaagctgatatttagaaaatgtgaaaatgtaaatcagccctatccataatagtttctctaaaactttatcttaaagagtcattttaaaagaatataactattcaaaaatgtaactgctatcttaagttttaaaataagttaagacattttgaaatatgaatactgtagtttaaaagaaagaaactgggggaaggaaaagtagagaaagaaatgccaattccaatgcaaagctttatttgccaagttttcttagaatgacttttaccaatttatgaattcttgtaaacagaatgtataatggaaatactgaaacactgttgcctaaagtggcattattcactgctactgtgatgctactgtaatgtaataaattattaaattgttgcaaagtgctgtttttgccttaaaattttgtgtgtcttgaaaactgtggtgttaaaggtattgagactgtgcaaatgctgggcacgcttggcatgagataatcggtttttatttttataaaattgtaatgtaaccatgaagtgtgtttatttgaagaacacaaacccaaagttatgggataaaaaaggttgtgggatgaaaaagttacaggataaaaaatgttatggaaaagttgtggcaaaaaaaagttgtggaaaaaacgtaaaagttttatgaaaagcttaaaaaaagggccgggctcgctggctcatgcctgtaatcccagcactttgggaggccgaggcgggtggatcacgaggtcaggagatcgagaccatcctggctaacatgctgaaaccccctctctactaaaaatacaaaaaaaaaaaattagctgggcgtggtggcgggcgcctgtagtcccagctactcgggaggctgaggcaagagaatggcgtgaacctgggaggtggagcttgcagtgagccaagatcgcaccactgcactccagccagggtgactgagcaagactccatctcaaaaaaaaaaaaaagcttaaagtattatgaaaaagaaattatgggattaaaaaataagtcatgggataaaaataaataaaagcaggcccctgtcagcataagcctggagaagtggggctggagtctctgtccctaccatgctcctaccaccccctcccagtcacccctttaccattagggtagcaagacaagacccctgtctaatggggggagaaaaacagaccctttgccaccttgaccagggctgagtccttaaatttctggatgatgatgattactatttaagagccagaggctggtagagctggtttgtttggaggaggcctcatggcctccctactctcaccgaagcaacttttccctcagggggctcccatcttcttattcagagaggcagctgaggcgggacagtggggctaactgtagagcaggcgagggcacaggctgctggggtggacccccttccgcagtgtacatatagtatctgtgtgacattttgtatattccagggggtagggccaccccctgtattgtacctagaggaggttggagctggcatatgaggaggaggttctaatcattatttgtggctgggaaacttatttattgatagcataggacagaggaaggaggcggggatggggttgtggctccctggtgatgtgactcccgtttattttgcttttcattttggagtaaatggatttagccatactgctcagcctggtggattcccgtgtccctcactgggtcctggagtttgtgccactgaacgaggagccctagagtgactgagcatgtccagctgggctcttggggaccttccaggcctgttacctgtatgctgcctggtgacacctggtggatttcacagggactgccatggcgcctatagggcacagtcccgccctgacagccaacagcctcagaagcctgatgtagcagtggccgggaagacaaataccagcacccaagggcactgacttccaccccaggcatcttccgttccatccccctgcctccctcgcctgtctgcacccggtggcctgttctgtctgtccctccagtgtacctggtggcctgttagtgctggctgccccgcaggctcctccagtctgagttcatggccctgccccctagtggccagagccggcttcgcaggataaaagccagctaagctccaggggctttccaggaaaagtgtcccttggaaagggtgtgtggccttttcactcctcccaacagcaccctagaaatggcttggccttttccctcccctgcgctccacagagaacacagccagtagaggacacattccccatcatccagaaatgggtttgattctcagccgagggacagcaggactggtagagactgtcaggccacacagctgcctgcacagcacccccattcttggtggggggtgggagggatggcgggggctggctgtccacaggccggacatgacagggaggctcactggaggtggcacactttggaggggcagtgtcaggggagaccttcctcttgttgggccacaagactccacaaggacagcacggtgacagattcccagtgctagaggcgaggcggtcagccatgtgtaggtgtatatatatatatacgtatatataactagatatatatatagagagagagagagagagagagagtatttatagatatttatagaacagggcaggggcataccacagagggggcacaagttttcagcaacggtcacacctggatcagctcaccactatgacagactaagtcacagatgaagggggctggctttggggctggggagccactgtccagtcacaggacacccgcccaggcaggcttggaaagggaggcctccgagaagaggaggatctgtttagaggtcagagtggggctggggctctcaggacgggatggacttgcctgacctgatcagctggcagttggagagaaagcagagagaaaatgggagagagaaatgtgagcagagagctggtgaggcaagcacagagcacaggcgtgctgcagcagctgtgggagggccggggaggggaggacacaggtgcaggtgtggcaaggttcctggaaaagaggggctggaaggaaaaggggaggaagatggagggaggagccggagcttcacaggtagtgcctgggggctgtggcagccctccccagcccacacacactggcctctcccacggcacccaggcagtgcacccacagttcagaccaatgctcagccccctcgggcttccctcttctctggtcaccctccccttccaacccactggcccagggccacctctcgccttggggagccccacccaacagccaccaggcctgatagagaaggaacactgcttgacccaggatggtgaagctaaaagggatggctggactgagtgagcgccagaggcccctctgggtcatcagaaagcccaggaccctctgaaaggaccctgggggaggcaggaagggcatatgccactggccatagacttataagtctaaggggggagcctcagctggttgtgggggcctgcaggttgcataggtgagcctgggcccctcctgctgggaaaagcagaagagggagagtctgtggcaggggaggtgggtgggctggctatgtggagctcagctgggccagcagggactgtggtccccttggctgaatagcacaggtgacccctaggagcaacaggccaaggtgcatgagcccgctggctggcggtagtgtttcagcaggggccagggaccctgccttcagtcacacgctagcaggtatgatggtatctgggagggagggaagggggctgtgtgttcctgcctggcctgtgaggtgtgttgtgggatgaccatgtgtatgggactctcaagattttatcctagatcaccactggattgccaacatatagaggaggtgggaccctgactatcaaccctgctctgcagtggatttggctctcggcactcccagactgggaactggataccctgccctggcagcatgactcagactgcacgacagttatgttgtgcccaggtgacattcctaggcctctggccgcctcagagtccagccccacacacaacgccctccacattcccagcccctacaccataaaccatgagttctctgccctctccgaggactctagagagcacccacatctgccaacttgggcatggaggctgttccaagagcccacagtcttagccatggaggctggggggctttggggccgtgggggccagccctggtacctgcatccagtaggatgctctgcacctgcagtcaggagttgtccatgggcccccgtgggcgtgctgattgtgttcatgaccgctgtgcctgctctgccgactcctccatcagcatgttcttgtccccatgcaagtacaggttggccagcagctccgagaagataaactccttgttctgagagtgggcaaagagggaaggaggttgggacctgatgcctgtgccaccctggccaccctgccaggccctgctggggctgtacgctggacttggagccccgggtatggcttttcagatgcggcttctacactgcttagactcgaagacccacctccccaccgctttttctcactcagatggggacactgaggtccagaggaaaagtcacctgcccaaggtcacagatctgggaggggacccaggatctatcatgccaccaggacacctgtctactcagtttttaatttttggagataggatctctctctattgccaggctggagtatagtgggcaagatcatggctcactgcagcctcaacctccttggctcaaagtgatcctccaaggttagcctgttgagtagctaggactacaggcaagtgccaccaccaggcccagctatttttaaaatttttttgtagagaccaggtctcactatgttacccaggctggtctcaaactcctgggctcaagcgatccttctgccttggcctcccaaagtgctgggattacaggcatgggccactgtgcccagtcccacgttataattctatgggacagctctggtctggaccgtgcccctctccctggacctggtcccatagggctggttgtcatctctggcaggacaacatggccacctgtgtccccagtgccacaggagccccctgcccccatgaggcggtgcacgcacgttgttgatcatgaggtgcatgatggtcttgggtgtgagaccaaccatgaggtcccacacggtcttgttgacaatggccacataggagtccaccaggctctgggtggtctccatctgccactccagctgtgggaccatggagtgcatgaagctgttggaaccattctcctcggccttgctggcctgctgtggagagcacgaaggcatcagggcggccaggccatgcagccaggctccaggcatccccaggatctcagccccctccaagggtacctggaacattgaggcacagggagaaacaactggccagaacacacacccagctccccacacaatctagagggtttcaggtctctgcctctcaggaccccagactctcccgattcagcctcgtcttagttctgactctagtacccagaatttgcctccatttcccaatccagaaattggaaaagaacatctccaggtccctcacttgaagacatggccagaggtggtgccatgctacagacacctggcaggaggtgggaagggcatactcactttccccttgtcctgggaggcccacacaccaacattgccgccaccgctgccacctgggagcacagccaaagtagacacacacaggaaaaggggaagggttgagtgaagctgggacactgcaccccaactttaatgtgttgatgaattcaatctgctaatattttgtggaggatttttgcatcaatattcatcagtgatattggcctgtagttctctgttttggatgtatctttggttttggtatcagggtaatactagccttgtagaatgagtttggaatagttgggtaaggcctctagttttggaatagtttgggtaaggttggtatgagttcttctttaaatgtttggtagaattcagcagtgaagcaccaggtcccaggcttttcttcgcagggagactttttattaccgctttgatgtcatggtttcttattggtctgttcaggttttggatttcatcacggttcaatcttggcaggctggatgtgtctagaaatgtatccatttttagtaggttttcctatttctttgcatacattgcttataacagccactagtgagcctgtgaatttttgtggtatcagttgtaattttcctttttcatcttagattttattcacttgtgtcttctttttgtcttagtcttactttggctaaaagtttgtcaacattgtttctctcttccaaaacccaacttttcatttcattgatgcttttgattgttgtcttcatttcaattccatttatttctgctctgatctttattatttttcttctactaattttgggtttgctttgctcttgcttttctatttctttaagatgcattgttaggttgattatttgatgcttttctacttttaaaaagtaggagtttatagccgtaaatttccctcttagtactgcttttgtcgtatcccataggttctggcatgttgtgtttccattatcatttaagaaatgttccaatttccttcttaatttcttcactgacccagagcatattatttaatctccatgagtttgtatagtttccaacatttcttgttactaacttctagttttattccattgtgatcagagaagatgtttgatattatttcatttttctctaatgttttaagatgtgtcgtgtgacctaagatatggtgtgtccttgagaatgatccatgtgctgaggaaaaaaatgtgtattctgtagcccaagggagaagacacctgcccccactctgctgcaacacacagcgctctgctcagggatggggcagtggtgtgctgttgttacacaaggggctctctgtcggggagggaacagaagtctgttctgtagtgtttgccattttcggtggtgcaaatattccatggctgatttcaaactgccaccgtcttctcagcctgggcttgtttgtacccacccttgggaaggctttccaggtatttgaaaggatgtgggtgttgtgatctcaactgtatctttattaggggacactccaagccaagttacgctaaagttcttgcagactcagaggaactgccctgatggtcttggataagatctagaagaatcatctgggctaccaggcattagagactcttattctgtacctgtaatttttctccaaaaaaacagtctgtctatctgtctgtctgtctctctctctctctcttcctacctccctccctccctttctctctctgctgggtcacttggagctggggtggactgatacaacatccctatggctaccaccactgggactgcacggggtcagacctaaagcttgagtaagctcaaggcccactgtcaacactacccggctattgcctatgctaagattcagattattcacaaaatgctcccaagtgaagaaaatactttaaccacatgaagtatcatgctacacaatatggtgtggtggggaagggtgcaggctctaaaaccagaaaacacgggttcaagtcctggccctaccaccttagcaaggttacatggtctctctgtgcctccatttcctcatctaaaatgtggggatgacaataatagtgtctatttcacagagttgttttgaggaaaataatatatgtaaagcactgtgaacagcagttagtgctatgtaagtgtttgctctagttattttaacatttcagatgataaatatctaccctgttattcagatgacaagcgtccctaagctgataacatgatgaagaacttttgggtttcttaattaccatcagttttgtgagggaaaaaataccacatgaagaagagcaactgaagcaggcgtgaggaggaaacttggcttaagattggggggcttggggttattaggctttcatcttctcaaatgtcctaagctccactgataagaagacgcttagtatcaatccagctaaaaaggaacaatagaccccacaagacactgagttagagacaaaaatagcagggtaataaatgaaatatggaaaactacacaaccagaaaaataaacagctaccagtacccaaaacgtggttaaatctcacaggattatattgaatgaaagaagccagccacaaacgtgcacatactgaatgatcccatttatatgaagttccagaacaggcgaaactaattcatggtgacagaggtcaggatcctggttaactttgaggggacagcaactgagaaagggcaagagggagccctctgtgttgatgggaacattctgtatcttgagctgagtggtggttacatgaaagtgcacatatgtaaatactatggagttggccaggtgcagtggctcacacctgtaatcccagcagttggggaggctgaggcaggcagattacttgaggtcaggagttcaagaatagcctggccaacatggtgaaacgctatctctactacaatacaaaaattacccagacgtggtggtaggtgcctgtaatgccagctactcaggaggctgaggcaggagaattgcttgaatgcaagaggcggagttttcactgagccaagatcgagtcactgcactccagtctgggcaacagagagagactccatctcaaaaacaaaaaaaatatggagttgtaacttaaggtatatgcacttcactgtatgtaagatactgtcttagtccatttgtgctgctataacaaaatatatgagactgggtaataggtaaagaataaaaatttatttctcacagttctggtagctgggaagtccaagatcaaggtgccagcaggtttgtagtctagcgagggctgctctctgcttctaagatggcaccttgaacactatgtcctaacataatggaaaagacagaaaaacaaaagaagaaaaccgagctaggtagctccctcaagccctttcataaggtcactaatcccattcacgagggggctcctcccttacagcttagtcatctcctaaacacttcacctcttaatgctatcacattggggtttaagttccaatatgaattttaaaggagacacaatcattccaaccatagcaaatatactctactaaaaagaaaaaaaggaaaatcttgtctctaaacataatattttaagagtttacatatttacagctcaattttctgcttgcttacatacatatttgtgaccatgagtgtcattattagccgagaaaagtttcagtaaattaaatttttttctcacattatctattaataccttattcagataaaaccaaatttctaacctagattttaggttgagacagaaacccatagtcgtttgttgcaatgtgagaatgacagagagagagattaactagcaggatccaactataaaaataaatttaagggaacagttctctactaatgactcccccagcaaatcattacttggatagcaatgaatcaactaaaaatggaagtgagaacagttcgagtcctttttgcaatggatggatgtttatgagactattaagtgaagaggttcacaaacaaggggataaatggcatggtaatttggagttgaatggagtaatcttggaaatataaaaatcgtgcttaatgggacttgtctacttgcaattcaataagccaacatacgtaaattcaaacagacgatggacatgaacactcagaacaaaattacagaagcagggctgggtgcagtggctcacgcctgtaatcccagcactttgggaggctgaggcggttggagaggtcaggagcttctgacgagcctggccaaagtggtgaaatcccgtctctgctaaaaatacaaaaattagccaggcgtggtggcgggcacctgtagtcccagctactcgggaggctgaggcaggagaattgcttgaacccaggaggcggaagttgcagtgagctgagattgcaccactgcactctagcctgggcggccaaggtaagactccgtcttaaaaaaaaaaaaaagaaaaaagaaaaaaaaattagccaggcgaggtgatgggcgcctatagtaccagctacttgggaggctgaggaaggaggatcactcgaacccagaaggtggaggttgcagtgagcagagattgcgccactgcactgcagcctgggtgacagagcaagactccgtctcaaaaaaaaaaaaaaattttacaggaataaatttagcaaagaggcaccaaagttaaggtaaggcccactgttccacctctgacgtctttaattcttgagtcatggggatggcaagccaggaacagagtcttctgactggaagctaaaaccagcctttgaggtgggtgcagagagactgttcagactaaagatgagaaaatgttcagactaaacatggtcgaaaatatcccgaaggcaagggcattttcaaagacagtggtgcttcgagaaagagaatgctgtgtgtttaaaaacaaaagaatggaaacaaggaagaaaaattgaccggagcgtagggtgaccatatgctctggtttgcaaggtacagctaaggttatgtctgctgtcctggtgcaattattatagtgcccctttcactctgaagtgtctggatttggatgataaagcatatggtcaccctaccaaagacaggaagttagccagaagacccatgtgtccattttaggcagtatggactgatccacagccaggctcgtgccacttcccagctgagcggtgtgcaccacctctgcctcgccctattccgccctgcccgggtttccaggaaggctggagctgaaccctcggctcccgcgctgctctggtgctacctgcaggttgtgtgggggaactgcttctccccaccccgaacctggacagccttggacttggcaaaaagactgtcaggtgctgttccccacatctcttgtctttccgctaacactttaggatagtgaggaagcaaaagagcttgagcttactaagctcctactgcgtactgggcacagagtgggcacttttctctccagcctcgcaattgatgggaaataggtgattgtacaactaggatacaggatcagagtgggctagcgacgtgctcacagtctctcagctgaaactggaacccaggggtctttgactctaaagctagtgctctttttgggtctccagcttgagcaatagttgcaaaatgcaaagagcaccatgaaaatctaatattgatccacataagaccgtattgcaaacagaaacatgcagtgtcttcgtgggagtgatggcgaggtggggagattatctcagttctatgtaacctgggaactctccaaggaaaatgaatgaagcatgaccgagtgcaatttgtctgataaaatctgtcagaacgtggggccttgtgggtcctgagtgaaggcaagaacccatggtgctggacatttgctaaggtgttctttatgaaatcactcagggcctcagtgcctccaccttctccatgaccccaggcagtttccccgtctgtcttcatcctactgcctggcacactatccatcaaactgcttttggggttatgtctcaataaaacaaaaatcatggtgggagtcatttacaccctagtgagagtcatctaagattcccttatcttctcagaccttttagctgaagttggttatgagagaggatggggagggggaaaagggtcggggcaagcacttggagcttgcactgtttcttgccaacgccctggcacagtgtgaatatgtccatctaaatggagagctctatgcatgttcctctctattccctttgtcaccaataccaattcccaaggcagagccccgggtgggctggcctgaaggacctggaggtaataggaaacacttggctttgggtttcaggtcaagctctgccagtgacttgctgtgtaacatcagacaagtcagttcacctctctgcacttcagcgacctcatctgtaaaaggctggtttggactagatcattaattttcttaagttttgcagttgttttttattttaacagtatattcaattcctcccctatctttattaaagtataattgacaaataaaaattgtgtatattgacagtgttcaatgtgatacatgcatacattgtgaaatgattaaaatgagttaattaacactttaatcacctcacatacttttttttgtggtaagaacatttaagatgtatttacttagaaatagtgtttactagaggtgaggaagggtaagggggagaaagtacccaaaggttggctaacaggttaacagatacaagagtacatggctgagtgcagtggctcatgcctgtaatcctagcactttgggaggctcacttgagcccaggagtttgagaccaggctggacaacataggagatccaatctctacaaaaaaattagaaattagccaggcatgttggtgcatgcctgtggtcccagctactctggagactgaggtaggaggatcacttgggcccaagaggtcaaggctgcagtgagttgtgattgcaccacttcattccagcctagggagcagagtgacaccctgtctggggaagaaaaacaaaacaaaacaaaaacaaagagtacagccagatgggaggaatagttctagtgtctttagcactatagggtaactataattcatgacactttattatatatttttaaatagccagaagagtggattttgaatgcccccagaacaaagaaatgataaatgtttgaggtggtggagatgctaattacgacttgatcattacacattgtatatatgtataaaaatattatactgtatcccataagtatacacaattatgttttgcttaaaaataataaaagcaggccgggcatggtggctcacgcctctaatcccatcactttgggaggccaaggcaggaaatcgagaccatcctggctaacatggtgaaaccccatctgtactaaaaatgcaaaacattagccgggcgtggtggcgcgtgcctgtagtcccagctactcgggaggctgaggcaggagaatcacttgagcctgggaggcagaggttacagtgagctgagattgtgccactgcactccagcctgggtgagagagcaagactctgtctcaaataataataataataataataataaaagcaaaaaatctactcttagtaattttcaagtatacattattaactatagtcatcatgctgtacaacagatctccagaacttacaacattatatttaattctgatcaaactactagttacacagaagtaacaacaaaatgatatctgttgcaagaaatcctcagtaaaacaagaaaagaagaaaaaaagaacaaaatggtagtgaaaggcttatatcaaaaagcatttcctctgccctttcctttcttgcctttgagtcctaattcctataggtcatcactttaaactcattttgcgacttcccctggtatgttatcgtcatatttctaaagaatgtttatgttgctatttcttgatttgttttcttcagtatctgtcagttcctggcatagctcagtatagggcttaccttcctatgaggtcttaatttccttgcctccatttcactaatttgactggatcacaatcgcatgaaatcaaaagcatttacattcttgtagccatctaaatattgaccctaacccaagtcccgcactgaaattgtttcatctctttcctttcttcccctggagttaataattgcttcagattattatccctcatttgctttttttttaaccaattacctacctattttttcagatgctccaaccaatctatcaaatgcctagtgataattatccaaaaactaagatacactggatactctatcagccccattattttcctggaggcttccctctctcccttgccctccatccttctgctccaaactggactcgactctcagcccatggcacggctggcattctgacatgtctctgcaccatcgtgtgaattttcttgctgcctcttctgtgtgcacctcctgttccctgatttactctctcattgtgttgcagtacatcttccagtgtcttcccgagaaagagtgaatggaagccaaactttctgaccctcacacattttagaatgtcattgttctaccccaactcctgattactagtttggctggatgtaatgctctaatttaagtgtaacttctcctcacattgggaaacattgctctattattttctagttcccagtgttgttgggaagaagtccgtgtcatgcagagtctcggctcttaacttatgacctgtcttttctctctggaagattttaggattttctctctatccttagttttctggaatttcctaatgatgtgccttgctgtaggtctttcttcattcaccgtgctagtcacctgatagactcttttgaactagaaaattatgtccttctattgcgggaagccaccagcaggttcatgtgagctgggtaatcacattcttttcttccaaggacggaggtatcaaggccctgggaaccttataagtggatggggagaaagggggcctgaggtgaatccaacaaagctgcagcacccactgagctcatgtcccagggctaggctctgcctgaggacaggagacatgggtgagacccacttcctgcccagtcgcatggtggggctcaggacacacatggtccaggaggcccccagccccagctacattgacatgcacctacctgtatgcagcgatcagtgagccacaggacaacttaggggaaggggcagctccagagtgcaggataggagggaagtaaataatcatggggtggggagtggccttgtggggaaggggcaaaggcagggccgtgtgtgtgtggtgtattgggggaaatggggagaacattttgtctgcccccttttctgaccactgcaccccttttatcatgaatagtttttcttcccatcatggactgagtgtctctgtctcctccaaattcatatgttgaagccctaaccctctgcatggctgtatttggagatgaggcctctcaggaagtcataaaggttaaatgaggtcctaagggtgggggccctgattcagtaggattagtgtccttataagacgagacaccagagagtgcactcactctctctctgcacaaatacaaagaagaggtcatgtgagcacacaatatggcagccacctatgggccaagagaagaggcctcagaatgaaacctaccttgctggcactttggtcttggatttcccagcctccagaactgtgagaaataaatgtctgtggtttaagccacccagtctgtggtattttggcatggcaccctgaactgactaatacatctccccaccctacttcaaccacatgacactagagggcttggcagttttggagtcccagctactcagccaacccagaccagaccaagcagaaactttcttctggaattttctgattaggaactaatggaggggagccccatcctttcttggaggcaaagccaggaagacggaagccccatggtgccaacagcctgactccaaccttgtggggaaagttgctctgagaacacaaaactgatctgcagactgaggtggagacagagacaaggaaaggagcctgcaaatcctaacagcactggtgattctgagtccaggtattcctgaggcccaactgttccctgccctgcccgtggctaacttactgaccaaggagcttcccttcttgcctaagccaactcgagtgaattttctgtcacgcacatccaaagagccctggctgcaatggcagggcatggcagggctgggctggctggagcagaggacggtgtgggtggaatcagcagtgacaggcacacaggaagtgcaggtatcgagtggcctccatgaggtcttcctccagccccgactgtgagcaaggctgggctcatacgctcagtaggtcagagtgagggatttggtcagaggtgccatgctcagggccatctttctatgagccagactctatgtcatcaaaagctttgccatcagagatagttttagtcacatcttgggttcacttgatcaattgctgttctcctgctttcaggatctctacactaggctgccccatgtgggtgttaggaagccataggcatcctgactaaaaacccagaccacaaaaagtgcttctaccagcctgcccagggctccagagggcaggaccgatgggtggtggggtgggccacgcctgggcagtcgtgacatgtacaccactcttgatctgtcttctggaacttttcactcctccagtttgggtcccggtggggcacacgtgggaaagaccatgaatacccatgtctctgactagtttccccatcagaagtggacgttgcaccaagcaccctcctccattaaaactggacagactaaggaccactttcccaatggatgggtcttcttggtccatctcatgctcccaacagagctccctccctgggatgggaatgcgccatgccaggagagccctcttgacccagcctccagccaaagccagtccccctgccaagcaggccctagagttacactggaggggaacaggcctcacctggaaatttcttgctgaaaattgtcagtttcccacacaagtacagcctggcagtttaattcaaattaaaaccagaaggagactgctgcttcagtctcgactgcttgaaaattacgttgtgtagagctttcatttgctggaaattgtgcagccagacattgtgcagattgacccagtagctacagcagtacacacatagggcgccaagcaaggacaagtgtgcacatgtgtgcacgcacacacacacagcagaaaatctagaaataaactattttaatgtcagctgtcatggaagttttgtgtcatttccccaaaaaatacaaattttattttatgatttagtcttgtttttatttagaattacttaaggaaaaggaaacgtgagtgcagtggctcatacctgtaatctcagcactttgggaggctgaggcaggaggatcacttgagcccgggagttcaagaccagcctgggcaacatggtgaaacccgatcgctataaaaaatatgaaaataagccagatgtggtagcatgtatctgtggtcccagctacccaggagactgaggtgggaggatcccttgggcccaggaggcagaggttgcagtgagccgagatcacatcactgcagtctagcctgggtgacagagtgagatcccatctcaaaaagaaagaaagagaaagaaagagagaaaaagacagagaaagagaagagaaaagaaaaagaagaggaaataagagaagagaaaagaaagagaaaagaaaagaaaaagaagagaagagaaaagaaataagagaaaagaaacaagagaagagaaaagaggagagaaaagaggggagggaggggagagaagaggaggggagaggagcaataggatcctgatatctggtgtggggaaacttaaatggatacatctgagaattctgaacctccagtttccactaaatgctctggtctaaaagaagtagccccctttccctgctaagagaagggcagctgccccttgccgggagactgggcaaagagcctccaacaaggcctcacagcaggatgaggtgtgtcgtcattgctgccccacattgacaccaggctatggtcattcttcatcatggcccaaggtcacaagcacagtctgctctgggagaatgatttttttttgccaaaaatgcaggagctgccgagtgtgtactggcagaatctaggagaggaggtgaagaagtggacataagggtgttggaccaggaggagactaaaggctgtatacacgagaatacagtgacctgggagcactctcaggatttaatgcttggcaaagacacctggggctccaacacagtgctggagtggctccttgaaatgtggacagaacagttgctgcagtgaattaggtggagattatagaattgcatttgcaaagcgtcaaagaagccagaaagtacagggaggtaggaatgttggaatggttcattatatgccaggagattcggaatccaccacttgactatgtgcccttggagggctcacaggaactcccctctctaggcaagcaaggaaggcactagtgagaagggcacctgaatctttgagagactcagtggcactatccttggtaggccaggatcgacaagaggagatgctgccatgagaccaggcttcgtggtgtcagtgggaacggtggaaggcgagaacagcggatgccaggtggtggcccttcaccatcatccacaaggtggatgtaattaacttaattggtaggaaggctagagtgacagccaggatgccttgacctccagggagctgttgtattggctacaaactgatggcattccaggggagagttacataggcagttgactagggtggttttttcttttgttttgttttttgagacaggatcttaatctgtagcccagtctggagtgcagtggcacaatcatagctctctgcagcctcaacctcctgggctcaagcgatcctcccacctcagcctcccaggaagctgggattacaggcatgcaccaccatgcctggctatttttttttttctaatttttagtgaagatgaggtcttgctatgttgcctagactggtctcaaactcctgagcgcaagcaatcctcctgctgtgacctcccaaattgttgggattacacatgtgagccctaggacatttcctgatttgtgtattcaggaaaaaacaagatctggcacgcagaaggctgcaacaaaaaattgcaatttcctacccagttttcagactgagacaattgagacctatagctcatggattgtaggggaggctgggtattcttggaaaaagatcctgcaacaacaccacatggtattcattaattattctccaaagggatctggggtcattgatgaaagtaactgtagctgatgaaaagggaatacccagactgtttgagggccattcatataggattagagctgaccatgccaccataagatccacaatgccaccatgtcccatccccaacaagactgaggacatgtgaaggctaggtaataaatggatccctggatgaagaggccacagccccatccggttgtcatttctctgtccctaaatatgcaattgatatgagtatgcttagaagctaacagagctctcactttactccctgacctgtgggtatgagccactatagtaggaagaacatgggggaagtctctgcaattccctcttcccacttccaggagcaatgcagtattccaggtggaaacacagagatttatcacctccctcaactgtgaccgctgccttataatgatagtattcttacatttccccacctgtcccttgtgccattctcatgatcattttacttccacatgttataaacacgacaatatgttactacttttgcctcggtcaattatttctagacatcacaaaaggagaaaataggatcttttctatttatccatgtatttattatgtcagtggtcttcattcctttgtgtagactcaaatttctacccagtgtcatttttcttctgaccaaagtactgcttttaacacttctcagagtgcaggcctgctggtgattatcctggcttttgtttgtgtgaaaaagtctttattttgtcttcattaaaatttttgaaatttttttgttgtttttttttttttgtttttgtttgtttgtttttgagatgaggcctcactatgttgcccaggctggtctcaaactcctggcctcaggcaatcctcctgcctcaacctctcaaagtgctgggatgattacaggcgtgagccaccaccacacctggcctcattgactttttaaaactcattttaatcccatatctgcagagttaatttttcatctctagtaattctttttgttttattttgacacaaggtctcactatgtgcccaggctggagtgcagtggcacgaaaacagctcactgcaacctcgacctcctggattcaggtgatcctcctgcctcagcctcctgagtagctgggactacaggtgcatgccaccatgcctggctaattttaaaattatttatagagataggtctccctatgttgcccaggctggtcttgaactcctgggctcaagcaatccttgtgtctcagcctcccaaagttctgggattacaggtgtgagccaccgcacccagcctgtgtttgtttgtttttttccaatatatcttccatttctctcttctcataatgttcagatttagatttttctagccttcttgaacatatggagcatatttatatgttttttaatgtccttatctgctaattacatcatctctgtcatttctgggcctatttccattgatttatttctcttctggttataggccatattatgcctgttgtttttttgttttgtttttttgttttttgttttgagacagcatcttactctgtcacccaggctggagtgcagtggtgtgatctcacctcactgcaatctccatctcatggttcaagcaattctcatgtctcagcctgccaagtagctgggactacagttgcgtaccaacatgcctggctaatttttgtatttttagtagagacaggatttagccatattggccaggctggccttgaactcctggcctcatgcaatctgcccacctcggcctcccaaagtgctgggattacaggcatgagccactgtgcctggccattgcctggcaatgttttattgactggtagacattgtttttgtgttgtgactgctggattttgttttcctttaaatagtgtgggactctgttccagcactagttaagttacttgaaataagttggatctatcaaggtttactttcaaactttgtgaggacagtttcagagaagcctttactccagtgctcatttagccccactattaaggcaatacttttctaaagcttctcttccatttcctaagtattatgaggtgttttcatccgcactagtgagaatatgaattctctctagcctgttgtgagctctggggattcttctgtctgctttctggcagttctttccctgggtactttcttctcacatacatccatatcagccctttgccaaaggcttgagggcatcttccatagctctccagagctcacgcgctctcttctcccacctcctccctggtactctacctcacaaattctaccggccttgaagaccttcccaagctctgatctctgtctcctcaatccaccaagaccactggactttggattcccctccctgtgttggagcctgtaagtgcttccggcagtaaaccgaggacactgtagggttcaccttcttttagggatcatagttctgctcgacctgttctctgatgtctgaaaactatcgttttatatatgttgttccatttttctagttgttcaaggtgggaggcaaatctggtccctgttagcaatcgtggccacatgtagaggttgcaggatgttgtttacgtctgtatcttttttttttttttttgagacaggctctcactctgtcgccccaagtggtgccctcttgcctcactgccaccttcactttgtggcctcaagcgatcctcccaccccagcctcccaaggtgctgggattacaggtgtgagccactgcacccggcctaaaattgtatctttcttattatcagtgaagttaaacattttttcctgtgtgtcagcggcatttgggtttctttttctttgaactttcatatttttttttccatttttcttagaatttttggtctttgtcttctctacttttagaatagaatgaatatgatattaatcatacttcgaattgtgaccatgatagagtacctgtattgatgatggtctcccagcataaacaactacaaagctggacaaagtacatgaagaaattgtcttcaggcattgggcaataggcagttccatgtacaatctgagagaagggaatcacatgaagtgactgctacatttttctggtggggaaagtttctaaaccctcaatgacagcacgaggaagcagagtccaagccaagaggatcagtcttgtttggtgaaggaaacagagactggtgctcagggctgctaaaatgtgtgtggcagagtatcagaaaggacggagttgcagaggagaagccccagaaatcttacagaggttgctgcaggtccttggccaaatcccaaacaatgagtgtgcagattgaggctctgcaaggcccagcacagaacagccgatggggagctgaaagctaaacagcgatttcagtcacagactgctggagatacatctgaattctggctcagccagagtctccactcttggaatctcagatcttgatgaatattccagacattcacagagggcctagaaggccatgccttgggattaaggaagattccctgggaataagggcaaaactgaaaaacaggtcaccctaacaaagcctaaaatgtacccttgacacacatgatcaagttaacccacgagtaatttaattccctgccaaaataaaactcaacactagagtaggataacataacccacatctctacaatgaaggttcacaacgtccaacagctcaagaaatactagatgtgtgaaaaaagtgagaaaatatatcctaaaattaagagaaacccagtcaatatgaacagacccactgtgcatggtggctcacgcctgtaatcccagcactttgggaggccaaggcaagtagatcacttgagctcaagacttcgagaccagcctgggcaacatggcataaccccatctctactaaaaattcagaaacgagttgggtatggtggtgtgcaggggcccataacccccaggctgtggactgtacccgtaggtaacctggtaggaaccaggctgcgcagcaggaggtgagtggtggacagcgagcattactgcctgagctccacccgccgtcagatcagcaggcattagattctcatagaagcgtgaaccctaatgtgaactgcacatgcgagggatctaagtttcacactctttatgagaatctaatgcctgatgatctgaagtggaacagtttcataccataaccaccacccccaaccccgtctgtggaaaaattgtcttccacgaaaccagccaggactgctggtggcacgtgcctgtggtcccagctacttggaaggctgaggtggaaggatggcttgagcctgggaggtggaggttgcagtgagttgagatcatgccgctgcactccagcctggacaacagagtgagaacttatctcaaagaaacaacaacaaaaaaagggccaggcatggtggctcacacttgtactcccagcactttgggaggctgaggcaggcagatcaccaggaattcaagaccagccagatgaggtggaggttggagtgagccgagatggtgccattgcactccagcctgggctacaagagcaaaattctatcacacacacacacaaaaaaaaagagagaaagcagacccataaatggctcacacattggaattagcaggcaagagctttaaagtaactacatacatacattaaagaatttagagaaatatcaacacctgtgaagatggtgaaaaaaaaatttagagaaataagttttagtataagtatgtcctaaatatgcatggtacatacttactaaaaaatagtttattttttatcagaaatctaaattcaactgggtgttctatatcttatctggcatctctaccccaaagccaagcaggagagaatccacagtcttatcttccagcaggtgacctagcctaggacagggcctggccaggggcaattgtgaattggatggattagagatgccagtcattcagtgtgtcaaaggtttgccagacctgcatacaatcaacattattattattattgttattttaatgttaagattttatttacaaagatttttgttgtacagaaagtaaaaatgctgttacagtcccagtgtaactggtagccacagatggttgactcaccaatcacagctatctacgctacagcaagagtctcacacaaaaacctaacaacacttacaattttgttggggtgaagtccctaagctcgatggtagattggtagattaccaagagggactacatggaggaagacggaatgtcacaggaactattctttggctctttgggtgggtgggtgtcctggggtttgtatcagctacctttttttttttttttttaacagctaccaaatccatgagcagtccaaccgatactaaacagttctgtttctgcaggtcatctggggtcttaatcatcttctccttcatcatccgtttctctcttcctctttttacctttcctgccttcttcctcctccttcatcctcatcctcatcttcatcttcttcaagtccaaattcttcttcctcctcactgacttcatcttcgtcatctccttctacattttcatcttcttcatcaaactcctcttcttcaccatcttcatcctcctcgtcttcttcgtcttcttcttcgccctcctactcttcatccacaccatccacctcagcatctgagtcaggttcctcctggtcctcttggtcatagccatccatgtaggtaagctggggcaggagcttgaagacactctcagtagtcattcatgttagtaacctcacagttaaagaggtccaggcttttcagacattctaactttttcaaaggttccaaggtgctgatatctttcagtttatttccacttaagtttagacgtgtgagatttggaagcttttcagctaacatgtccagacctccaaagattctattttcactgagttcaagctttttcaatttaggcagcttgggaagatttgaaactgagatcaagcctacatttattaaactaaggaactctaagttcacaaattcagctgttaagccctcaatttttccatcatttgatttgcaattgtccaagacaagttctcgaacagctgacggggtccagttcctcagctccaggtggatcctcctcttcatgtccatgttcccctcttcccccctcttcaaacttaactttccgcagcgggggcggatgggggagaggcatcctggcctgcacagcgagggccgtcagaagggtttgttcgcggcagaggccggcggcgcggtcctgggtggcgggcggcgtgggggcaggcgagcggagcccccggagccaagttactcacaggagcgtagaggacattatttttatttaattttttttttttttttttttttttttttttttttttgagacgagtcttgctctgtcgcccaggctggagtgcaggggcgcaatctcggctcactgcaagctccgcctcccggttcacaccattctcctgcctcagcctcccgagtagctgggactacaggcgcccaccaccacgcccggctaatttttgtacttttagtagagatggggtttcacagtgttagccaggatggtctcgatctcctgaccacgtgatccgcccaccttaggccttccaaagtgctgggattacaggcgtgagccaccgtgcccggccttttatttaatatttttgtctaaagcaactttaaaaatttaaacctgttatttggaaacatagattcagaggaaatttcaaagatggtacagagaggtttcatgtactcttcactcagtttcctccaaaggttctattttgtataaatgtagaacaatatctaacgatgtcatgtgtctaggtctataccattttatcacatatgtagactcctttaaccaccgctacaatcaagatacagaactgttccactgaaggggtggcctgccccttcacacctgtgggtatatctcgtcagatgggatgagagactgagaaaagaaataagacacagagacaaagtatagggaaagaacagtgggcccaggagacccgcgctcagcataccgaggacctgcaccggcaccggtctctgagttccctcagtatttattgattactattttttcactatctcagcaagaggaatgcagtaggggagcagggtgacagtggggagaaggtcagcaagaaaacatgtgagcaaaggaatctgtgtcacaaataagttcaaggaaagacactatgcctggatgtgcacgttggccagatttatgcgtctctccacccaaacatctcagtggagtaaagaataacaaagcagcattgctaccaacatgtctcgcctcccatcacagggcggtttttctcctatctcagaattgaacaaatctacaattgggttttataccaaaacattccattcccaggggcagcaggagacagaggccttcctcttttattaatcctcctcagcgccgatccttcacgggtgtcaggctgggggacagtcagctctttcccatcccacaaggccatatttcaggctatcacatggggagaaaccttggacgatacccggctttccggggcagaggtccctgaggctttccgcagtgcattgtgcccctggtttatcaagactagagaatggcgatgacttttaccaagcatactgcttataaacattttgttaacaaggcacaccctgcacagccctagatcccttaaaccttgattccatacaacatatgtttttgtgagctcaaggttggggcaaagttacagattaacagtatctcagggcaaagcaattgttcagggtacaggtcaaaatggagtttcttatatcttccttttctacatagacacaataacagtctgatctctcttttctctacattccatcaccatgaaaatccccctcctgctattcctctgcactcattcctggctcttcccctccactattcctactcctggcaaccactaatctgctttctgtctttataatcttgtcacttcaagaatattacaaaatgcaaaaattagctaggcatggtggcaccagcttgtagttccagctatgtgggaggctgaggcaggagaatcgcttgaacctgggaggtagaggctacagtgatcctgccgctgaagtccagcctgagaaacagggcgagactctctcaatgaatgaatgaatgaaggcctggcacggtggctcacacctataatcccagtgctttgggaggccgaggcaggtggaaccattgaggcctggagtttgagaccagtctggctaacatggcaaaacactgtctctactaaaaatacaaaaattagccaggcatgatggtgagagcctgtacttccagctacttgggagactgaggcatgagaatcgcttgaacctgggaggcggaggctgcagtgagcccagatcgtgccactgcactccagtctgggccacagagtgagacttcatctcaaaaacaaaataaaacaaaaccaaacaaagaaaaaaagaacattatataaatggaatcacacagtatgtggccttttgagactggcttttttttttttctactcagcaaatgccctttaagatccatccaagttgtgcatgttcctttatgtttttttctgtttgagatggagtctcactctgtcacccaggttggaatgtggtggcgtgatctcagctcactgcaacctccgcctcctgggttcaagcaattctcctgcctgagcctcctgagtagctgggattataggcacccaccaccatgcctggctttttttttttttttttttgagatgaagttttgctcctgttacccagtacaatggtgcgatctcggctcactgcaacctctgcctgccgagttctagcaattctcctgccccagcctcctgagcagctgggattacaggtgcctgccaccacatccagctaatttttttttgtatttttagtagagacagggttacaccatgttggccaggttggtcttgaactcctgaccttaggcaatccacctgcctcggcctcccaaagtgctgagtttacaggagtgagccattgtgcctggccccctttttattgttgaatagcatttcatagaatagatgtagcagtttgcttaaccattcacctattggggagtatttggttgtttccagtttgggactattacaaataaatctgccatgaacaatcatgtatgagtttttgtgcagacatcagttttattttctggtacaaatgcccagaagcaattgctaggtcatatattgaggtatatgtttaattaaagaagctgccaaactgttttctagagtgtctgtaccattttatattcccaccagcgatgtatgagagagttagttttgtctgcatcctcgccgatatttgatattatcactatgcttgatttgagctgttctaatagatctgtagtgatatcttactgtggttttaatttgcatttccccagtggttagtgttgaagatctattcctgtgctttaagtcaattcatttttaaaacctaaataaatgtatttaaaaaggaaacttttgctttgggaggcccaggcaggtgaattgcttgagcccaggagttcgagacaagcctgagcaacatggtgaaactccatctttacaaaaaataaaaagtatccagagtggtggcatgcgcctatggtttcagctactcaagaagtgaggcaggaggattgcttgagcctgggaggtcaaggctgcagtgagccatgattgcatcattatactccagcctgggtgaaagagcaaaattctgccttaaataaataaattaattaaaggaaatttgtgattagtgattctcagagtgtggaccctgggccagcaacatcagcatcaccatcacctgagaacttgttagaaatgcagattctcaggcgccgtcccagacctcctgaatcagaacctctgaggcgtgggttcagcgacctgtggtttaacacgccctcccggtgagaatcggtctcattcactacagatagaaggaaatggtaaaaatcaattcatccgcatatcgcctaaaatcctcttgtgggccccaggttggcacagcacacttttgggcaggagccccactcacagaggccgtgacaagaatgctcctgcccctggggttgtgcagtgacagctcacacagctccacgtggcggttctgagtttgggaagcgctgatgtagtcctactgcagcccttcctgcccttcaccggactgaggaaatccaggctctgaggagggcgagacttgcccaaggtcacccagcaacatggtcagtctcctttcccagggccctcacaatgcgtggcctgtttaaagcctgcctctattcactgctgagtgaaaaatccagctccaaaacagaatatggggaaggatactatcttgtgcagcttatgtttatagctgcagatacatgggaaaaaaagtctgaaaatactgttgaagcagttatttagggagagaagtggtttgctggttttttgtgtttttagcttttctgtatttcttaatttttatcacaataatcatgtttagttacataatcaaaatgtattaaatataatattaaaaatcaacatgaagcctgatccagccacggcctattgttggcagattcaggaagccttccagatagagcagccccgtacctgccccaggtcacaccctgggcctgggcacatgctaggtcctctgtctggataccctcaccccatggtggcctccacatctgtacccaccagcacctcctgtgggcaaggcccttgcctgcatccagccctgggcaccccctagaccagagggcacctcatggtctgagagtctgcctgtctctaaagagaggaaagctccttgggacacgtgttccacttgactatcacccctggcctggtacagaaaggtggacggtgggtatttggtgaataaatgaatgattggaatgaatccccagaatggtgatttccagaggcccttctccagctggcccaggtggaaccatttccacttttcacaggaaagccaggtgtgaggagtggggcaggtgtgtgtgaggggccaggttttcgaaggctgcatggacatggtgctttggggggtctgggggcggcagtgctgctgtgggagcctcagggagggctcatccctggaatcccccagggtatcctagtgcccccagctgctgtgcggtgtgagaattcctggctggtggggacacacagggatttgtttggattggccacctggtccagcccaaggagctgcacctccagccccttggggaaaaactcacttttgatgtgtgacaacagctgcaggcaaggggaggaagaggtgtgctgggcctcagccttagaagccagaagccagttcatgcccctaccttggtctaggtgggaaagggatgcggcctcagctagctctagggtcctgggttatggtcagaaccctcccttatggactcagtgacttgggctgacccagcccctccctgagcctcatcagtgaaaccagggctgggccagggccctcaacacctcccagctccaacctctggctttgtcccaggagggcaggagatgagacagaggtgacccgggctctcctgtttacctcaacctccttgtgaagcctccctctttctgcctgtgaggtgggtggggccggaaggagggaccacctgtgggcctctgacatctctgcccaggtgtgcctgcagagcctggtctatacccggtgctctgctacaccctacagcctggccatgacctccctgcctccagagcagctctggcccagggaagaagctggtctctgcatcgaatgataggtagaaaatggaagtggggatgatagctctgaaaaggagtcaaggaagaagctggtctctgcattgaatgataggtagaaaatggaagtggggacgatagctctgaaaaggagtcaaggaggaggtgccttcccaaggacgtggaggatttttccagaatggaacttgactggtgcgggcaaacatcaggaggtaggaagggtggctccctctgtgggagccggggccacttgcctgggccaaatggtgctaggctgtgggtaggggtgggcagagctggggttcccagagcctggggtccctgtccttgcagaggactcgaatgcaaaacaagtgtcccctgccttctggctgggggacatcctctgcttccaagcccagacatacaccagctgctacaagcccctggggctcttcagaggaccaatgggcagccatacccacgctgggccagcctgctggacccacctgcaccctggtcagagcccatgactgaggggactctctggggacaatgggggcagtctcatgctgccctcttacaggtggatccatccctgggatctggtgttgggctggggtgggctgaggctgttctctgctggggtgcctggtggacagcaggtggagcaagttctccttgactttcctggaccccaggacacagctgaacactgcactttaccctggatgccttcggattctcaggggatcctgggaaggaagagggggctgcccctgcagggggccagggctctgggccatgcttgctccccccagtaggcaccttctctccagatcaacatcacctgattcctgaaggcctgggctactgaccagagccccaactccttcaccaaggcctgtcttacatcagaccagctagtatgagtttggagccgaagggggcagagagagaacgcagggctctgtaagcgttctcggctccctgctgcggtaggcccagtagaaggccccctagaaatctgcagctgctgtaagtcactgggaggaagctgcagcagacgtgtgtttcccagcctggtagatgcagaggggtgtccgggcccccaggtgggaggcccaaatgaggccttggttgtggcagtgcaggaattctagccagctctggggccctgggcaagtcatttaacctctcagaaccctactcctggtcaccatggggctcttgtgtggatgtaaagaacccccctggccacttatgtcccatcagtggaagcctagcatgggtggagacccccgagactgaactcagtggtgggatccagccttcccagctctcctagatagagcccagagccagcagggtgggcttcctggagaagcaggtgctcctgtgggctggagagcatgagtaggggtccctttggaaaggtggaagaggctgcggtcagtggaggccataatgaggcagagcttgggcagaaggggcatgattgggggatctgaggcccaacagagactggactgaggacactatggccacctacaggacactgtgctactcaggcagtggaaacttagctagggctgggccccctggtcctgagtgaggcttcaccagtcttggaaactgtgcccaaggtggcttcatgtaagagcgcatctcagcacttttttttttttttttttttctgagacagggtcttgctttgtcatctaggctggaatgcagtggcaagatcatagcttactgcagcctcagactcctgggctcaagcgatcctcccacctcagcctcacaaagtgctggaattataggcctgaggtatgcagctcggttttaaatcttaataaatatctcctcctggtctgcttccctggctgacacacatgctggaatcttgcgcctagacagacatgtttctggacttggttccatttgttctgacggcctcctctctctcaatgaccgcacattacagtatgtggctattcttacacatttctgtatagacttgagggttagtatattaacgtcaaagttctactggtttttcaaggctggatggaatgtttgggttaatttagttgtgggcatcttgacaatataggctttccctccgggaacggtgattctgggacgcaggttttgcacattctggtttattgcttggctcgctgccacagagggatggcactgctccacacgccatgcccaagagatgtcccaccttatctttctaaatcaagctgaatattctcagttgacaggatatcatatcagtgctgcggggactcacttccccacaacccgagatgaagtgaggtggagactatggagcagatccgtgctgactgcattcacccttcctgacccgcactgctgctggccgcggctgtgtctgagtcgacagacagcattgatttggggacggggtgggggggcggtgctggagagatgcccctcacctcccttagctcctcctgtccagccagtgcttggccaccaaggcccctgacttccaggccccagtcaccactaacagggtgctgcatgggaacaaagtgtaggcccagagcctggagttcaggtcactcctccttccagtcgaagcctctatccctcccaggtgagtccaccctcattcctccatgggccaaatatcctaaacaaaggcctggacatggggtctttatccaagtgcccagaaaacacacacagaaaggctctgcaggcccccgtggcctgtcagaggtaagagcctgcccatcaaaatgcacagtccaggttcttgcagggaggtgaggaggggaggaagaaaaggtctatctcattctttcagcaggaacctaaacttgggaaagccagacgcagtacatttcttaatgatcctgatacttttataactggttacagcggggtcacatgcacaactgttttccaacatctttcaacgggacacataacatcctgcagcttatttttttattttgtaaggccaggggcagtggctcatgcctgtaatctcaacacttttggaggctgaggcaggaagtctgcttgaggccaggagttcaggaccagcccaggcaacatagcaagacccaggatacaacagagaaagaccctggctcaaaaaatatcttttccaagtgcagtgccatgatcacagctcaccatagcctccaactcctgggctcaagcgatactcccacttcagcagctgggactatcagagcgcagcaccatatctggctgatgttttaatttttagtagagatgcggtctcactatgttgcccaggctggtcttgaacgcctggcctcaagagatattcccaatgcgacctcacaatgcactggggttgcaggcatgagccaccatgcagcccctgcaaaatctaactgtccttcaggtgctccttttggacctcctagctagactgccattggcaaatgccagttgattatccacccacatgtatgttaatggatttcccatgttttatttgtctagaccaggctttctccacagcagcactgttgatgtttagggctggacagttctctgttctggagctgtttgcgcctcgcaggatgtttagcagcatccccagcctccgcctgccacatgccagcagcactcctcagtgtgacagccaaagtgatttcagatactgtcaaatatccccagggcggcaaaatcacctccagttgagaactgctgacctaaaaccctctggaacaatgttagatcatggtaatgatagcgcatactgctcctgaccttaatgggaatacctctagcatcaaagtatagtagtacctgtatactactgtctgggctgttattagtacactgtattagtccattctcactccgctatgaagaaatacccaagactgagtagtttataaagaaaagatgtttaagttgactcacagttctgcatggctggggaggcctcaggaaacttacaattatggcagaagatacctcttcccagggcagcaggagagaaggagagcgaatcaaaggagaaagcctgttataaaaccatcagatctcgtgataactcattcaccatcacgagaacagcatgggagaaaccgcccccatgattcaattatctccacctggtcccacccttgacacgtggggattattgcaattcaaggtgagatctggatggggacacacagccaaaccagattatatcctttatattagcatactgtatcgaagtataattttctttctttttttttctttgagatagagtctcggtctggctctggctggagtgcagtggcacgacctcagctaactgcaacctccatctcctaggttcaagcaattcttgtgcctcagcttcctaagtagctggaactacaggtgtgtgcaccccctagctaattttgatttttttttttagtagagacggagtttcaccatgttggccaggctggtgtcaaacttctggcctcacgtgatcccgccactttggccttccgaagtgctgagattacaggcatgagccaccgcacccagcctgaagaataatttttacaatgttaaaagcatgactttcatacaaataatgaaggaatatgtataagatattttctttaattcacaagggagttagcaacatggtgaagcaagttcaaggagctttttgagagacagtgtctgtaatgctccaggaagggcattctgaaatgtattctgagatagagacaaaacttgttaatatcctatagggaggtcaggcatggtggctcacacctgtaatcccagcactttgggaggtcaaggcaggcggatgacctgaggtcaggagttcaagaccagcctggccaacatgttgaaaccctgtctctactaaaaatacaaaattagccaggtgcagtggtggtcacctgtagtcccagctactcaggaggctgaggcaagagaatcgcttgaaccctggaggcggaggttgtagtgagctgagattgtgccactgcactccagcctgggcggcagaattaaattccgtctcaaaaaaaaaaggggggccgagcgcagtggctcacgcctgtaatcccagcactttgggaggccgaggcgggcggatcacgaggtcaggagattgagaccatcctggccaacacggtgaaaccccgtctctactaaaaatataaaaaaattagcccggcgtggtggcgggcgcctgtggtcccagctgctcgggaggctaaggcaggagaatggcgtgaacccaggaggtggaggttgcagtgagccaagatggcgccactgcactccagcctgggtgacagagcgagactccatttcaaaaaaaaaaaagaaaatcatattgggaaataaaactgccatctttgggtgttatcttttccactggacagaaaccctaagttaacatatatacatattctcaagaatattcataacatattctgtagtatatttccctacactagtggttttcaaagcatggtctcaaatgtcacctgggaatatagacacgcaatgctcaggccccacctcagtcctattgagttagaaactctggtgtgaggcccagcagccggtttcacaagccctgcaggtgatgatgatgcactctaatgtgtgagaaccacggctctaaatagtcaaatcatcttttttttttttttttttttgagacggagtctcacactgttgcccaagctgactgaaatgcagcggtgcaatctcggctcactgcagcctccacctcccgcgttcaagcgattctcatgcctcagcctcctgactggctgggattacaggcacccactaccacaccctgctaattttttttgttttttttcagtagagacaggttttgccatgttagccaggccaccgctctcgaactcctgacctcaggtgatctgcctgcctcggcctcccaaagtgctaggattacaggcatgagccaccgtgcccagcctttatttatttatttatttatttatttatttatttttattttattttatttttctgagatggtctccttctgttgctcaggatggatggagtacagtggtgccatcatggttcactgcagcctccacctcccaggctcaagagatcctctgacctcagcctcttaggtagctgggacaacacgtgtgcaccaggacaagcgggtaattttttgtagagactggggtctccctatgttgcacaagctggtctagaactcctgggctcaagcgatccaccggccttggcctaccaaagtgctatgattaaaggtcttaacattcttaaaaaatttttttgacatggtttaggatagtctagtaacttaacgtactgttgttttcaacaggctagtggttatgatttgtaaaagaactcttcagaaatgagctcaattttaccatgaattggggacactttacatttctattttatagtgcagtttaattgtcatgggctctgtcttttaaaaacctgaaagcctgcaacaataaaaccagctgcacctgttgcatgggataggcatggaattgaggagagagctcaaactacagtcagccctctgtatcctgaggttctggatccttggatttaaccaactgtgcatcgaaaatatttggaaaaagtaaaacaataaaaaaacacaggtcgggtgcagtggcgggcgcctgtagtcccagctactcgggaggctgaggcaggagaatggcgtgaacccgggtggcagagctggcagcgagtggagatcgcgccactgcactccagcctgggcaacagagcaagactccgtctcaaaaaaaaaaattaaaaaactttataacagctatttacaaagcatttacgttgtattaggtattatagtaatctagagatgatttaaagtatacggaaggatgtgcacaggttatttgcaaatactatgccatattatatcagggacttgagtatctgtgaattttggtatctctggggtcctggaaccaacatcctgaggttaccaaaggacgactgtattcaattttgtctctggttattagtctattctcaaatgtatttttcttgttgttttgtctttttgtttttgcctcttcaagtcaatgtcggaaacttagttgttctagactacccattagctcagagctaccagtaatcagactaccactgcaacctaagcaaccgatttttcttccccatcagactggcaaaaattaagataagcatctattgatgttgaagctgtagggagttttcctgagcaagtaattatgacagccctttttgctaggcacctagatgattcatcaaaatgaaataaaatacccatgcacttgaagaagttatctggtttatttccttacctgggtgctggttatgtgaggtgtacagttgatgaaaacttattaagctttataataggtacaattttctgtatgtgtagtagacgtcaatagtttttaaaatgtcttttgccacagcccgcagctgtgaataatgctattcgcttaacagtggaaaacgtgtcaatgacctgaaacaccctggctcccgggatcctacccccttaagttaaacaaatgaaataacttccactgtctttcctaatgtcttaattcggtcctcagttaaactggcggttggcgccagttttttccagggaaggattctgggagacggaggaggagacgccagcatttcgccccctgcacctccagcgggctgcggtccgctcccggcctcactcgagcaggccccgccctcccagaggcagttagtccaagtcacgtgatcgtcgactcagctgaccctgcgggaccggaaaaagaaattcccgggccctggcttcttggcgcgatggtgaggcactaggggcgaagcgaggcttgggctgctggagcgggaatgagggggcgccaagtggctccggaaactgggggaggttgtactggcctctccgcaaacacagtgtgtgcgggcgtgagggctgtgagtctggtagggaaaagtccaccactctcccgctcccgagacgggggcgggggtacggggcgggtaagacagagcaggccggccggcttagagtcccggtgcttccctggcggaaggaagggcccctgcctcccggggcaggaactagggcttgtctggagctgggagtcctttcaggtcttccccatccccaagaggacctcccaaggatacccccttccccagccctgccgtggggcttgtacaagaaggtgcttagaatcaggctcactcttccacactgttaggaagcccctccgctctttccagagccagaaagtagtagttttggggttgagacttatccatccatccatccaatccatccatccgtacgttctaagcgcctggtctataccatgaagtgtgctaggcactgggaggacttgagctgccaagggaaggggaaatcggaggcttgaattggagtcatagctaaggctccaggggcagagacctaactgcgccttgtgtgtagtgctaagggggcttcctaaggatgccatcaaacttaaaggcggatggatggcaggagctggctggctgaagtacagtttgtgtaccaggggtagggaggcaagggtgggagacgtgtgtcttcagacagggaacagcatgtgcagagacttcaggttagagagagtatggctccccaggaatggatgcatttcccatagctgggagagtatcatctgcaggttagggaaagatgaggctggacaagtagagaacaaatcttcctggctcttggatcaccacaatcaagataatgaacgtatccactggcctccataatttccttgtgtgaggggctattttaagaagtataatcaagaaaggctgttctggctgggtgcggtggctcatgcctgtaatcctagcactttgggagagtgaagagggtggatcacctgaggtcaggagttcgagaccagcatggccatggcactccagcctgggcaacagagggagactctgtcttatttttttattttttaaaaaaagaagggctggtctgatgtgtcacttaaaggatagcaagccactggccaggcgccgtggctcacgcctgtaatcccagcactttgggaggctgagggggacggatcacttgaggtcaggagttcaagaccagcctggctaacatagtgaaactctgtctctactaaaaatacaaaattagccgagtgtggtggcacatgcctgtaatcccagctacttgggaggctgaggcaggagaatcacttgaacctgggaagcggaggttgcagtgagccgaggtcgcgccattgcactccagcctggggaacaagagtgaaactgtctcaaaaaaaaaaaaaaaaggatagcaagccacacagagagtgcagcaggcatggaggcgggagcaaggctggtgtgccccagcagcagcagggaagctggagtggctggagttgtgtgggtatggggaagaggggagagagttcactcgtctctgtgaggcccaggactttgttttatcccatgctgtacccccagcacttagagtgggagctagcacagagaaggtgcttaattgatgtttgctgagcagatgaatgcctggagtagacctcagagcagggtttggtggcagggtgggtcagggagagagtttactcaacagcctggtgataggggagaacaagaggccagagggtatccatctatgtcggggaccaggggtccctggtgggcagcagtgtgggagacacacggatcctggccacacctcaggcctccctccagcctgattacctgcctccctcccttgcagaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccaggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcagtaagtatgaggccagccagggtccgggctcattctagaaggtgcacgcagcacacaaagtgcatggagagtccagggagacgacttaaccacggtcacatggttactagcagccgtagagctgggacctggccctgggtctcctgactccccacaaggtttcttgtcactgaggtctgctgtgggtgatcagaactgattatcgggcacctgccctgttctgagcctgggtcagcaggatgggagcttcttagaggccacatagccttgaatggttgagagctgagccagggtgtcggctgaggtctacttggcttgcctgctttgatcctgagagccacccaccccatctcacagtgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcaggtgaggctcagctattcctcgacgggtgagaggctctcccagatccgcctgactgcctcccacctgcccacctcttccctctgcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaatgtgtgcagggggttctgtttgggttcagatcaagggtttttgtgagagaaacacaagtgacatacaggccttcttggtccatcactcattttcttttctcaattgctgattgagggaggtcataggtaaggccaactgaggaccaaaatgcatctgcttgtctggtgagaagaaaatcagggttctagctcccagatctgggatgctcttggctctgctgtctttgccccctggccatgtcctcaggctagcagcacgttggtggccccaaagccaaatgccccttgtacagaaaggagattgcccttgtttcactgccatcttctatttatttatttatttatttagagacggagtttcgctcctcttgcccaggtttcactgccatcttgttatttatttattttgagatggtacagtggcgtgatcttggctcaccacaacctctgcctcctgggttcaagcaattcttctgcctcagctgcccgagtaggtgggattacaggcatgccccactactcccggctaattttgtttttttttttttttttcagtagagatgaggtttctccatgttggtcaggctggtctcgaactcctgacctcaggtgatccacccaccttgccctcccaaagtgctgggattacaggcgtaagccactgcgcccagccactgccatcatctttaggaagagagaagtgaccatgcctgaaccagtcattggcaagaggaacggtgttatggactgaatgttcatgttcctccagaattcatatgctgaagcctctgtccacacatgcacaccagatgagggccatgtgcgcacacgaggtggctgtctacaaggccagaaagagggctgtcaacaggaactgcgtctgctggcaccttgatcttgaacttcccagcctccagaactgtgagaaagaaatctctatggtgtaagccactagtctgtggcattgttatagcagctcgagaagactaaggcagatgggcttccaggactggcccagaccagccagggctccttgtagaaaaggctgatgccagggttggcacatggagggtacaaggaggactcgcctggagtatcttaaggaacctatcgaagaataatggcttgttccactggccaaagatgggacaatttgaacatcaaaagagatacttactgactccactcctgacttctgcttctgaaaaaatgaagtaggtgttttccctattcctcccactaagtacagttaacaaccctggatgttacatataaaacaaacaaaaagactccgagcgatggagagaaggcaccctagcctggctgggatcctcaggacctgaggctccacagagagaaattcctggaatctggaccccatggcccagtcaggttacacaaaactgatcatcacagatctgtagaactatacaaaagtgctaacattcatgattagggtctcagaaggtaaggaggaagagagtggaatggaaaaagtattcaaaaaaataatcactaaaggccaggtgcagtggcccatgcctgtaatcccagcactttgggaggtgggacaattgctttagaccttgcaactggcctgagcaacacagggagactcagtttctccaaaaaaataaaaaattagccgatcatggtggtgcgtgcttatagtctcagctactcagaaggctgaggcaggaggatcaatcgcttgagcccaggggtttgaggctgcagtgagctgtgatcatacctctgcactccagcctggataacagagctgagaccctgtctcaaaaaaaaaaaaaaaaaaaaaaaaaaaatgtatatatacacacattggaatatttttcagcccttaaaaagcagaaggttctgtcatttgtgacttggatgaacctagacgacatgatgctaagtgaaataagccaggcacagagagacaaatacctcgtcacctcacttatgcctggagttgaaaaaagggcctggggcagtggctcacgcctgtaatcccagcactttgggaagccaaggtgggaggatcacttaagcccaggagttcgagaccaggctgggcaacatggcaaacctgtctctacaaaaagtaaaaaaattagccgggtgcagtggcacatgcctgtggttccagcacttgggaggttgaggtgggaggattgcttgagccagggcggtcaaggctgcagtgaaccatgatagtgcccctgcactccagcctgggtgacagtgagaccctgtctcaaaaaaaaaaagttaaattcatagaagtcgacagtagaatggtggttagcagaggctggaggagagagagggtgggttgtggggaaaaggggagacaccggtcaaaaggtacaaagttccagttaggaggagtacattctggtgatttattgcccagcgtggtgaccagttaataatgatgtatacttcaaaatagctaaaagagggttttaaatgttctcatcacaaagaaataaatatttgaggtaatggatatcctaattagcctgatttgatctttttttgtgttttttgttttcttgagacagagtctcactctgttgcctaggctggagtgcagtggcgtgatcttggctcactgcaacctccgcctcccgagttcaagtgattctcctgcctcagcctctgtagtagctgggactacaggcatgcaccaccacccctggctaattttttgtattttttgtagagactgggtttcactatgttggccaggctggttttaaacttctgacctcaggtgatccgtctgcctcggcctcccacagtgctgggattacaggcatgagccaccgtgcccagccgatttgatcattccacaatatatgcatgtaacaaaacatcacactgtactccataaatttatacaattattatttgtcaattaaaaataaaactatagataagtcaaactggtattctaaaaaatgctccaccagccacagttgggcaagaagaagcaaaaatgaaaactgggaataaacaaagtgataaaaaaatcacaaggagactatccttggcaacatggcaaaaccccatctctacaaaaaaatacaaaaattaggtgtggtggtatgcaccattgtcccagctactcaggaggctgacgttggaggatcacctgagctcaggagttcgaggttgcagtgaaccatgatcataccactgcactccagccttgagtgacagagtgagatcctgtctcaaaaaaaataaaaaagaggttatcctgtctttttagtcaggataaccaaatagccctggtcaatgaggtaaagctatacttgacagatggattctatcaaatatattaagaatgacaattagaaaatcactttgaggctggacacggtggctcacgcctgtaatcccaatactctgggaggccaaggcaggtggatcgcttgaggtcaggagtttgagactagtcttggcaacgtggtaaaaccctgtctctactaaaaatacaaaaaattaggcatggtggcccccacctgtaatcccagctactgggaggtcgaggctgcagtgagccgagattgcaccatcgttctctagcctgggcaacagagtgagacctgtctcaaaaacaacaataaaaacctaaaactttattttcttttgagacaggatctcaaagcgaactttcgtatttttagtaaagacggggtttcaccatgttggccaggctggtcttgaactcctggcctcaagtgattcactcccccctcggcctcccatagtgttgggatttcaggcatcagccactgcgcctggccaaaaacccaaaactttatattcattgaatagcaactacccatttcctccttcccggcagctcctggcaaccaccattctacttgctgcttctgtgtgtttaactgtttaggtacctgatataagtggaaccatgaagtatttgtctttctggggtttttttgcttgtttgttttatgagacagagtctcgctctgttgccaggctggagtgcagtggcacgatctcagctcactgcaacctctgcctcctgggtgcaagcaattctcctgcctcagcctcccaagtagctgggactacaggtgcccgccaccacacctggataatttttgtatttttattagagacggggtttcaccatgttggccaggatgatctcgatctcctgacctcgtgatccacccgccttggcctcccaaagtgtcgggattataagcgtgagccactgtgtccagcctaagtatttgtccttctgtgaccaacttatttagtgcaatgtcttcgaggttacccatgttgttgcatgtggcagtatttcctttttttaaaggctgaataatattccatcatataccacattttttttaggggggcagggatggggataaggtttcactctgtcatccaggctagagtgcagcagcatgatcacagttcactgtagcctctgactcccaggctcaagcagtcctccaaccacagcctctggagtagctgggactacagatgcataccactatgctaattcttttcttatatagagatggaatctccctatgttgaccaggctggtcttgaactcgtgggctcaagcagtcctcctgtcttggcctcccaaagggctgagattacatgcatgagccaccatgcccagcctattatatatcacattttaaaaaatccatgtatcggttggttgtttccacatcttgggaataatgcttcaatgtgtgttatctcttcattggggtggcagttacatgactatgtgtttgtcaaatattgcagtctgaaaggggtaaattttactatatgtaaattatacctttatttaaacaagagaacaacaaagaaattactccatagattatttggtgttcacaaggtatgaaccatatgttttctaatgcagaggtctggctgccacagcccctgtcttgatcagtttcagctcccaataaagtgggacaatgagatattgggtgcctcctgatatgatgcaattcaaagtacagagcagtggccaggcgtagtggcttatccctgtaatcccagcactttgggaggccgaggcaggcagatcacctgaggtcaggagtttgagaccagcctggccaacatggtgaaaccccgtctctactaaaaatacaaaaatcagctgggagtggtggcatatgcctgtagtctcagctactcaggaggctgaggcaagagaatcacttgaacctgggaggcagaggttgcagtgagccaagatcgtgccactgcactccagtctgggtgacagagcaagactccatctcaaataaaacaaaacaaaacaaaaaacaacgaagtacagagcagcacctaggaagtatccctgaatatttatataatcaagcctttagatctaattcccagcatgcaggatgaaccacagatagaggaccaatctctgtgacaatatcagtgacaccctgaggatacattcagacaaattgagaatgtgatgcagcatctatctcaaacaacaactggctgagactcttcagaaaggtatcatgaagataaaagaaggggatgaagtgggtgggagagggaaggtggtttcatctagatttaaaattattaaaaagatataatccagccaggcgcggtggctcacgcctgtaatcccaacactttgggaccccgaggtcgggggatggcttgagcccaggagtttgaggctggcccaggcaacatagtgagaccacatccttacaaaacatgaattagccaggcgtggtggtgtgtgcctgtagtcccagctacttgggaggctgaggctgaggatcacttgagcccgggaggtcggaggctgcaatgacccatgattgtagcctgggggacagagtgagaccctgtctatatgtgtatatatatatatatttgggacaattggggaaatctggatgtggactagctattagatgatattaagaagttactgttggctgggcatggtggctcacttctgtaatcccagcactttgggaggccgaggcgggcagattacttgaggtcaggagttcaagaccagcctggccaacaaggcgaaacctcatctctactaaaaatatgaaaattagccaggcatgtggcacacgcctgtaatcccagttactcgggaggctgaggcaggagaatcacttgaacccgggaagtggaggctgcagtgagccgagatttcaccaccgcactccagcctgggtgacacagtgagaccctgtctcaaaaaaagaagttactgttaactaatttctaataacttagatattattagatattgtcaactaatatcaagttgttaattctattcatttattatggcagaagtattttaaagtaaattagacaaatcatgacatttcatacccaatactttaacatgcatctctaaaaaccaatttcttacaaagccacataattttattacgcctaataaggagacgtagcagggtagtgtgaaggaggggaaatcgtggcgatgggttaggtatacacttagaatgaagtgcagactccacacggaggccctcccgaggcccaaccggacctgacctgggtttgcttctctgtcttcacctgccagcactaacccgcagctatactccagccacacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggtaactgccccgaagcctgccccaaagcctggaaccccccaagctcggggaccccaccccgaagaatcgcgaccgcttccctgagggactacacctcccagcggctcccagcgcgctcccgggcaccgcccgttctggcgttaaccctttagtggctgcagtggcgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggcaagtggcaaagcagggagggcggaggtgaggagtcgataccccccaccccagggaccaggcgctgccgcgggccctttccctcccccaggcccggggcaggagctcggggagcccttcctggtgcccgccgtcctcctgcggagccatggggagcggctccagcgcatggcggcagcccgcccgcctcgtcctggcccctgccctgacccgggggcggccgcggggatgtccggtccgtggggcaggcccggttctcgctgcggccaagcggccgattcggccgctcccgccgctcccccgcgccaggccgagcttcgctctttccctcggtggtgagcggccagatccaggcgggtcctaagtgtggggggaggggggcgcagggaggggcggccacgcgatcctaagaccctttcagatggtgggagagcctggagaaagagacagcgtgtgcggagggggtgctccctcagatggggggtcaggaagtctccctcaagtgtctgggacagagggacagcaggggccaaggcggagatgagatccgtgagtgaggggagccgggaagaagtaaggctgcagccgcggccccgcaaggattgggactttcgtctaaacgcggtggaagcccatggaaggaagcggttagcagcaaggcagagtcctgctccctctgcagccccagctcccagcgccctgggctttccaggcacctgtccgggtaggggattgagggccgtggccaggcccgcactttcctgccagccgcagctggccacatgcccatctgaccctccgagttctcctctaaaaatggggctgacagccgctacctcacaaagtccacaccgggctcaacccgctgccttcctccccaacaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggtagggccagcaccaggtgtgatgaacatagtcgcgggctccacacctgactctcttagtgccttcttggccaacaaggggcgagtccctgccccttctgggcctcagttctctcatctgcagatcaagacagtatacctgtcctgggtcagctccctgagccagtgggcatggaaactcaaaactaattgggggccgggtgtggtggctcaagtctgtaaatcccagcactttgggaagccgaggcgggcagatcacgaggtcaggagttcgagaccagcctggccagtatggtgaaaccctgtctctactgaaaatacaaaaattagccgggcatggtggcacatgcctgtaaccccagctacttgggaggctgaggcaggaaaagcgcttgagccggtgaggccggggttgcagtgagctgagacagcaccattccactccagtctgggcaacagagcacgactctgtctcaaaaaataatgataataataactgatgggggaggagagaggagagccaagaggaggatgggtaggtactgccctgaggacatgtggccagttagtgtcagagaagctggggctcccacccacaatcccacaccacctctcagggctcccaggaggctaagaaggtggaggggctttaatatggtaagtgaggctgagcggaattgtttcaaggggatggggaggggactatctcatgacatggcttccgccttgggctttgtggtctcccacatccggcctgcccagtattctgtgtcctgtggtctcctctgcgccacttccctgcctgcagtagggtgtaacagccccacctgggatgtgatgcaggtcacctcacatggcacagtgttggccacttcctttcctctgaagaggaaacgtgtatgagtctctgcttcatgccaggccttgttctaggggctcggggtacagcagtgaacaagatgaatgtggtccctgctcccacagaactgatgttcacataggataggggaatgagaaatggacccatgccttaggaaaacccaacaggtgaaggaggtagaggatgacttggccgagggtgggggtacattagcaatggccactctagggaggtttgagctgaggcctgactgatgagaaggagccagccagaggaaggcattggaactggcaagagtcacaaatgcagaggcctggagtagggttggcaagttctccctttctgggggatgctgtgcgtccgttgacccttaggagacttggatacctgtgggatgggttggagatgtctctggtgccttagaagaaagttgactcctggccttcccctgtgtgaactccaagcacatccccagggaaacatctgtctttggtcctggattcctcccacctcagccttcctggggagtcacgccacaagttaactctgccagctggctctgaagtttctctcaaaccacgagcatttgggctgttttcttagtcccccagctggggcgtgtggcaattggcttacctcagggatcagggcacctcccaggctacccttgtaccttcaccccagaactctgtcttctgacccactcatcacacccattagtcagtcttgccatgacccttttccgcaaagaaacaagatgcacatcctcttcacggtgaggaggggagacccatgacccttggaggtggggtgggggctgctagggccctcactggtactccacatatctcctgcacagagccagacaatgtccaggatcttgagaagaatggaccctaccaatggcaaacccacatatggtctctaacccaccacaaatgctatacagggagctccagactgcaaacacacttgaggtcctgtggccacactgttctcatgtcctgaggagtctgaggtgataaacacacaacctcatatacaacctcatgttgctttttttttttttttttttgagacagggtctcgctctgttgcctaggctagagtacagtggcgccatcacagctcattgcagccttaacctccagggctcaggtgattctctcacctcaacctcctgattaactggaaccacaggagtgcatcactaagcccctggctacttcttaaatttttggtagagatggggtcttccttgttgcccaggctggtctcctgggctgaagtgatcctcctgcttcagcttcccagaatgctgggattacaggtgtgagccaccacaccagcctcaagttactttagatcagtatttttcacctttcacaatgaatttatttttaattttgtttttattttttgagatggagtctcgctctgtggcccaggctggagtgcaatgctgcgatctcagctcactgcaacctccacctcccaggttccagagattctgctgcttcaggcctcccaagtagctgggattacaggcacccaccatcatgcctggctaattttgaatttttagtagagacagggtttcaccatgttggccaggctggtctcgacctcctgacctcaagtgatctgcccgcctcggcctcccaaagtgctgagattacaggcatgagccactgcacctggccgtcctttcacaatgaatttaaatcccttgatgttcccatttaacagataggaaaacgggggcagggagaagaggaactgtaactcccagtttccttccccttgcacccagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggaccagaggttcttcaatggcattggcaactatctgcgggcagagatcctgtaccggtcagcaagcaggcatgggcatggggactgcggtgggccaggtgtgcccacattccccactgcctagcatggcttgccttgcccccactacaggctgaagatccccccctttgagaaggcccgctcggtcctggaggccctgcagcagcacaggccggtaagcccagagagggatggagcacacgtgctggcacactggtgtccacatgggccggcaaggagatgggtggggtcaggtgtccccagcttagctcaacaacaggggtggggaggggatgaactgcccaaagtctgaccaagctcagagagaaggtcagctgcctttacatggccctgctgacagacaggtcctgcccctgccccttcctcagagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccatcctggccaacatggtgaaaccccatctctactaaaaatgcaaaaaattagccaggtgtggtggtgggcacctgtaatctcagctactcgggaggatgaggcaggaaaatcgcttaaacccaggaggtggaggttgcagttgagctgagatcgtgccattgcactccagcctgggcaacaagagcaaaactccatctcaaaaaaaaaaaaaacaaaaaaacagtgtttcctccaagctgcccatgagacaggcaggacaaggattcttttatatatttatacacacacacacacacacacacacacgcacgtttatatatatttttggtagagataggatcttgccatgttgcctggactagcctcaaactgggctcaagtgatcctcccacatctgcctctaagtagctaggactacaggctcacaccaccacaccgggctaattgttaaaaattttttttgtagagacagggtctccctatgttgcccaggctggtattgaactcctggcccctagggattctcccatctaagcttcccaaagtgtcgggattacaggtgtggccactgcacagggccaggacaaggattcttaatcccactccaggatgggaaacccatggccgagtgggaagaaaccagctgaggtcacatcaccagaggagggagagtgtggcccctgactcagtccatcagcttgtgtagctgaggtctgggccaggtctaaccaggctccccactcctcccaacctgagcctgccctctgatctctgcctgttcctctgtcccacagggggcaaaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggtatggctgcctgctcccgcctcctcccctgcactctgcagccctggctgcccctcccaggcagctgccttaccctaagagggcggggggagtggtgggccctaaccaacctctgaactgctttctgagcccctcagggacccgtgtctcctccatccaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggtgggctttcctcatcactcccagaaactggctctacaggagaggatgggatggtggcctaggagcgcgtgtacaaaggtgggagaaaggctgccatggcagcccctggagtcttagctgaccatcttgcctgttcttcccccaggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttcttggcacctcttggtctgagatggccaggtaggaagggcctgctgtccggtcctggtgacagaaggcccagctcctcacaaggcaaactgagcccccatcccagtcctcaaggctctgactctatcagaggacagtttgcctctgcaaggacagcccctcagaggtggtacaaagaccctggccccaggcagcccaggagccagagctcctccagtccagattctccagggtccagggctgccccctcatcctggcaggagccaggcaaaacccacccttcggcccctccccagccccaggcccaggccctttacctgctggcacaggggaggggcttctcaactcatggtctcttcactggcttttggtggctcgaggtccccagtctctcctgtgggggctgcaacccagaccctgcacgcacaggtaccttaggatcttgcccctacccaccaaatacctgggaagccatcccaccccagacttcccacccccaccccaagcgtgaggatgggccctaaggggactgagcagcagggttcccgatccaaggatttattccacaagaaaagactgatccctgctttaggctggggaagcagaaattaggagtccccagagccttctacaaacaaaaccccagccccagggactcagtgtggcggaggctgaagcacgagcaacagggacagcacttggaagggagaaaaggtgagcttcaggcggttgtcccgaagggtcaagtggccagcagggtctggtcgctccaagagatcgcagctggagaacaggaggggccatgaaggctctgcgagggcgagactcgacccccgccccaatcccacaccgccactcacaggatggcctcctgaaccggcagcgacaagtgcagccagcagtccacgtggctgccgtgggcctcatacagcctcaggaccagcgagcggcgctgggggctgctctccgcctgcagaggaacacgtctggtgggaggggccgagggcaggcccagttcggaaccccgtccccagcacgtcccaccccttgcctgcttgacggtctccaatacgaccgcgggtgaagacacggaaaacgcactccaggaggtggcgggcgctgggctgggggctggcagagccaacagggggaagtttaggctgtaggcagcttggataacgccagcatcctggaaagagcctggggtacgaccaggaaacaatgctggtggagaatgggggctaccctcccctgtccctagaaggggcaggaagccaggttgctggggtttgggctcagggaagggcagagaggtgtctagggctgcaggaaggccccaccgtccccagcactcacccttgtgcggcatcagtgcataggtgaactcgtggcgccccgtgtcagcagtagcgtccggggctttaggcgcccgcaagctggggtgaggagggcgcgtaggggccacgctgaagctgttggagttgtggtcgggaagacccatttctccatgccagctcccaggcctggtgggtaccccacttacagcgagaggctgaggatgctgcctcgcactgacgcgccatacttgcagtcgttgagcagggccagcccaaagccgtgttctgacagatccatccagcgatgggcccacacctggagggcagatccaagacccacttggtggccctgtgcccctctttgtgctcccagactccagagctcctgtcactaggccgagcacaagctctagaaccacacaactgaactccagctcccactgtacggggccctgggcatgccacccaacctgcctaagcctcagtttccttatctgtgaaacgggaataaataatagtactcaccccatcgaatgatcatgagtatcaaattaaatgtaaaactttgtttttttcacacaggatctcagtctgtcacccaggctggagtgcagtggcttgatctcggctcactgcaacctccgccctccaggattcaagtgattctcctgcctcagcctcccaagtagctgggataacaggacatgtgccaccacgcccggctttttttttttttttgagatggagtctcactctgttgccaggctggagtgcagtggcacaatctcagctcactgcaacctccgcctaaagggttcaagcgattctcctgcctcagcctcccgagtagctgggataacaggacatgtgccaccacgcctggctaatttttctgtatttttagtagagatgggggttcaccatgttgtctatgatggtctcgatctcttgacctcgtgatccgcccacctcggccttccaaagtgctgggattataggcctgagaacactgcgcctggccaatttttgtattttttttttttttttttttgagacagagtctcgctctgtcgcccaggctggagtgcagtggcacgatcttggctcactgcaagctctgcctcccagattcacgccattctcctgcctcagcctcccaagtagctgggactacaggcgcccaccaccacacccggctaaatttttgtatttttagtagagacagggtttcatcgtgttagccaggatggtctcgatctcttgacctcgtgatccacccacctcagcctcccaaactgctgggattacaggcgtgagtcaccacgcccggcccaatttttgtatttttagtagagatggcgtttcaccatgttggccaggctggtcttgaactcctgacctcaggtgatccacccacctcggcctcccaaagtgctggaattacaggcgtgagccactgtgccttgccaatgtaaagcatttagtgcaatgcctggcacacacgttaggaagcagcaaatgttgattatcctcttcctccccagcctgttccacacaagcagtctccccagccagggaggagtccaaggccactcccaccctgccatgtcagacctcaaatcgagcccagtcccaagaggtattgtagtgggtaggtcgctgcaggtgcccaaactggatctcataggtggcctgggaactccgcacgcgagcagggaactccaccttcaggaacttgtgggcctcatgccagtgtacctgggagtgggaaggagggtgggagtcagggaaggaagagacacaccaaggcctggggctggcccctccttaccaagcacacttggggaaaacagccaccccctaccccccgactacctcggtgtggaagcggacataggggcagccaacgtccagcacaacctcctggctaagccgactgttggggctgatctgtagcaagaaccaggcgctgccccgcaggccgccctcggtgcccactgccagggtccctgcctggcccagcacaggcttcctatgggacaggggtggacatactgatccagagcagcctgtgttcccaccacctccaccatccccacatgctgcccagcctataccgtgtctccaggtggtagtccatgacgtcccatgcatcccagtacaaggggacatcatcaaatagcacaaactggttccccacggcgccctcagcaatggcctccctggaaggacatgggattggtgctgtacaaccaactgacctcgctgtctccagctgctcttggtggggtagggtggagtgagtagacccagtggacaggggactactgcccagcctgccctgctccatgtgtgggttccagcccagagccactggtgggctgctgtgggcagtgttgtggcaaggggagagaggaaatggcctggggtctacttgccaggcactgggaaagggcaatgaggatttggcacctgccagaggccaccaggaccaaggacgtcaggcgaccagttgggtccagcttcactcggatgatgccattgtccagagtcacggagccatcagtctttgtgggaggaggccttgaggctgagtctgtaggggcttcccacaccaaaagtcttcccaccccaaccccagccccgcctcaccacttgctccagacaggggagctcaggaccctcagttgtaagaaagtatcccagcacagttcctgccccccagggcatgcaggactcacctcttgcactacgaacacaggctgctggggcagcaggggctgcagtgaggtggggggaggaacaggagcatagcccatgctgggcactgtcaccagggctgggggtgaggcctgggcatcagtgcagccttcctgacctttcaggaagcttgcgcaggtggggatgggttggtggaagatgtgctactactctccagtcaggggcacccagatccctcggggtatcccaggcctgatctgtctggcctccatccttcctgctgcagtagcaacccttcccctcagctcgtacctaggctgtgggccccgcccggtttgggcagggccatcacttcgatccgcttccagggcagtgtgttgacgatgaggaggccctcaggacctggctccccagcacacagggctgcggctgcagcgctgagcagtgtattgccatgggaacggatgtctgaggaaagactggctggtcataggtgggcaacaggtctggaatgtgcccatgggtatcccacaggggacactctgggctcagccctggggttggagagagcaggcaggactattgtgagcctaaccttcataatggcacatggcttcctctgccaccatctggatgcagcttccagtcaccacatcatggaactggttcagaagaaggagcctgcaggggccaagggcagggatgggaaggctgggaggggcaggcacagaggtaactgcagtgagcagtcaggtggatggcagggacagaactgggctgacctccagaggtgctgcagctgggctgctgggtataggaactgggcactgcgggccagggccaggctactgagcagctccacgtcgtgcaggatccgctcacattcccggttccccttcttgatctgagcccaggatgggaagattagtctggagcctgcttagctgtcccaggacaccttccaaagccctcccttgctcagaatccctgaggactcaccaagggcctcgtggagaaggcctctggcgggtgacctgccttaaatgccttccctcttctccccgcagcccaaacccttctttcttcaggggtttctgcctccttcaagctttcttgaccaacccaggtcttgaacttctctcctccaaacttctcttcccctagatctggcctgggctctgtcccctgctgccttctctgaccctctgcagatcaagggcacaccctccctgcacagccctgcaacctccccctgacctgggcatgggtggtgtatgtgccattgtgcagctccaagaagagctccccaacccacgtgcacagctgctctgagtcactctccagtgctgagaagagctgtcttggagaagatagctgcaccctgaggagaccacaagcctaggtctcccagccttggagaccacatggctcacccttcttccacaccaaagcaaaggatccagctcctacagagaggagccactccagaaagctccccgttcacagatggccagccctggacgccctaggagagcctctctctctgatgggctggagcccttaccagcttcagcttctcccccacccacccccagggtggaagtttggaggaacccgtggtctaggattgggacaggacaaggtccagaggaggggttgggcccaatgtctgagggaaggcagggctcatggcaagggcccagggtggggctaaaggagagccaaggcctggcctgacctgggcagcccatccgtattgctcaggcgcttcaggcggtccagcatggtctgggtggggccaccacccccatccccaaagccaaagaggaaggcactgtggttggcccgccccttgtcccggttgttggccacggtcttcagcacctagacaggtgagggcaggccagcatggatcagcctggaacaagccagccctctccagcctgcccctaccccaccaccctaggtgacccctcacctcctccacgctgccctgcatcccataggagtcgccaggtgggaagtggaccagtacacgggagccatccaggccctcccagaaaaatgtatggtgctaccagcagggaaacagaagcagggcagagaggccagagtcagggctgaggcagagccaggccttccagacttggtcctgcccctgcctgctatgtgaccctggcagaggcagagtgagggtttggtggtctgtctaggaccccacaataagggggagaggcaaatgggccaggcgggactgaggcccactctgaccctgaccccccgggggcctgcttactgggaaggagttcaccaaattccagctcaatttctgggtgagaaagcgcctgatgccacagccgtgcatgatctgggggagctgtgctgagtagccaaaggtgtccggcagccagaactgtggagaaagaggatcctggagtgcaggaaccagagctccaggcggactcaccccagcctcagcccctcagcactccaagtcgagcgccagccccactcgcccacagcctggtgtagcagctctcagcctacctcagagcacatcttcccaaactcctgcagaaagaagttctggccctgcaaaaactgcctcaccatggcctctccactgggcaggttcccatcctggcagtgaaggaagtgggaggcagcccaggtcagcgctggacggggagcaggcaggcgctcaggccaacccaatccctgcaggagaagccagggctgctcaaacatgggagttacagccagaactcaggaagggcccctgtccttcaggcctgactgtccatctgcctgagggggtgcccaggactaggccatgcaacttgtcacagcgctggaggctctcctcccccttgaagtcccaggccttgagatcccagggactaatgagccagccctgccacacagcggggatgagtggcccgtggaaactcaccagcaaagccgggagggcggggctacctgagggaaggctgttgtcatacagttcaaggctgaggagtgcccagtgcacttaccatctccacccaggtgccccccacaggcacaaactgcccacggcacgcaaactcctggatgcgggagtacaggccagggtagcggctcttcacccattccagctgctgcgcctgtgggcaggttgaagggagctgggaccagagtgacaagggccccacccaggactgagcatatgggactcagtgtgtggctgagggtgaggagcagccctgaccccaggcctgggaagccttcagggcctgtggagctccagggagggccacgtgcttccctcctccctcacagctgtccctctgacctgggagcaggcaaagatgaactcagggttccgctccatgagctgcagggcggtcacccagctccgggcacatttcctcacagtctctttgaagggccaaagccaggctatacggggagtgaggtggaggacagagggagcagcaaggctgaccaggcctgggctgggactccagagggtcacctagcccccctcccatcccaggcccttcaccctggaaagccctgtggtgtccctcctaagtggtcacttcacttcactccagcgaggtgggaggaggggctggggaaaggaggcggcagtgctatgaggccaattatacaggtcaggaaatggaggctccaggccccagaatagcctcagtcctcttggggaattagacatcccctagaggatcctacgagaagtagcagggactaccctgcccctgcacaaacttgatgtatacctgggaacagaggcatggctcccaggatggagccagctgtcctaccagaggtgctacagcctctcctgactcccaggctgcagttcctcccttaccagcccagaacctctcacaccttaccctacatcttggcacagcagagaaagcccttgttctgtgatcccaaaacttcggctgcatcagaatcaataccttcaggagcttgttaaaaatgtggatttcccgtaaaactcagacactgcaaacttgtccaggaagcctctctggaatcccccaacccagctggagtaagtacctctcctgtgctctccagtgcctcagactccccaccattgtgacaccaactctgcctgctgaatctgtctctgtaatcctaccctcaatatctagcatgggccccatgaggcatcagattttgttgaaagaataaatgaggctgggcacggtgggtcatgcctgtaatcccagcactttgggaggccaaggcaggcggatcacctgaggtcaggagtttgagaccagcctggccaacgtggtgaaaccccgtctctactaaaaatacaaaaattaaccaggcattgtggtgggtgcctgtaatcccagctactaaggaggctgaggcaagagaatcgcctgaacccgggaggcagaggttgcagtgagccgagatcacaccattgcactccaccctgggtgacaagagtgagactccgtctcaaaaaaaaaaaaagtgaatccaaagcaagcagagcccacagtccagccccccggccccgttttacagacggggaaaacgcaggtccaagaggagcaagaacttgctgagcatcacacagtgcttctagggcacatccaggtcttcaagggcactcctgcttccccagccagcccaaccagctgctgtcctacctgtatcaatgtggcagtgccctgtggcatgaatggtgtgttggctttcacccccatgttggccaaagaacctggaggccagggcctgggccactgggaaggtctcgggctgggcagggtcacacacgttcaccatctgattggctgtgtacagggcctggaagctgcgctggttgtccttcccgaggccctgcagcagggttctgccccttaatccctttttcaagcacagcttccagacctaggctccactgatctcagggctctcagcagagctcccctgacccccaaccctttttccctgctggtccccctgctcagcaccgtctccctcctccccttcacataggaaaattctctcaaccctcaagcaggtggaaaccctcgtcctactctggattcccagagtcccatttatctgacccaaagaacaaccttcttggagcagggctctagagggtagcagggggtacagggggtgtcaagtaccttggctatgcccagcagcagctccagatccaccaggagcatgtggacatcccggtggaacacagctagctcagcccggctcagctggaacatcttctcagggtcaggggctgcaatcatgcttcccttcccggcccccaggagcccattgcaggctacttccacatagagagtgaggctacaaagatggggagacagcctcaggctaagggactggcacagtactccggggacttggggaaggggcacccaggaggcatccagctgagcccaacctgtctgcttccaggatccactacccagaggatcccacagtgtgacaagagtgcatgtgggagggttgtggtacaaacaccagatggatcccatgtcttgctgtcagagagaataagtagcaaagtttggaaccatgtaaagtacgctgctgtttagtcttatatttccaaagttgtctttgcaaagcactgccttggtcttggaaccctctttgcatattaaaatcatgttcggatctcccaggctcaaacttttagacccaagatctaaaaccaacacggccaacatgggcgggccattcattggagaacaggctgggctgtggtgatgccatacttaggcttcagagagcaaacacgacttccttagggaggccttcctgactccacttcgctgctaagtctagagcaaattcctcagtggagtacccaggatttccttccagagccctcagttttgtaattatatgagtgaatctgtctccctttgttggcaagggctattttattcaccaccatactcccagtgtctgaaagcatctgaaacagtgtcaatctatataaaatacattcataatgtctaagaagtgtttttaatggtgtcataaaatgtccatgttataacatggaatgtaagaagtcaggatacaatcttaactagtaaaaactataccgggatgagccgggcacggtggctcattcctgtaatcccagcactttgggagactcaggcaagtggatagcctgaggtcagcagtttgagaccagcctggccaacagagtcaaaccccgtctctactaaaaatacaaaaaattagctgggcatggtggtgggcacctgtaatctcagctagtagggaggctgaggcaggagaattgcttgaacctgggaggcggcggtcgcagtgagccgagatcgtgccattgcactccagcctgggtaacaaaagcgaaactccgtctcaaaaaaatccaaaaaaacccccccgaaaaaacaaaaaaaactatgccggaaagatacaccaagaacatgaatactgggccaggtgcggtggctcacgcctgtaattccagcattttgggaagctgagaggggcggataacctgaggtcaagaatttgagagtagcctggccaacacggtgaaaccctttctctaccaaaaataaaaaaaaaatagctggacgtggtggcacacacctgtaatccctgctactcgggaagctgaggcatgagaatcgcttgaacctgggaggcagaaggtacagtgagctgcgatcgtgctactgtactccagcatcggcgacagagggagacttcgtctcaaaaaaaagaacatgaatgctgagatgttaataatgttcatctctattctagggagtggaataacggtagttatttacttctttgtgctttcctgtatttaccacaggcaaacattgctattatttttgagacaaggtctcactctgttgcccaggctgcagtgcagcggtgtgatcatggctcactgcagcctcatcctcctgggctcaggtgatcctcccactcagcctcccagggtagtgtgggtcactgcacccagcccattatttttatggttaggaaaaaatcatgcttttaaaagcaaacaatgagatgtgaggatgattgtgctagagcagaggcgggcttatgagatcactctgggcctcagctcctccttgctcactggtactccctccctgacagcactggtcaaccagggcacagggactcaccttcgggggtctctttcccccagcctgtcagtcaggacatagctggtcttctcaccctctttggttaaaccctagtagggaggggagtgagagagacaaggcttgaggcttttggacagttcaggtaaagtgtaagccatggggagtcaggcccctccatctggttcccagctctgggtcctctctcccaagcagggccaagattggcaaatcagggacccttggcagtagatgccccaactcccatggcagccagcaccatgaccgtcaaatagcccctgtttaccagtggcaaacccatggtcttatgggaagggccctgggaaggggttaggcagcctgagtgtggattctggtggcctctgcacccctaaataaataccgggaaagaaactccgtgaagtcaggggcaggtttgcctcattccctgctacaccctagtgcttaagggtatggcccagaatggacaccaggagatatttgctgagccagtgaagggaggaagggatggtctctgccttcttgtagccaggaagaacagtcttaaccccagattgagagtcagtccaatttgaaatagaagctgtgtgaacctgagtgagtcaactacacatctgtttcttaatttgtaaatgggtataaagacctactagataggagtataaggactaaacctgataagggtggagcatgaataagacacttaacagtggttatagctggggaatgggatgggtgataaggagagatccattactttatctagaactgtttgaaatgttttcctataagtttgtattatacacaataaaaactaaggaccaattgcacagatgcccaagtggcaacttccctagtcctgaaatcctgataccaccctgtgggcagagcaactcagctgtggcttctccagagtccacagaagaagggctgtagtcatttcagggctgaaatgtggccatacctggccctaggacagggttcctcacctggacaggttctccatcacgccacaccagaccttctccatcactttcccagcaaaggtgaacttcctggcccacccatgcctctgggatggtcagctccacccggaaccagcaggtccaccatctgcaagagagctgttgtgataggcctagaggtagaagtcctatcctgatatccttccttggataaagtgtcggcaggggcttgaaactctccaagcatctgcagtgtcacaaggtactcagctttgagtcacaagaaaggagcaacaaggtgagaagcaagatgagggaaacaggcagaggcgtcaaaggttcgtgatccctagggtgcccttcctaagggatgtccagaggcggccacgtgggaatgaaaaccatcccctgaagacccagggaccagagagctgttcccagcagagggtgctgctcccagcagagggtgctgctcgatcccacgtagttgtctacggcagagggcagacaacgaaggtgtggctgggagctgggttgggacttcccctaggcctgtggccccgcccacccgctgggcgttacctacgtgggtccgaagctgtcgccgacctgcgcggggcggaagtcccgctggactgcctcctggtagggaagtctctccggcgtcaggaagctggagagcacagccacagggcagctggccccaaaaagcctgcgtgggacgggccggtgggcacatgctggaggccgccccgtttccgcctgggggccagctggccggtggggccgcactttccctggatcctccgccaagagggctgcctggccgctccgcggcacagtccattccctaccccctcctccccggcccctgccctgcccgcggcgggcactttgtcccgcggcccgggtggctgcagcttaggtttctccccggaaggaaagcttgaggcgcacggttgcggtcggccggctgcgggggaccaggggccacacctgccgcggaggttacagtcggtaaagtagagcggcgacacgaacttctccacccgctccagcgtggtgcgccagtgcttcaaggccggcgcagccgccatcgccgggctctcgctcctctttccggaaggcccctggcgctaccgttccgctccacggcaggaaaccaaaggttccggcgtccagagggcgcctcccagtcccgggcagcttttcttggaacaccggcggctctcggaagcccagctgctgtctgaactttgagccgagttggaagctagaaactgtttttgaggctctcctatgttgtccgaaatagtgggccgcagggaaaatctcaaaataaaatgggaaatttgacgattagaactctcgaaagtctcaagacagagacttaggccattcggcaagacaggcgggagcctcagctgctgcagacccagcctcagaagcagcaaccgggagacctctggctctagctgtcggtgaacacggaaagtggtgtttgcttaacgtggagccagactacccggaataggtgttttcataccggacggagatcagggtgttagtgagcagggtggtagagctttacgcccaagttactacgacttactcgattacacgctttactgaatgtatattgctaactcttgcacatcaccagaaactctggagtttgaggtggcagaacagtcatggcattgacgatcccaatggaaaaatgtatttcaccatacaggactgtagagtcccgggaagccataataccagaaacagacctccagtttcattctcatccctagtactccactgacagctttattttttttctcctggggttgccaagagtctttgtctataaaatcattaggaacaaaaaaaaatacacaagattagccctgatattttaatggaaatactgaccaagtttacaacatttcaaatgcagatcacacggaaaggtgactaagtacagaataacaaatgtgatttaaaacaaagataacctgctgctgcatataatacaggttgggtttagagcttggagctcagatgtcagacagcaggaggaataaaaatgctacttgtgaaaacccaggctgtaggtaaaacttactcttttgttggttgcactggtgggttgggactttctcctgaactggccttgaaatcctatcctgacctgcaggcaagtgctctggacaaaacactgcaggggcagcaacagctggggctgaccctgatcacaccccaccaatttcccctatggttccaggtcaacatgacctttcttgagggaacacggggataggtgaattatttgagaaaacctcaagatctttcccctaaatcagtacacatgaccaccgccaagtcagacactgccccagctttgccctaaaatctcatcccacaaagctctttttggcaccctacactttggctcacagtctcttctccccagtacaaaaaaagcctaaaatcaggccagggtggctcacacctgtaatctcagcactttgcgaggccgaggtgggaggacagcttgaggccaggagtttgagaccaacctgggcagcatagcaagaccctgtctctacaaaaagttaaaaaattagctgggcgtggtggcatgcagctactcaggaggccgaggtgggaggactgcttgagcctgggaggtcaagcctgcagtgagctatgatcgtggcactgcactccagtgtgggtcataaagcgagacactgtctttaaacaataaaagcctaaaatcagagaggtctaccatgtgttttgaaaatccaggagccaaaaaattttgtttttctttttggtggtggtggtgatttttaactaaaaagcaaacataaaacacacagaacattgctggttacaactaagacttgcgtaatggttgctgaagaaaaatccaccagagtactgggaggggctcagttggtctttgttcagaaagtccaggttaaccacatagaaaaatcctaatcattcatgtttaaatgtctgctagtttaaatttatgtaattaaaaaaataggtatcccatttcaaattctctccctcccaactccatttataaggtataccacatgccttatgcacacttttttttcaaacactggtttggtatttaagttgctcacccccatccatcaccaatgtgaataagaaaaaatatatagaaatacaaactacatagcttgacaacttacccaaatataaaatattttcagattatttgaacaagggaaaaaaacacgtactaaaagacttaagtattctaagattttggaatattttgatttgggacaagtaacaagtattttaagcaaaatcctgtttctaccctggataaggaactgaagtcaaaatccctgcttcacagtattttctggtgaggacaagggacgtgggttgagagtttattccttaagtaagaaccaagctttatttatttacaaaaaaaaaaaaaaaaaagttgggggcaaaggggaagacaagttttacacaaaagtactacaatggtaactccctttggtaaaaagtgtaataaatgtcttgtacatctgttcataggtactaaatctgaagccacagtactatggtacacaagaagctagagcagttatgctagcacatcaaagcatatttcttttaataaaaaattgacagtatgtacattatgtacaaaaaaacaagttaaaattgtgtgtgtgtgtgcgtgtgtgtgtcagagagtaaagctggtggatggcactaaggtagactagtaaagaggcagatacaaaacagttccacgggagctaaaaaggacaactgatttgaactcgttgaggttgagaaccagaggagagaaaagggtaggcagcaagggaatcgtcaggaataaaatccacaagatgatcaatcccaaagccaaactgcaggtcccagataaaacctaatgggtgatcttagatgtgctcgagtgaccagaaaaaaaaaatcaaatccagcttttttttccttttgtggggaggggagaggagcagtgaccatgatagttccaatccatctgagtattaagtccttctccagtctgttttgtaaatgcatctccatccagtcaaagtgtgaacagcatccggttccctcattgaaagttaggccacaggagactccagtcttagctctgctggtgtgtgcaagcaaactgcatgtctttgcttgcatggacttccttcccctccagggcaggctatacccaaaaccctttgggaaaagttccagcttcagctttgtaaggtattcatgttcctaacaggtagcccacttggtgccaggctgcaccagccacacacaggtcaggtggccatgtcccagagaggcccagtgaggcttgaaaggcatcttccttgtttcttcagtgtgtgagtgcataggcccacacacacatccccacacacaccccaagttatctgctctggctttgcagttaaggggctttgaatactgtgccgtatttgacacgatacttgttaatgctcacaaaatgcagggtctctgtatcacaggtggtggtacagggcaccaggccctccagcccctcacccatgagccacttgctggtctctgctgccatttcacggggcacatgctccttggtccatttatctacccaggcctggaatctctgatgtagacgcttgcttacacgctcatgggactgcaaaacagaaaaaaaaaattttattaaatgaagcagaaccaaaaaagagcccttcaaatacaaagcctaattttcttctaaaggagcaaaggaaagatgtgggctcaagtcttagataccactgtttttttcttaaaagaaaaaaaaaaggattctctgtttaaagagaagttaaagaggtaagaacatagaacatgtgagggcatgaaaatccataaagcctccaaagaaatgcgaacacaggctctgggctgaaaaagctcgctgttctcaattttagcatgcgttagtataaccgagggaatgtgttaaaaaatacacatttctgaccaggtgcagtgactcatgcctgtaatcctagtactctgggaggctgaggcaggcagttcgcttgagctcaggagtttgagaccagcctgggcaacatggcaaaaccccatctctacaaaaatacaaataataactgggcgtggtggcacacacctgtagtcccagctacttggtaggctgaagtgggaggatcgcttgagccaggaggtggaggctgcagtgagccaagatcgcaccaccgcaccccagcctagatgacagagccaaaccctgtctccaaaaaaaaaaaaaaaaaaaacccaaaacccccaaaacccacatttccttggtttaccaatgtgcattttaaaccagcaatccagctgattctaatgtatcctgggtaggacccagtgagccattgatcacttctatcagcatggagatccacctctaagccagacagtgcaaagcaaagggcttaaaaccactctccctccactgtgttaccccaccctgggaagcagagtccaggcttggcagatgttctgcagggggttctgttcccaccaacacattcaataaaaatttattggtgtccacatgcaaggatactagaagagatacaaagacaaaactggtgttgcccagtgtcccaaataatgtgaatcagagacaggcagacacacaacacatagcaaaaaaaatgagccaggtgtggtggtgcacgcccgtaatcccagctactcgagaggctgagacaagagaatctcttgaacccgggaagtggaggatgcagtgagctgaaatcatgccactgcgcttccctcagtgccatgagagaagtagagcagactcttgaacaacacagctttgaacagcgcagggccactgataggcaagttttcttccacctctgccaaccctgagacagcaaaaacaacccctcccttcctcctccctcttcagcctactcaacaagatgagaataaggaccctttatgatgagccacaaccacttaatgaagagtaaatgtatcttctcttgcttatgacttaacattttcttttctctaacttactttattgtaagaatatacagtataggctgggcacagtggctcacgcctgtaatcccagcactttaggaggctgaaatgggtgggttgtttgaacccttgagtttgagaccagccctgggcaacgtaaggagaccccgtgtctattttcattaaaaaaaaaaaaaagaaagaaaaaaagaatgcagtatatataatacatacaacatacaaaatatgttgtttatcagtaagccttccagtcagtagtagactatcagtagttccattttgggggagtcaaaaattatacacagatttgactgtgcaggggccagtgccccaaaccccttgtcgttaaagggttaattatacattaaactgtctgctcaacatctcccatttgaaagttttgtagtcctttcaaacttaaaacagcacttcatctgtctcccaaacctcataaccctttcctattaacaggtgagcccctaaaatctccacttaagcaaaacaaaacaaaccaaaaaaccccaaaactaatcaggcaccatccttgatgtccttcttttgcttacccccacatttgatccaacaccatctcttgtcaattaaatatctaaataatatctacatctgggcgtggtggctcacgcctgtaatcccagtactttgggaggctgaggagggtggatcacttgaggtcaggttcgagaccagcctggccaacatggtgaaatcccatctctactaaaaatacaaaaaatcagccaggcatggtttgagacacagcgaaactctgtctcaaaaataaatgcataaagtctacaatgtaattcttgcaattccactgccaccctagtagtacgggtggcccccacatctcatttggacaagggcacccttttgagtggtctctgctcttccaactttatatatacccatctccactgtcctcacagaactccaagctatctttgtcaaatgtcccagtgcatctcaaacaaattacaaaccatggcctatcattagacaaagtgatgtggcctctgcctacccttctaacttcatgcaaccttgagccacaatggtgtttgtaatttcttgaatatgccaagtcctttcctcccagccttgtactagctcttttgtctagaaaacacccatcctctactcttcaccaggctaattccttgtcattattcaggcctcaagcatcacctcctttgagaagcctcctccagtgaaagcaaggcctgtatgctagttacccttgatcacttcacctgatttgtttccctggtagtgcatatcatcgcattacttcatctgctctacttcatggctgtagtcccagggcctggcataacaccctatacgcagctgcaccaggaaggtttcacaattgagacagaatgtaaagacaggtaggattcatacaagcaaaagatcagatactacttgagatgtaaatactgggagtaaattcaccaaaaaggtgccaccgggtatttacgtgctcttacaggctgaactgtattctccttaaaattcttatgttggccgggcatggtggctcacgcctgtaatgctagcactttgagaggctgtgtcaggtgagactctgtctcaaacaaacaaacaaaaaatcatacattgaagtcctagcccccagtacttccgaatgtgacctcatctggaggcagacacacacacacaggtaggaacaccatatgaagatgaaggcagggatctacaagcccaggaatgccaaagattgccagcaaagaaccagaagctaggagaggcctagaagagattgtccctcacagtcctcaaaaggaaccaacactgctgacacttgactttggacttctagtctccacaacttttgtcatttaagccacagtctgtggtactttgtcacagcatccttagcaaccaacatacgtacttcctcagttaagtctcagctccaagaacaggtttgcataaacaaagaaaaacaatcagaagactctgggcctcccctggtcctagctagggtgggagatgtgtacagaaatttcagttactggttctcacctgatgagcccggagcagggcggtcctccgatacatatagtcctctgatttgatcacatacaccatcttgtaggaattcagcttgaatctacactccagcttatccagactatccacattctccatggtcttcttgctgtttccttccttcccttccttttcctgctgctctcgaccacgttgacacttccggatccgccgtagattcctattgcagaaaagccccggaggatgagagctcgtccagatgcagattcccgtgacttccccaaagtgagttttctttattatatgcttgcatagtactcatcccaatttgttaaatacatacacaaatgttcagttgtttcactgcaaaaaaaatttcaactgcaaaggtacacagaataaaaagcagaaatcttcacccatcccctacttgacttagcagatgtagccagttaagagttttaatgagaaacttctaggcctctgtctgtaaatttacacatgtaattaccagctacagttctgctttgggatttgtttttaagacaaaataggatcatactatatattttgtcctcaacttttcacttactgtcatgaatattttttcatttcatgatagatttgtcttattctctttaactgctgcagaaaaatgtaccccaatttaccattccttaacagtttctttcaactgaggttcctcatctgaaccacataacaaaaatttatttgaatgactatttttaaaaattcccccagatgatataaactagtgccattctacatacacaagaaagaagataattcacatgaatggatgccctgaggggtggtaggcttgctaaatctcaacatccagtgaaaaaagttatcagctagacaattatattgtttctcataacttgctattaaaaacactgcttcaggttggccactgtggctcatgcctataatcccagcactttgggaggcaggtggattgcttgagctcaggagtttgagactagcctgggcaacatggcaaaaaccccttctctacaaaaaaaaaaaaaaaattaggcaggtgtggtgacgtgtgcctagagtctcagctacttgggaggctgaggtgggaagatcgtttgagcccagaaggcggaggttgcagaaagccaagatcccaccactgtactatagcctgggacacagagccagacactgtcttaaaaaaaaaaaaaaaaaaaaaaaaccaaccagcccaaaatattgcttcagtgagaatctttgtatacaagtatttctgtagacagcagttctttgtccaaagggtcccaggaccctttcaggagatctgtgagatcaaaactattctcataataatactaaaacattatttcccttttttgctgtgttgacatctgcactggcaccattaaagtaatggtgaacaaaaatgctggtggtggcgccaaactgtatttgcaatatcgaacaaattgttaccaaattccaatatcaatttgtacatcactgagcttttcatacagttgtcaaactctgttggtttatcttgtaccatcaatgaatccattttacttccatgattttgcaccttcatgcgactgcaattcaagtctttgaacttcacactgaccatacaatgacattaagtgaaaaaagccagtttcacttaagaatgtttctgatgggccagtcacagtggctcatgcttgtaatcccagcactctgggaggctgaggcaggcagatcacttgaggtcaggagtttgagactagcctggccaacatggggagacctcatctctaataaaagtacaaaaattagccgggagtggtggcgcgcacctgtaatcccagctattcgggagggtgagacaggagaatcacttgaacctggctggtggaggctgcagtaagccaagatcgcgccactgcactccagcttgggcaacagagtgagactctgcctcaaaaaaaaaaaaagaaaaaaaaagtttctgatgaagcagtaacattttctattaaatcccaacccctcaatttacatctttttaacatgctgtgtgataaaatgggaactacacataaagcacctttgtgtgctaaagtacaatggtattcttatagaaaagcacttgagcaattgcttgagttgtaagtggatcatcatttttacccgaaagaacaactgactaaatatagtcaatctcagccaagtatttggcagatgttttctcaaaaatgaacaagggagcctatcacttcaaggaaaacaatgttgccaatggtaagactggaattttcaagcaaaactatgaattttggtgaactggtatcagccaccctgagcttgacagcttcccaatacttaaagatgtgtttgatgacctagcgatagcgatattaaatcaatgtgatttcttttggagacactgtaaaatatatcaacatttagtaggtgtgtataacttattttccaaatagccaattgcgtaaagttacaaaatcatagaggaaaaaaagattcattcatgatacaaaataaatcaatggatttttacaactgcatgaaaagcccactgatgtataaattgatattccaactaacctttaagaaactatcactggggccgggtgcagtggctcacacccgtaatcacagcactttgggaggccgaggtgggaggatcacctgaggtcaggagttcaagaccagccagaccaacatggagaaatcccatctctactaaaaatacagaatcagccgggcgtggtggcacatgcctgtaatcccagctactcgggaggctgaggcaggagaatcacttaaacctgggaggcaggggttgcagtgagctgagatcacaccattgcactccagcctgggcaacaagagcgaaattccgtctcaaaaaagaaaaacaaaaacaaaaactatcactggtagttttgttgtcatatcaaagaatatccagttatctgaaggatctgaaaatattcctttttccagctacacatttgcgtgaggccagattttcttcacatatttcaatcaaacaacatacataatgcaacagattgaatatagaagcagacatgagaatccagctgttcttctggtaagccagacactaaacaaatttataaaatataagcaatgccactctattcactaatttttgttttgaattagcttttcattaaaaaatattatttaagaaaatataatagggatatatatatatatatatatattttatttttgaggcagagtctcactcggtcacccaggctggagtgccgtggtgcgatctccactcactgcaacctccgccttccggttcaagcaattctcctgcctcagcctcccgagtagcttggactacaggcgcctgccaccatgcccagctaattttctgtatttttagtagagacagggtttcactgtgttagccaggatggtctcgatctcctgatctcgtgatccacagcctcggcctcccaaagtgctggagttacaggcgtgagccactgcgcccagcccaatattgttatttttcaaatgaattaaagattgaaaacatttctttgtttttatttctaacttggtaaatattactagtataatccatataaacaaaagctttttggagtactcatgctctaagagtgtaaggggtctcaaggccaataagatgagccccttagctgtcagacaaatcattagaaactgaaattctggagggaagattccatacacttcaactaccctgccaccagaacgattatatcaatttccttttcctcacagtacataaatgtgcctccttcctcatatcatggtgagagacacatgatgacaggtttattgtagtatgttattagcatggagcctgttttgttgagaggaacctgacacagagcaactgctcaaatgtgttaaatgattcaatgaatggagaacccggcagggccctttttgctggtatctcttttcccatgttctcattaggactcaataagtctaataacactgggatgatactttcttggaaacctaagacataagatttcaattcaaaacttttaggaaggaagaaagccattctacccattttatacttcttaaactgttttcatatacttggaggatcagtatcacaatctgcctatacacagagggaacatttttaaaattctgtgcagaaaagagttaatgtagcaggcctaagattgctattctttgaaaagcctgcttataaaagttggcccttggctgggggctgggatcttggattttgggcaatgttctaccattccttaactcatataagtgtctcactgtacctaaactatttgtacaaactctatagcttatgctgaaaatgtgctttctttctgagagtttgggattttggtacatgctaggcatacagtgcctagatgactacatctcaataaaaatcctggcacagagtctctaatgagctgccctggtagacagcattttgcatgtgttgtcacattcattgttggaagaattaagagtgtcctgtgtgactccactgggagaggattctaggaagcttgagcctggcttcctccagctttgccacaggcaccttttcgctttgctgattctgctttgcatcttctcgctgtactaaatcagtctgactatatgcagagtcctgtgagtcctcttccatcgaaccatggagactctgacacacattcccatccaaagtacggaggttattgttgattctctacaactctcacctcccagatgctttgacacatgctccaggtaagctcatgttgtgacagccatataaaaccttgaattagcatccccagcagatagaacaaatgaataaaatatgtgaaggccaagaacgtgaaagtcatttaactctccattcctcaatcatgcacagtatggactgctgacagatgacatggctcactcacctggggagaaatactggtttctgtgctagatgttcacgaagctcaggcgaggtagtatctgaattcatgtatcgctccacgtagtctgaccagcgctaagatggcaaacacaaaatacaggtggaaggaaatcacaaaaacagctcctaatgcattgggcactctagtaaattctatgattacaatgccccgaattcataaatttcaagatcaaaaaagtccctttctataaagacatgattgttagtaggtattggaacacggattaaaaattctgttagccagcaatactgctaagtttctgaggtgctaaggttatgagaagtcataaacaggtagaagctggctcactgacaagtttcatttccccacagagcattttgttaaagaacaaaatttatagtggcaaatgtgtgaaagtttccttcacattacaatctagatttctgacatcgcttaaaaaaaaaaaaaaaaaaaaagatctgccaacaagccaacattcccaccaaaacaagtcatcccacacgaccccccccaacatcatacatatggcctgcatctcctgtgtacattatctgccataaccaactatgataatcacacctgtctattcaggggttgaaaactctggactttatcagtccaataaaaagtaaacatgacacaaagaatcaagatgacatgagaaagacctcatttgttgttttttatactttaggaaaaaacaggaaagctgccaaccataagacttccttagaggagatagctttactaagtgcaagatgaggttaacatctataaccaggcagcccgtctcttcagctgaagacatggctggattgacttgtactttaagcatccaggtcctgacccttaaacaggcctgaggtgccttggccttttggcagacagggtcactggacagactctcaaggcacgccagctctgcttggcacctggggtctgtgatgtacttgctcatacctctgcttccacagggtcatccgaattctcctcttctgtgtccagaagctcaatagtcagctggacctggccttggctctgaataaacataagctgcaaataagaaacctaagcgtaaacaaaagaccgtctctgtagctgtaatctatcttctcaaggaatgagaggtgcagaggcaataaacttagtaaactttgctccaactgaagagatgaggaagatactagatcttgggtggccagtgataaaggcaaaagtctacacttactacaagtaaaatgaaatatattaaagcaaaaggtactatttcatgtttcaaacttctagaattcgctaaaataataatcaatgtcagtaagaatgttttacaaaacaaatattttgtcagaaagaaatatggcacatgtagccagaaccacaaaatgtcaatgctctgtccattggtaatcccacttctaggacgtaatagaggaggtaactatcagaatcacatggagaaggtcagagcctggaaggaaacctgagaattttttatttcaaccttcttcattttacacagagacaaaactgaaattcagaagagttctggtttctcaaggcacaccactaatcaatatacatgcagagccagaagctagatctagctcagtgttcttttaaagctttaaaaattgctctctgctagtaaagcttacaacctgacaataacataatatatacacacacaaatacagttatttccaaaatagatttcggggtgggggcagaccctgcattttcacaatttataatttaagaattgcaaaatctgtctccagtattcataacaggatgtcattaaccagtccccatagtgggttggacgtctaggatgtttccaactatttgcttttataattatccattataatggtgaaaaattggaaacaacctaaatgtccaccaatacaggcattaattctctaaaaagtgaatatcaaatagccataaaaaagacaataaagacccagaagtgttgttaattgagcaaaaatacattaaagaccatttccggtcagatgcagtggctcacacctgtaatcccagcactttgggaggctaaggcgggcagatcacttgaggccaggagtttgagacaagcctgcccaacatggtgaaaccacatctctactaaaaatacaaaaattagaccgggtgcagtggctcatgcctgtaatcccagcactttgggaggccaaggagggcagatcacctgagctcaggagttcaagaccagcctgaccaacatggtgaaaccctgtctctactaaacacacacacccacacaagctggccatggtggcacgtgtctgtaatcccagctactcaggaggccgaggcaggagaactgcttgaacccaggaggcggaggttgcagtgagctgaaatagcaccactgcactccaagcctggacaacctggacaacctggacaacaagagtgagcctccatctcgggaaaaaaaaaaaaattagctggacatagtggtacatgactgtaatcccagctactagggtggctgacgtgtgagaatcacttgaactcaggaggcagaggttgcagtgaaccaagattgcgccactgcactccagcctgggcaacagtgtgtgtccctgtcttaaaaaaaaaaaaaaaaaagttaaagaccattttgtccagtataaactctttcaaaatatatactcaagcatagagaagtttagaatcatagagatgtcatcaatgataatttcaggaaagaattctaaggtgactttttttggttatctgcattttattttcatttttttgggacagagtcttgctctgtcacccaggctggggtgcagtgacgcgatcaggcctcactgcagcctcgacctcccaggctcaagcaatcctttttttttttttttgagacggagtctcgctctgtctcccaggctggagtgcagtggcgcgatctcagcttactgcaagctccgcctcccgggttcacgccattctcctgactcagcctccagagtagctgggactacagacgcccaccactacgcccggctaattttttgtatttttagtagagacgggggcaatccttctacctcattctcctgagtagctgagactacaggtgcacgctaccatgccgggctaatttttgtattcttgtatttcttgcagagatggggttttgccatgttgcccaagctggtctcaagtgatccgcccacctcggcctcccagtgtgctgagattacaagtgtgagccatgtgtgctgggcctatgttttcttttctataatgatcatgaccatggatttcatgtaccaacatttttctaacaataatatttacaaagcatactatgaaaaatgttcagagaaaaagaatacaaaattgtaaaaatcatatataactagttttttttttttctttaaaggcaggaaagaaacaaagtagattgtccaggaagacaattacttccactttgtagttctctggtgaactcattaaaaggtccaggagtagaatcacaggtcaaagtaccccggctttaacttctggttcagagaatcctaacaactgacattgtcaccagcaaggtcttcgactacctgaccaactctcaccttaaagcaattctcatctgacattagctgctcagctttccgctgatacgttgactccaggaggctccttgagttctgtgtgttcagctggcctccggtggccccattattattttctgccaggtaaaggtcagtcacctgcacacagatctcatcactcacgatatgctgcagctggaagcaaacaaaggcaagcttttagtgaacacagaaaacatttctccattatacagtcaacgttcctttgatgtagtcattcaactccaaaaaggtttttctttttttgggggggtgggggggtgctggcaattttagaaaattaatcacacaaaccactgtatcattttcttggagaataatcaagccaggattttcaaccatatcagtggtccatggtaaaactttcctatctatttaaaataagaaccatagagaactcaggataatcgtactatttaaaattctaagcatctttaaataattttctataggtcatatctttattgcattttaaaatcatttacaattggctctcatacatattctttctcatttgatcttcacaactgccctgggaaggcaagctagacagagagttggggccagttaggagacaaatttacacaatgcatcagaaaggtggctcacgcctgtaatcccagcactttgggaggccgaggtgggccaatcacctgaggtcaggtgttcaaaaccagcctggctaacatggcgaaaccccatctctactaaaaatacacaaatagccgggcgtggtggcaggagcctgtaatcccagctacttgggaggctggggcaggagaatcgcttgaacctgggagatggaggttgcagtgagccgagactgcaccactgcaaagctcaccgtgagctggggtgaggaagggagccttggagaatcatgaatgcagtatctatgtctatattcccaggccaactacaaagcctgaaactcattaagtatttaagaaatagctgctgaattattgcccaggggtgctcagctgaagaaggagggttgggactaaaagtcaaggttcctgactcctagcccaatacttttccaaacacatcacctatttttctgtatctgatagaaagtatagggcttaagttgtacataaagttaactcactttccatacaggccaatcatgattgactatcagtagcttttgtgacaatcttaggaaactaatgactagaaagttgaacgtttcagagttcccattctcatgtcatgctatttctattttgaaataaaaatccttccaaatgaaactttatcatcaaaatgacagaagtgaaaaatagatacaagaagaaagcaaaacgttaatttcaatattgatttgtctgtttaaaaaactttaagatgatcataaccaccaagccattctatttttaggaagacacattctttttaagtgttaggaaccatgataactatttattcttaagtcctaaatgaccagtatgtgtattagtagataactggacacagtgaaaggtcagaacggtgactgagtgtggcagaaagggcagtatctccagcaactacagatggataaataaatcacaatgagtccagataaaggattctgatacaaccattaaaataatgcttatgagtacctgatatcatgaggaagattaagatacagtgttttaggagaaaaaagaaaaggtggaaaaaaacagatggaaagcatgacttcaatcatacatacagatgcttccactttctactttctttttgagacagagtctcgctctgtcgcccaggctggagtgcagtggcatcgtgatcttggctcagtgcagcctcaacttcctgggctcaagcaaccctcccatacctcagcctcttaagtagctgggtctacaggcatgtgccaccacgcccagctaacttttttgtattttcagaagagacggggttttgccatgttgcccagtctgatctcaaacttctgagctcaagtgatccacccgccttggcctcccaaactgctgggattacaggcgtgagccaccgcctctactttatactttcttgttgaagtagactgtattactgattccccacccatactctctttttggatatctggcccctcctcgagtcttcagaaaagacagcactacaaatccagagacagctacggaactcccacccccactgctaagcagatcagattctctatcttgctaattggagatgacagagagggtgttcaatagattttttgaggaggagcatctgtatggaaaggtctagtaacactgggaccaggggtactgggagggcaagccaaagcctcagaggctggaggagcctggagcacatgccgtatgttcatctgcagagcaaagcacaagcatggagcagaagtccagagtgaaggcatgcaggagagaaaaatcacctcccagcccaatccttccatggtgtggtcctattttgagttctgtacttggatgtctgtgaggttgcctattgtattcttaatacaaatccctcttaagccagcctacaataggtaagataaatgtaatggcttcacttggctggaatgcagtggtgcaatcacggctcactgcagcctcaacttcctgggttcagatgatcctcccaccttagcctcctgagtagctgggactacaggcatgtgccaccatgcccagctaattttttgtatttttaatacaaatagtgtttccccatgttgcccaggctggtctccaactcctggactcaatatatctgcccgccttggactcccaaagtgctggtattagaggcatgagccaccatgaccagccttgactttgaaatatatgttgtacattcagtcagcagtggaatctgagggaacaccaaatatgaggagaatgagagaagagatacctccagttaaaggagttgagaagcttgaaaatgttttaaaaagtcactgtaggctgggcacagtggctcatgcccgtaatcgcagcgctttgggaggctgaagtaggtgaattgcttgagcccataagtttgaggccagcctggacaacatggcaaaactccatctctacaaaaaatacaataaattagccggtgtggtggcccctttggtcccagctacttgggaggctgaggtaggaggtcaaggctacagtgagctgatcacaccactgcactccagcctgggcaatagagtgagaccctgggttggaaaaaaaaaaaaaaaaaaagtcactgttttggggttttctggatgaaacctgtttccattaaaaaaaaaaaaaaaaagcggggggtgggtggagatagtatttattactgattcaaaatcataaccagatacagtaaataattgtaactattgtttcgaaaaccaacctcagaattattaaaagttagttttattggattttttttttaagctgtgctggtggtatgaaagacttcgttcctagctgaagcagcagcaagcctgtaatcagcaacataagcacagggtaactggagtctgtattttatataaatttcagggaagttaaggaagattagtctgaaaaagtatgactatgggtgactatgtatccatctaatgatttctgccagttaccatccagacctcttatgggaaggcctaacaacttcttcaacttattggaaacaactatctgacaactttcccccagatgttaaggttcatttatatgaagggctcttcctcaatcctgtgtagatactgtgggaggagtacagaggcatgcacccttccaaaaccaaggcaaaagcatgggtactttgcaaagaattcaatattttagcccaagagaacattaagcaacaagctctttccttctacagtggcagtgtggattctagaattagaaattgctttttacaagttttcacttaagtacttcaccgcctttctgctgagctattctatggaagagggctgtaggtagccacggtacccaggtggaacagcatgatcctaaagccctacttccacaaggaatcgcagtggcccatggccacgtggttcaaccagccagcccagaagatctgcagatgcaagcaaaagtataccacattgacctgcaccctgcatctggacccatctgacccatggtaagctgccccacagtgaggtaccacaccaaagtacaagctggcaggggcttcagcttagaagagttaagggtgaccagcatccacaagagggtggcattagtacaccatgtccctgtgggccaatgttcagcacctgaaggagttaagactccaagctcaacctcttctccaggaagctcttagcccccaagaagggagacagttctgaaaaactcaaatcagccacccagctgacaggaccaataatgcccatatagtacgtctataagaaggagaaagctggaatcatcactaagaactttaaggtatttgccagtcttcacacagcccacatcaattttcagctctttggcatatgggcaaaaagggccaagggagccacagaacaggatgctgaaaaggaaaaatgaagccctgctggggacttgcagtcaatcagcagtagagctgggtctccagaaaaagaaaaaagcagttaaccaacaatctctctgggagttcagaactcaagtccaagaagtagaaatgtgactatctgttacaagctattttttatatcattgttgtaaagaacaacatgtttacaagttcccagggtgccacaggaagaacacacaaaaccaaccagaaacctaacttagagggaaccgcagatgagtgaggtgggcagagtattataaaagatgttatgtgaaccctttcttataaaaagaatttcaaatattaaacaatgcaagtacataagagttaccaacaccttgaccaggcgcagtggctcgtgtctataatcccagcgctttaagaggccaagacaggaggatcacttgagaccagaagttcaagaccagcctgggcaaaacagtgacaccctgtctctatttaaggaaaaaaaaaaaaaacttaccaacacctatggaagacgcaatgttccacactgtgtgcttacccatggcagacaaggtaagagatagacaagttgtgcaggaagctggggtcaggaccactgcactctacaggtggccagcaagaaaggatatggggtaggcaggctcatacactgcaactttgttaacatgagaaatcaggcatcacattaacctcccctcctctcttcagaaccctacgttcataaacactgttatatgaaaaagttgcctttccttttccttgcgtggcccatctctaggtaaggatttcttcccttactcaccctagcctcctccatgccctcacctgtctgacaatgctctggatcagtttgtccatggtaaaggcaatgtaggcatgaatggtgaacatctctctcagtgaatcttcatactgtgatgagtctatgttgccatccagcaggctccgcaccatgtccaggaaagctgggtaataatcttctacatcaacatccactgtgggagagatgggattggtgaggccttaccttgctaagaaaagactagggatagagtacagggcaaatcccacagctggcctaaatggcatttgaaagtatgaacactaggtattcaaaatatactcactcattccaatgtaaacagagatgaattccgacaggtgactacaatcaccagcactatcagagtgactctgcaactttaacagtggcttctaatattctgactaccatgctagaaagatacttctttatggtactgctgggccactttcagagaggaaaatatcctagggaagccagtccttcaaagagctgttggctcccctgctgagagaggaacctactctcccagcctgcacaagagcattcctcacatgggtcacttgctcataaagctatttcaatgaagcataaagtacagatgaggaaaggcagacacagccatactccagcactgggaaacctcttgggaacacaaaaataggagtgcaaattaaatcctttatgaataatgaagtaatctgcatttgtcaaagtccttttgtttaaaaatggattcgctacgttgtatttcacaaattgcattaaatcatctgtagttgctgcacatgaatcatttcaatcactagctagaataaatctcatcagttgttaaagacatttggcaactagcagagggcacaaggagtattaaagagtgctgcctttagcttactaaagacccatttatataaagttcaaaaatagacaaatctaatctctagtgttagaaatcaacaaagtggaaaaaggactggttatcagagtactggttatgtttcgtttcttgaacataggtacgtctagtctgtaaaaattcactgagctgcacaattctgatttgtatacttttctatatatacatgccgtaccttatatgtatttttttgtagagatggggtctcacttattaaccaggctggtctcaaactcctggcctcaagtgatcctcccacatcggcctcccaaagtgctgggattacaggtgtaagccactgcacccggcctatacattgcacttcaacaaaaagttgactaaaatgaaaaaagttacaaaacgaactatttgtcactgactaattggttacttgctagttgtgtttgtgctggagaaaaaaggctaggagcaaaaccaagttgtctccatttatctgaagtctgacgaattcattaaaaaacaggcaaaacaggacaaatactgtttaaaagaggcaactggcttgagtttcatcacagactatcacattctttagctccatagaataggtataggctatagactccaaaatataccactgctatgaaaactgcttttatgccagaataaagttttgagtccaaaccacagatttgtccaaacaagctgtggtaagtgtgagggttggcattatcagacaagacaacattatgtaagcctcaaaccaggttaagtcagtggccaagccaggaataggccatttaatttctaatttctacccaagtagatggaatcaccacaatgagatctaaaatttatctctttcgagctaggactagtctagataaaagctttcagaattatttttcagtgtcattagctcctcaacagatagaaagctagggccatatctgggcttcctacatcagcaacacataaaaaaaaaaaaaaagaagaagaagatacactcctcaggttggctatttccttaagagcccagaagaaatgcttcatgaaaaagcttttggctcacagctcaagtacctaatttatgacgtgaactggaagcaggcagcacaaaattacataaagcacatgacagcgtcctgaaccctcacttactttccttttcctgagttctacatctttatccctgtcctgcctgttctccatgtctcatatcaccttttgagttccagtctcctttccataaactatttctacatattaagaatgagccataaaccccactggttaaacagaagtcctgctcaaaaatatgagaaaattctgttttaagcactaggaatttatgttctgtcatggattgaaattggctgtgacagtttagtctctatctgtactttgaaacagatggcagtaacccagaaatctgccatttgagaaattaactgtgatacccccttcccaggtgcgtccacagtaccaaccactgaccaagtgtccatgatctaagccctgcataggatactttgcacaaagcaacaccacaagcaactagagcctccatttttcagataaacaggttcagagagtttaactacacagactctaatgcctgtgctctattaataaaagaagcagtcccaagtctaggtggctctaaggtcctcaacctcacacatcctctgtaaatcagaggtctcggcactcactaggttctttgagacgtagctgaatggcagggctgtcactcttgtctcgctttatgcccagcacttcccgttcccattctctctctcggttttcttcttcaatttgccgttcggcttgggaacaaatccgtagcagcctcaggcagagaatctggtgcagtcgcataaaaatataccagttgttgttgacatagaagaggttgtatacttcatccattcctcttaatttttgagctgctgtgttactaaacagtaacttggacttagggggactgcccccaacaccattgtgcttcttaactgcccctgtggcttcatctacatccatctcttcttcttcctcttcctccacatctgagagatcacctctttgggcaaagagcaaatctggaataaaatgatgcatgatttgttttatcttatatttgtcctccttctgaatgcctgtctgcctcttcacatggtggataatcagagcagcagcatcttccagtatttgtttgtcttcatacgcaagtgagaggtgtgggccaacaggtacaccagcattctcctccgtagcctgctcttgcctctgatgggacagagacacaaaagtattctgtgagatgtctacagcgacaacatgtctacaagaccacatcagccatacatcccattatcaaccacagtgtctatatttttctaatcaaaaacttaggacctgggactgggagcggtggctcacgtctataatcccagcactttggtaggccgaggagggtgatcacttgaggtcaggagtttgagatcagcctggccaatatggtgaaaccccgcctctactaaaaataacaaaattagctgaacatggtggtaggtgcctgtaatcccagcccttgggatgctaaggcaagagaatcacttgaacccgtgaggcaaaggttgcagtgagccgagatcgtactactgcactccagcctgggcaacagagtgagactctgtctcaaaacaaaacttaggacctgactataacaataatttttgtccctcttccagaaacaaataggtaatgacagagacgtggtttgatgtcaaaatacaggtaccttctacacactgatgacttacagggagagtaggacagaattggaaccatctttctttcttttttttggcagggtcttgctctgtcacccaggctggagtgcagtggagcaatcttggctcattgtaacctccgtctcccgggttcaagccattcttatgcttcagcctcctgagtagctgggattaagaagtgcaccaccatgccaggctaattttgtatttttagtagagatgaggtttcaccatgtcggccaggctggtttcgaacttctggcctcaagttatctgtccacctcagcctcccaaagtgatgggattacaggcgtgagccactgtgcccagtgggactatctttcaaaattctggattagtatctatataaaggatatgatatgagatctgtgatttactttacttctggggtgggggtatggagggtgacaaagtaacatcagcaaaatatggaggattaagtttatttattttattgattttgagacggaatcttgctctgtcacccagactggagtgcagtggcatgttctcagctcactgcatcctccacctcccaggttcaagccattctcccacctcattctgccgagtagctgggactacaggtgcacaccaccacgcctggctaatttttgtatttttagtaaagacggggtttcgtcatgttggctgggctggtctctaactcctgacctcaggtgatctgcccgcctcagcctcccaaagtgctgggattacaggcatgagccactgtgcccggcctgattaagttcacataagagctcattttactatttttaaagttcaggatcaccccactccaggaattcccaattgcactgcatttatgtttctatccatctcctaaaactgagcccacggaaaccaggatttattgcttattcatctctgatcctagctcctagtactatttatagtcctggtaggcatgctgaataagcaaggattacaaagagtttggtggtcaatgacaaattttgaagctgtaagtaaggagagatgggactatatggatacaaggtattattgtttgaaggaaacaggtagtcggagaagtggaaaatggaggcaggaggtataagttgaaaccaggacagtaaactaggaaactagtcaaacagcttaggtataaaggtatagtttagatttaaaatggtagaatgaggaatagaaaaggctatgacagctatcaagcaagaatcaacaggtcttagagagtctcacctgcatttaacaaaggtaatttccagaaatcaaagctgtgctaaatatagactagagtcctctcacagatgcagaaaccccccgctcacctcatcatagatactctcaatctcattgagtaagctcttagacctcaggaccttggtgtcattctgtttaaagttgatcccctggtggtccagagacttcaagtagtatttctcattttgttctcgccatactttgttaaagcctctctgagcttctcgccattcttcctctttcatcttcaacctagtgaagcgggaagggatggaaacaacacatgggaattcagagggtttagaagaaagaaatttgccaggcttactttagttaaagaaaggtgcaaagctatattaggtctctcaaaattactggcaacttgggatgctatcaaaccagtcttgaactctgtttcatgagggaattactcatccaagacttactttgaggaaatgatttatctcaaagtcaaataatttacctagaatggttacttaaaaacagcattccagggaatatctttcaggtataagtattccttgaaaaaaagagttcttgtttctttgctataggactttgcaaaacgttcacaatgctaatagaaacacagaagtccaagacaagagaacttgcacagttatgttcctctggatacagtcaggaaagttctgatcagaactgattctaataacccagaagagaacagactaagacaaaaaaaagcactaaaactgaagaataacctgtatctcaaaagccagaagttaaatgctacaggcaagaagaagaaaccatcaatctgtgccagctcttgaggggaagatgagggagaagaaaccatcaatctgtgccagctcttgaggggaagatgagggaggacaaatcaaatctgggtatttgtgaactgtgcagcaaataagaattaatttttaccagatgatactgagagagaaccaagctcctaacaaaggattcacagtgtggtcaataatgacatggggctgggtgtggtgtggcttgtgcctgtaatgccagcactttggggaggccaaggcaggaggattgcttgagcccaggagttagaggccagcctgggaaatatagcaagacctcatctctattaaaaaaaataaaataaaaattagctgggtgtggtggcacattcctgtagtcccagctattcgggaggctgaggtgggaggatcacctgagcctgggaagttgaggctgcagtgagctgtgttcacactactgcactccagcctgggtgaaagagtgagatcttgtctcaaaacaaaacaaaacaaaaacaaacaaaccacaaagatgttaacaacagttagtcctgagtgtggcaggaacatgggtggtaattatcttcttttcttttctgtattttaaaatactcccccaaacatacacacagagccttccaccatgaacttacaagatttgttctctaatgttggttacacaggacccccaaaagaagttccattctgcacctgaattccaacaaccagggttggggagaaagagaggtctcatgggacaaccaggttgaaaatgagagccttatttaatgagacactgaaccggtagtgaagtacactaaagcactaagggcacatttgctcatgtaccttttaaggacaattggaacagcaatggagggattctttctcagaccatcaatgatgtcagctgctttatcagcatatatcctctggagtgcttttctatggatgacttctgatgtgcccccaagggtgttgtccaagcgaaatttggcttgttcttcagcagacaagcgggaaagcttcttctgtattgcttccagaacccggattgttgccagattggtctctaaaactacatcaagctgaagaggaagacaaagaagggtatgctcaggacccaaatcaaaatagaatagagtagtgtttagaagaataaggtagggagtcaaactccttggatttgaatcctggttctgccctactagctacataagactgtttctttatcagcaaaatagggataacagcacctattactctcacaaccctgtgtctggattaaatgatacaatccacataaagtatttagcacaatacctggcacataagaaccacaggatgaagttggataaatggtagttattaccaccaccgtcgctgctgccgccaccaccaccgtgtgctttgcttaggactactgattttagaccagaggaaccaaacaggagatgactttactgaaacgtttccctgaactttcctgaattgctaagatccattatgaacaaacaataacaatcaaaacaatcccaaaagaccgctttgtcttgagagttttttggtttaacttgaaatatttaaatatattcaaatacttaaatattcaatagccttgttccacatccagtaataataagagcagtgactatcataacttaaggagttcactgttgtagctgcgggtaaccatttaaattcttattggactcctggcaacctttgagtctactttttccctagcttaaaataaggttctctaaatgagaaacagaaaatgaagtaaatgagcagtctcaacggtctacaaccaactgtttgcagaagtgttccctaagttttcttgttttgggaatgtggtagtcatttggtcaatatttctggcccctcttgctctccaattatgaacaaaaaatggactaaacttcctggctcccttatgattggatagggccatgtaactagttttgaccaatgagttgttatgagatgagtagaagtaatgtttattacttctaggctgcagcatttaaaggtgtgagatcattccaagctctcttttcctcctagtgactagcaacattcataatggcagcaatcccttggcctgaatccccaagtaattctgatatgccaaatcccctgctaaacatcaatgtacatgtagaatgattagaaattaaacccattggttttacaagtcactcagatgtgggagttgtctgtactgaggcattactaacctatcttgattggtaacgcacattccttcaaactagctcatcccaccaaatcttaaacacatgcacaccccacttctttcatgtttgcccttgtagtcacaaatgggaaatgaagttgcctctcatttggaggcataccagctgagagaggataggaacactctgtcaaaaacaaatgccaagctctgctaaactcatcagttaaccttactaaacgtaagtaacaaagaaatgccttctttagcttgataacactccctatggaagttaacatctgtcttgatttagctttctgcaaataggtgcaactccttataaatgctggggcaaagatggccaaccacctgccagtggccaggcagcatgtggttctcaattaaaaacacaccagaaactgctgaaccaagtgtgaggcgggaaaactggcaaagagctaaaagagtaccaaaacaaacaaacaaacaaacaaaaaccagcaagatacctatccacacaagtaagcacagccagtcaatttaatgtaacagatacactaaataggatacgtatcattttacatctttagacaaaccagacttccctttttaaaaatgataatgtaaaccagacatataaacacactgaggattgagcccactttcagtagtccctctcctgatataggtggtatggggccttctaccacctcatttattcactccactcttcccttcctaattacttcaaaataaagctcctgggacaggcgcagtggctcacacttgtaatcccagcactttggaaggccaagacgggtgggtcacttgaggtcaggagttcaagaccagcctggtcaacatggtgaaacccatctccactaaaaatacaaaaaaaattagccgggtgtagcggcatacacctgtagtcccagatacttgggaggctgaggcaggataatggcttaaactcgtgaggcagaggttgcagtgagccgagatcacaccactgcactccagcctggttgacagagcaatactctgtctttaaaaagaaaggggtccctaatttagccttctttcaaaaggagccaatcaggccaggtatggtggctcatgtgtgtaatcccagcactttgggaggccagggtgggatgatcgcttggacccaagagtttgagaccagcctgggtaatgtagtaaaacactgtttctataaaaaacaaaaaattagccacagggggtaggaggcaaggggagggagagcattaggacaaatacctaatgcatgtggggcttaaaacctagatgatgagttgataggtgcagcaaaccaccaaagcacatgtatatctatgtaacaaacctgcacgttctgcacatgtatcccagaatttaaagtttaaaaaaaaaaaaaaaaaatttacccaggcatggtagcacatgcctgtagtcccagccactcggtggcgggtaggggtgggggtctgaggtgggaggatcacacttgagtctggaaggttgaggctgcaatgaactgtgattgtgccactgcactgcagcctgggcaatagaatgagaccctgtctcaaaaaaacaaaacaaaacaaagcaatcagctgggcgcagtggctcacacctgtaatcctagcactttgggaggccgagacgggtggatcacgaggtcaggagatcgagaccatcctggctaacacggtgaaactccgtctctaataaaaatacaaaaaattagccggacgtgttggcgggcgcctgtagtcccagctactcgggaggctgaggcaggagaatggcatgaacctgggaggcagagcttgcagtgagccgagattgcgccactgcactccagcctgggagacagagcgagactccgtctcaaaaaaacaaaacaaaacaaacaaacaaacaaacaaaaaacaacaaagcaatcaataccagaaacatgaaagaaaaatgccagttctcagagctggtttgctaaccatggcaagatacttgctaagggtaacaatacacacagatcttaaataatttaaaaacagcttcaagaaagtactataaaccttaggatactgattttcttcaccatgcaaaacataataatcttaaaatgccatgcaaaatcaaaagaactattatttagtcatcaatggacaatttcagttaaaagggctaaagtggcctagataagtcacatttgccataaagcatgtactaatatatacatttgaccaatgcataaagcatggaaagtaccacaacaagcacttaccatagaagaatgtgagcctttggctcttccatcttaataaccctcagagacaggtactgatagtctcactgagcatctcccatttcccccaacttcaaatgccaaacaagcttgtacctcaaagcgttcatcttcacaacgataaatatgttcttcatattgagtcttcttggaactcacaaaggtagagtcctcagaccacgaagggaaggaaacccaggtatcatttaaaacctttgggtagaagaagagagactgaaacaaaagcctaaaaaagctttctggtgattaagcattctgaatgaaaagacaaaactctagcagagaaataggcaactaatattacttcacaaatttcacctttagcaagtttacaaaaagctattagtaagaaaagggtgctgaatataagcggaaatataattccagtgctttgggaggacgaagcaggaagatcacctgagcccaggaggagtgacccaatctttacaaaactaaaaacttttatttttatatttttagctgggtgtgaaggcatgtgtaagtcccaggtacttgggaggatcatttgagcccaggaggttgaggcactatgagccgtgatcacatcactgcactacagcctgggtgacaaaacgaaaccctgtctcaaaaacaaacaaaaaagtagaaaacattttctttttaaaaaggattaaaagggttcttaatttcatcattcatataaattctcaatccttggtaccaccactcccttctggaaaaagctgaggacccagggctgatctttgctagggaaggccttacctctttacagagaggagtccgtcctgtacacttgggctgctggtaactctttggtaaggctcgatagctggagcccaatcgtttacaagaagcataatctatctccatagcaatgccctctgtggctcgctcctttggataagtttccagatgtacagactccttatagcccagaaagtttttaaaccaattaaacaactcagggaatttcctgaagaatcaaaccaaaaagtgacaagcaattaggggcaggatgcagttatcctgaggtatgactactaccatctggttttggatcagaaatctgctaccagggatgaattatttcctgcctaagaagaactgcttctgagcatttggtttcccctttttctaataaaatactctcagatcagttaaagtggtgatcaaagagttgtaccgaaaccaggcaaaataacaagccattcttttgatcaagaatattgctttaatgttcacataattcttaggttgtcaaatatagtaaagattccagactcggtgtagtggctcatgcctgtaatcccagcactttgggaggccgaggcaggtggattacctgaggtcaggagttctggaccagcctggccaacatggtaaaacaccgtctctactaaaaaacataacaaaaattagccgggcgtgtggtgacaggcacctgtaatcccagctacttggggggccgaggcaggagaatcacctgaacccaggaggcggaggttgcagtgagccaagatcatgccatcacactccagcctggggaacaagagtgagacttcatctcaaaaaaaaaataataataataatttttaaaaaaattccagaactctgggagagatttttcttgataaacatccagcactggttagaagatcaggagaccactagtcttggccattagtcgataaatacttaatgccctctctattttctcatctctagagctggactagaagacttctcaggactcttctggcactaacatttgagtcaactgatgtatctcaagtaaattaactttgcctatcatatactctcacaaatcaaacattacctggtctccatatcatgcatcagggctaagcccctcacttcacttaccccaggaaaggagagactagttgcacaagctcagcacgagagatcacctcctggttaaaaataacaagacagcgtaggaaattttcgtaggcttctgcactccgaagagcctttcggaccttatggagacaacgggaagaaaaacagtttttgtttttcttaaagtggggaactgaaaagggcctcgctctgtcgcccaggaggaggcgcagttgtgtaatctcagctcactgcagcctcccatcctcagcctcccaagtagctgggactacaggtgtgagccaccatgcctggctaatttctaaattttttgcagagacgaggtcatatattgcccagctgccctgccattagtttttaaaaactggggaaatttgtggctgggcgtggtggctcatgcctataatcccagcactttgggaggccaaggtgggtggatcactggaggccaggacttcgagcccagactggccaacatgctgaaaccccgtctctactaaaaatacaaaaattagccaggcatggtggcacacgcctgtaattccagctacttgggtggctgagtgaaacataagattatcacttgaaccctggaggcagacgttgcagtgagctgggataatgccactgtactccagcctgggtgacagagcaagactctgtctcataagtaaaaaaataaaataaaaacggggaaatttaaactgatatttgatgacactaaggaatcaacgttagtgtttttagatgtgataatgattatgtttgcaataaggagtttttttgttttgttttgttttttaaacgcagtccagcactgttgcccaggctgaagtgcagtggtgcgatctcagctcactgcaacctctgcctcctgggttcaagcaattctcctgcctcagcctcccaagtaggtgggattacaggcatgtgctactacacccggataatttttctatttttagtagagacgaggtttcaccgtattggctaggctagtctcaaactcctgaccacaagtgatccacccgccttggcctcccaaagtgctgggattacaggcgtttgagccactgtacccagccacaaaaaggagtcatttttaaaagaaacttactaaaatatgtatggatgaaataaggtatctgcgatttgtctccaaataaactgggatgggtgggaatatatatgaaacaagtaactggctagaattgggaaccgctaaagctggatggtaggtacgtgaggaatcattttactattctgtttatgtatgttcaaaattttccagctgggcgcagtggctcacgcctgtagtcccagcactttgggaggccgaggtgggtggatcacctgagatcgggagtttgagaccagcctggccaacatagtgaaaccccattctactaaagaaaaaaatacaaaaaaattagctaggcgtggtggtgggcacctgtagtcccagtgactcaggaggctgaggcaggagaatcgcttgaacccaggaggcagaggttgcagtgagccaagatcacgccactgtactccagcttgggcaataagagcgaaactccgtctcaaaaaaaaaataccataataacaatttaaaaactgagatctcggagtataccttctcatatgcttgattctccacaccatatcagagttactcaggtttttgttgcctctttttcttttttttttttgagaccgagtttcactattgttgtcctggctggagtgcaatggcgcgatctcagctcactgcaacctctgcctcccgggttcaagcgattctcctgcctcggcctcccgagtagctgggattataggcacctgccacaacgcccagctaatgttttttttgtatttttagtagagacggggtttcaccatgttggccaggctggtcttgaactcctgacttcaggtgatccacccacctcggcctctcaaagtgctgggattacaggcgtgagccactgcgtccggcctgttgcctctcttaacatgtttacagcaagaatctttgccaaggctgttttaaactctggtaatctggaataacgctctcttaagatagttctgtcctctgatctggtcttttttcttcctctatttacaatattgagcatcttaataccaaaaacccaaaaatgatcaatggcatagacaaagtaaaactagtctagctagattaccaatctggagtttcagttccaaaataagtatttagcactgtgatcctttggtgaagaccacagactgccaccaaaccaagtggcttatcagcaacccctgctccagacttccgtatgcttttcttaactattcatcagtagacactatatagaatctagacttttaaagctaaagataaaagaacactgtaccttttatactgtataccctatttacctttactttttattagcttttaaacatacacaaaagtagacagaagtataacgaacctatgtactcaccccaacctcaatgatctatagtaaattttgtttcatctatacttacttctcctaccactgcattttaaagcaaattccagacatttcatctagatatagtatatatgtttaagaaaaagtactaagaaaatgccattacaggactgggtgcagtggctcacgcttgtaatcccaacactttgggaggccaaggcaggcggatcacctgaggtcaggagttcgagacagcctggccaacatagtgaaaccctgtctctactaaacatacaaaaattagctgggtgtggtggtgggcgcctgtaatcccagctactcgggaggctgaggcaggaggattgcgtgaacccgggaggtggaggttacagtgagcccagatcacaccattgtaccccagcctcagcaatggagtgagactgtcccagaaaaaaaataaaaaaaaaacaaaaaaacaaaaacaaaaacaaaaaacccattactcttagaaattaacttattttcagaagactccttaaggcaaggcatggtggctcacacctgtaatctcaacactttggaaggcaaatgctgaggccgaaggaggaggattgcctgagcccaggagtctgagaccagccagggcaaaacattgagaccccctctctccaaaaaaattttaaaaattagctgagtgtggtggtctgtacctgcaagtcccagctactcaggagggtaagaaggatcacttgagcccatctcttaaataaaaaaggccaggtgtggtggctcacacctgtaatcccagcactttgggaggcgaaggagggctgatcacccgaggtcaggagttcaagaccagcctggccaacacagtgaaacctcatctctactaaaaatataaacattagccaggcgttgtggcggggcctgtaatcctagctactcaggaggctgaggcaggagaatcgcttgaacccaggagatggaggttgcactgagccaagatcacaccacttcactccagcctgggcaacaagagcgagactctgtctaaaaaaaaaaaaaaacccaaaaatgtaaaaaagattccttaatagcatctaatattgagtccgtgtcaagttcaattgtctaattaatgtcttaaaaattggctattggccaggtgtggtggctcacacctgtaatcccagcattttgggaggctgaggtggatcacctgaagccaggagttcaagaccagcctggccaacatggtgaaaccctgtctctactaaaaatgaaaaaattagctgggcacggtagtaggcgcctgtagtcccagctgtttgggaggctaaggctggagaatcgcttgagccagggaggcggaggttgcagtgagccaagattgcgccattgcactccaagctgggcaacagagtgaggctctgtctcaaaaataaaaataaaaataaaaataaatcagcttttaaattcagaatccaaagtctgcatgtcacatttggcttatatatttcttaattcttaatttataatagcttcccttccatacccttttcttgacatttattggttgtgatctagacttccacacttgtctaagagcaccaaccgcccaagcagactttggtaatgattcacatcagagctaaggactcaacactcttgcaggactctcctgcaaaaagctcacataggcacagcagacagaaagggatcaggagatactaatcacggagatgttaaatcatctgcccttctgcaaaacccaagaggcagaaaatagagtcaatcaccacagatcaatccaggttgattcctaccagtgagaagcccaacaggtgccagctaccctgatgaaagtttcctgctaatcatcaagttgactccgaggagcaaatcacacttaagtttatgtggccaaactaaggcaccacacaacatcatttatgccaataatctcaactctcgttgctcattagaatcagctgggtagctttgaaaacatgcaagtaaattagaattcccctgaatgctatgtatgtgtgtactacaaataactatcacagcaataagattacaagtcatcggccaggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtgggcgcctgtagtcctagctactcgggaggctgaggcaggagaatggcgtgaaccccaggaggcggagcctgcagtgagccgagattgcgccactgcactccagcctgggcgacagcgagactccgtctcaaaaaaaaaaagattacaagtcatcttaaatcctcaaaaattggtacaggcactggtactgcctgccacacagacctggatatctacaatgggagctccaaacatctttcaagagaaacataatacattttctaaaaatctgtcttctgccccaaactgcttcataaaaccaaagcaaacaatgctaccatttttctagctatgctaatagtactagcagactcaaaggactcacaactgggaaactatgttaaaaaacagaaagtcctaattagcctgacacctttaaaacgaaaccttccagggggataagatgattttcttttggcattaacaggcactatcaaatctaactcatccattactcaccttatcaaaaaataacgattctgttccaccaccatgtttgctggcatctgccatagaagaatccttcagattgagcagtttgggtttcttctgcaaaagaaagatacaaacatgtgagattcaacgagtggttttctctgaattttatttttgtctgtattcaatggtttcatcactgaaaccactgctgattaataatttgaaacaaatgagagaactctaaccaactcactccataccctctaagatttcaactcatattttctatttcagtttgcctattaagtttctttctacaacagaggttcaaagatcattctacccccaaaatattttctccagaaatgatcatgacattactgtgacaaacttttagaatatccttactttttctaggggcccaaagtaacttcatgtagaatctaatgccactgttttgttctcctaccagctgagggagaaaaggctgtttgtaaaaagagctcacaaattgacagaaatcaatctttaaccctgaataatatttcaattaaaaatttacttaaaaagcataatttgctgggcatggtgactcatgcctgtaatcccagcactttgggaggccaaggtgggcagatcatgaggtcaagagattgagaccatcctggccaacatggtgaaaccccgtctctactaaaaatacaaaaaaattagctgggcgtggtagtgtgcgcctatggtcccagctactcaggaggctgagacagaagaatcgcttgaacccaggaggtggaggctgcagtgagccgagatcacgccactgcactccagcctgggcaacagagtgagactccatctcaaaaaaaaaaaaaaaaaaaaaaaaaaaaaggcacgccagcaatatccactcagactaatttaatattgttcttctaaagggaaccaacaggccatgatataatcctgtcaggcaagaagttacttttaaaatccaccacttactctctatgaagaaatgcacaaactttgtgagaagtagcacatttaccttggctatctcagagtatactttcttaagagccgcagcctctgcttacactgcctatggagaaagtaggcggagaattttaagcccccactatattcttgccacctgtaggtaatcaagagtgggcggacgtaaatccaagcatggagtgtatctactgagctgattcttgctacccatataactaattctctttattgaaatgaagaaatagaaaccattattatgttcaacttgatttcaaaagatttcaaaagaagaaaccatgacaaacactaatgaaaaggatacttcaaaagtgtcagtaacacctagtacgtcagaccttgtagtcagtcaatcactattcatcagccacctcttactattagaaattcccaaacttttgtcattatttaattctgcagacatatctgtctcttctatattacatactgctttgaaattcactgaagaattaaacattcaatacatacaactagccctctccctatcatagctgtgttacatcaaagaagggagcaagctaagttttctgcaggcagaccatcagtgttaactataacaaaaaacatcatgtaatggattactaagaggagtttaagacttccctctgctacagcccaaaggtcctgccttggagattaagatgatacacataagatctggtaacccaacaaagaactttgagcaggacagggttctagaccagagatctcaaaaaacacatgcactctactcacaagaggacctcagagaccacttatttctgaaataattctcaagctcaagaatgttctttcttaacacaaggcagatttaaagcatcaaagaagaaggggccaggcgcggtggctcacgcctgtaattccagcactttgggaggccgaggtgggtggatcacctgaggtcaggagttcaagaccagcctggccaacatggcgaaaccccatctctactaaaaatgcaaaaattagctgggcgtggtggcacacgcctgtagtcccagttactcaggaggctgcggcaggataattgcttgaacccgggaggcagaggttgtagtgagctgagatcacaccactgcactccagcctgggcgacagagcaagactccatctcaaaaaaaaaagaagggaaaaaaatttcaagtattggaaattcttagtagcaaccaaaacattaaagaaatgacagctcattgcaaaggagagataataaagaactcagaaaagtacagtaatccaagcaatcaatgttattctaatactcttttgcaaagccagataaactctgcactgagtttctgtgacacaatactaacttcctccaaatatctaggacccaaccgttaacacacttaagaacacatgactgccgggcacaggtaatcccagcactttgggaggccgaggcgggcagatcatgaggtcaggagatcgagaccatcctggctaacacggtgaaaccccgtctccactaaaaaaaaaaaaaaatcagcccggtatggtggcatgcgcctgtagtcccagctactcgggagggcgagacaggagaatcgcttgaacccgggaggcagaggttgcagtgagccgagatcgtgccactgcactccagcttgggcgacagagcgagactcggtctcaaaaaaacaaaaaaaaacaacaacaacaaaacacatgaccacctctagagtacctctccattagaaatacttgtgagtgtcaaaatgagcagctgctgcccattctcaccttaactggaggggtggttcctgtaggatgtctgcggatctggcagccattctggctgggcctctgcggcttgttgttcagttggggcttcttgacagtgcctccatgatcatttctcacagaatcaaccttctcagcagttgttttgcttaaaagctgattaagacacatgaatgagattaatgctcttatcaaagcaaacaaatatcatctaggaaaagtccccttctgagcacagttttccaactcatctaagataataatagtaaatagtgtaattcttattaaaaaaacataccacggagctgttggcatctggtaggaattgtccaaactctgacaacaaatcttcctggtttttaaagagacgagcaacctgggcatacacctcctgctctgtcaatgctggagtgtagtttcctccagcttccttggcatttctctgctctttctgaggaattgcaaatgaaaagagatcatttgggctactgttttgagtcactcatctttgcacgctttctggaatcactgttatctatttaggctgcatgtaagaagaaagtctatgttcttagcacccgttctgaccacagactttcaagttgagaaaaaaaaaaagttgaagatggtggatgacaattcctttcaaaactagggtagtaaatatttttgagacggagtttcactcttgttgctcaggctggagtgcacttgtctcggcctcccaaagtactgggattacaggcgtgagacaccatgcccggcctagggcaataaatattaatgcccaggggaccactaccaactgacaaaaccttagaaatttctcctcctcctactgtacattaactagactatataaatcaccatctaactgtcccagataaaactgagtttcatttcatgggacagtgactaacaatcctgactgaggccgggcacggtggctcatgcctgcaatcccagcactttgggaggccatggcgggtggatcacctgagaccagcctggccaacatgttgaaaccccgtctctactaaaaatacaagaaatcacttgaacccgggaggtagaggctgcagtgagccgacactgcactattgcactccagcctaggcaaaaagagcaaaactctgtctcaaaaaaaaaaaaaaaaatcctgactgaatgttgcagggcaatcaagtcaggcaaataaaactggctttatagcatgggggcggtggctcacgcctgcaatcccagcactttgggaggccaaggtgggcagatcacaaggtcaggagttcgagaccagcctagccaacatagtgaaatcccatttctactaacaatacaaaaaattagctgggcgtggtgggcggagcctgtaatcccagctactagggaggctaaggcaggagtatcacttgagcccgggaggcggagactgcagtgagctgagatcgtgccactacactccagcctgggtgacagtgcaagactccgtctcgaaaaacaaacaaacaaacaaactggctttaaaaacatgcatgatagtttctaactggttaatttccagtatgaattaatggacacaataatggttacttgttattggactagatgccctaagagggtgacctggttaagacaggctgaatgggcactccttacctgatatgtgtgcaaaatctccaggaatgctttgtagatgtctggttggccctgaaatctgttcttgatcttattaacatagttgatggcatgattaaactccacaggttgattgttctgcaaggatggggccgttcccaacgagattgtcactggtgtgtgaggctggaccggcggagaacgtggggatgcatacggtggaagtgggggagtctgctgactggccggagtatgtgcttgcagttgggagggctagaaagaaaagaaatctttattctcttcagatgcatagatgagttgatacaaggaaagttcaaactaaagagaaacaaggtgtcaacgtatatcctttatttactcactcaggccaggtcattttagtccaacacaaatcatactgggcagcagtgggagttgtaggcggttcaaacatgctgatacaaatatttcagtctcacattttctaaataaaaccttaaaactggagccatctccaattacagggaagaatttttcatatgcaatgttttagcttagtagctcaacaagtacacatagaaaaaatctcattctacatagccttttgatgtcaacaacaagacaactgttgcagtagctccacataaaaaagtcttctacgccaactctgtcctgtagaactgagatgatggaaatgtcctttatttgcactgtcttatacatagccaccagccacatgaggttactgagcacttgaaagctagtgcaaatgaaaaactgaatttaatttaaatagtcctatgtggctagtggctactgtgtcagacagtgtggttctagaccaagaacaccccatcttcatcaccatcactatcactattcattagatcttctacttagcttgatataatctagttagtgaaataactttcataaaataaccatgtgggcagcagcacaatttgaccaggataagacgatggtttctatctgtgctgtcaactactactacacaaagtcaccacctgttgggatgttcatggttttataagcagaaactgtaaaaagaaagaccttgaaagttgttgctgtgttgatttaaatagatacctaagtaagtgatgtgtaaatgtgaaccatgtcatagtgaagttttcatacagcatttttctatgacgaaatctttgtaactttgtttctcagtatctaagtcttatataaaggggaaacatcaaaggaaggtgctctctagggatgcattcatattgatgcaatattttccaagtgctcaccttgctgactttggcaggtgggggctgaggagctggctgggcaggagctggggctgactgggctgaaggctgggaaggatgttggggtggtggttgaggctgtggctggatgccatgggtgggaatctgatgaacctggccaggagttgtcacattcaccatgtcattggtttgcacctcaattttgtagccagggggcaagaaggtgttgaatcccattatcagatcggggtggcctttgaatagctgggacacacgactaatcactcctggggtgtcgatgctgataaaaaacaaaaagaaaagtgataaactgtaagcttaacaaacaccctgttaagaaaaaatttcatgtttttttttcttttgagacggagtctcactctgttgcccaggctggactgcaatggtgcaatcttggggtcttggctcactgcaacctccacctcccgagttcaagtgattctcctgcctcagcctcccaagtagctgggattacaggcatgcgccaccatacccggctaatttttgtatttttaggacaggtggggtttcaccatgttggccaggctggtctcgaactcctgacctcaggtgatccgcccaccttggcctcccaaagtgctgggattacaggcatgagccacctcactcaaaatttcactttctactaggttttctctaaacaggaaaacagatcatctacgcattttaaaattaacacacgaactctgaaattccaaagccatttagttttagactcaaagatacttggccacaatttgttttttttttttttgagacagagtctcattctgttgcccaggctggagtgcagtagcacaatctcggcacactgcagcctccgcctcctgggttcaagcaattctcctgcctcagcctcccaagtagctgggattacaggcacccgccaccatgcccggctaatttttggaatggtcaaaatttttaacagaatatatgttcattgtaataattctaccaagcagatactcagatgatatatataaagctacatatcccaaacaagattcactctttgatataccagtatacatcatttcagcacacatctacattgttcagatgagttacactcttacaacagtgaaccatgccagaatataagggtatctaaaccaattcagaaaccaagtagcctaaatcactaccagtgctacttccctgattgagacaaaacactggaaaaaatttagttaaggaaaatttaccaatagggataaaaaagtctagtggccataatttccatcaataaaggtatgcataaaataaaggcatgattttgaaaattcagctgcaaaaaggagcatcctttatcttccagtaaataaactatatcctcttccttccaaaatcaatatgccagatacaaagcttgagtacaatcacacatcttttacctctgagatttaaattccttcatgatgtcaaggaaatcattgtagacctgaggctgactaccaaactgcagcttcacctggtcaagataagatagcgcatcctccacctgaggcagggataaatatcaaggttataaaaagaaagtaagctcataattacaaaaaaaaaacaaaaacaaattatttatgcctaagtatgcttaatgcagtaaatgaagtaaaaatatattaaatatatacttaaaagttagtatggataccaataataaactcaagcttaaaataataatcaactcataaaatctgtagccttgccttggaaaattttgaacagaatgatcagtgaagaataattacaatgatatatcatttattaattcatttcacaagtatctactaaactgcaacataccaggcccaatgtgagtaccaaggattcaatgacaaataatttgtagcccctcgtctatagacatttgtttgtatgtagtcaggaatcataacacagtgggtaacccggtaatcactccatgcctggagatgacatgggaaggacacgtcttctccaccaaaaaaagtgaggcttccccaggaggtaatgtataaactgagacctaaagatgactataagctagcaaaagtgaagaccagtgaagaaaatcaaaagcggcagcacgggtaaaatcctagacaggatacgatatgggatatttagaaatctgaaaacagtttagtttggctggaggatctgtagtgaagaggaaggaaaagtaacaaaatgagacagaaaaaaaagcaggatctagattctgaaaggatttgtaaatcttgtgaaaaagcaatttagatttttatcatctgcattttcgtgtacgcaatttgactgcagtgttgagaaaaaattggcacaagagcagaaaagattgaaaggaggtaggaagaccaggtatgctacaggaataactggacaactcatgtgaaaacagtggcttgaattatagtactggcccagaacaacagagagaactgcatagataaaaaagctttttgggtagtagaagtgacaggattggggaactgactgaatagaggagctaagggagagccagcattcaaaagtgatccgccacggagcactgaggaagaacagtcaagagtgactctcggaccgatcaaagcccacatgccactgcatcccgcactcagcgcttacatccttccacatcaccaccacacccaagagaaagcctgaaggggatgctaaaggagatagagccaaggtgaagaacaacccagagaagatccgcaaggttgtatgctaaacctgctcctccaaagccagagcccaaccctaaaaaggatgcaggctgggcgcagtggctgacacctgcaatcccagcactttcagaggcagaggtgggaggatcatctgaggtcaggagttcgagaccagcctgaccaacacggagaaacccatctctactaaaaatacaaaaattagccaggcatggtggcgcatgtctgtaatgccagctactcgggaggctgaggcaggggaatcacttgaacccaggaggcggaggttgcggtgagtcgagatcatgccattgcacaccagcctgggcaacaagagtgaaactcggtctcaggaaaaaaaaaaaaaaaaaaaaagtcccctgcaaaggagagagaggaggtacccaaagggaaaaaggaaaatgctgacactggcagggaggggaataaccttgcaggaaatggagatgccaaaacagaccaggcacagaaagctgaaggtgctagagatgccaagtgaaacatgtgcatttttggtaactgtgtacttctggtgactgtaaagtttgaactataaagttatgaagtttgtaaattttgaaataccattgtttaaatcaagctttataaaaatgcagaattttgttttgctttttctaaagcagtgttgttatcgcacacagaacacttcattgttgttttggtgggaaggatcacaggtcactaatagaatgtctttgaagctggactgacgtggggaaaacacctttcccttctagttttgagagacttcctcttggcttatagaagaaattccctgactttatttacttatttatttagagacagagttttgctattgttgcccaggctggagtgcagtggtgcgatcttggctcactgtaacctctgcctccggggttcaagcgattctcttgcctcagcctcctgagtagctggggttacaggcacccgccagcatgcctggctaatttttgtatttttagtacagacaggatttcaccacattggccaggctggtctcaaactcctgaccacaagtgatctgccagcctcagcctcccaaagtcctgggattacaggcgtgagccaccacacccagcctagattccctgacttttaacacacatggccaccttggcacaaacaccttgtgggatggaaaaacaaattcatttttacatcctgttctccctccccaccttcacagacctaactcccttttacccagacacctgttgggacctaacccccaataactggttaccaatatgtcaggcagtcaaactttccagtgatgccactgaaatggcagccctcaaaagagcagtggttgctttttctagactgtggatcttcagataagtcctgccattttcatttcacttcctgaaagtcagggttggcttgtgaaaagttgttaaacaacatgctaaatgtgaagtgtcaaccttcactctaaactttccctgttcagagcatcaaatgagacttcactgggttttatagtggcttttttttttttggtagctcattgttaaggattgtccatgttctgcctgaaataccatgactgtttttggaaagtatctttaaagctggatacagtttggctgggggagaaaaaaaactgacctatcacaaagaagaacaggttggaaaggctaagctatgagtctgatttaggacagagacacccaaaagaaatccccactaggtgtttcctatttactctgagatacgttaagttttattttggtagtttaactgaagcctaaatatttaaaattatacaaaatatcaggtttaagaaatttcagaaataaacatttgatgtgatttaagccagtctttttcttttttttttttttgagatgggagtctcattttgtctcccaggctagagtgcaatggcgcaatctcgggtcactgcaacttctgcctcctgggttcaagtgatatctcctgcctcagcctcctgagtagctgggattccaggcgcatgtcaccacatccaactaatttttttgtatttttagtagagatgggatttcaccatgttggccaggctggtcttgaactcctgacctcaactgatccgcctgcctcagcctcccaatgtgctgggattacagatgtgagccaccacacctggccaggcatagatagtcttttgatttgttgcaaaatggaacatttacattcaagtcaatcattaactggtgctgtggtctgaaatgtgtcccacaaaattcttacatcgaaacttaatcaccgatatgatgatattaagaagtgaggccttcagaaagtgattgtggagccctcatgaatgggattagggaccttataaaagggctggagtgaaccagtgttagtcccttcggcccttctcccttccagtgtaaggacacacattcagggaccatctcgaaaaacagagttcaggccctcaccagacaccaaaccaactggcacctggattttattttattatttattttatttattattattattatttttttagatgaagtcttgctcttgtctcccaggctggagtgcaaaggcacgatctcagctcaatacaacctccgcctcccgggttcaagcgattctcctgcctcagcctcttgagtaactgggattataggcgcctgccaccacgcccagctaatttttgtatttttagtagagatggggtgtcaccatgttggccaggctggtctcaatctcctgacctcgtgatccgcccgcctcggcctcccaacgtgctgggattacaggcgtaagccactgcgtctggcctatttatttattttgagacatggtctcactctgtcacccaggctggagtgcagtggcacaaattcggctcactgcaacttccacctcctgagttcaagcgattctcgtgcctcagcctccagagtaactgggattacaggtgcatgccatcatgcctggctcatttttttgtatcttcggtagttttaccatgttggccaggctggtcttgaactcctgacttcaaatgatctgccctcctcagcctcccaaagtgctgggattataggcgtgagccaccgcacccggccagcaccttgattttagatttcccagcccccagaacttctccagaactgtgagaaataaactgctattatttagattatacagtctcaggtattttgttatagcagcactaatggattgagacaaatggccgcttttttgtttttgttttttttgagacagagtctcgctctatcgcccaggctggagtgcagtggcgctttcccggctcaccgcaagctctgcctcccgggttcacgccattctcctgcctcagcctcccaagtagctgggactacaggcgcccgccaccacggccggctaatttttttttctatttttagtagagacgggatttcactgtgttagccaggatggtctcgatctcctgacctcgtgatctgcccgcctcggcctcttaaagtgctaggattacaggcgtgagccaccgcacccggccccgagacaaatggctgtttaagagttcttcagacttccattacggccatggttaatcagtgtttcggtgttgctagaaatcagattgtatagttggtcaatacccacttgtttgatggttagtttttctatacaaatatcatgacaatttctgttgaaattcaatggactattttaattcatattctgaactttccatactaaaatgtttcattaatgaccaacttaagtgaacacaaaatatattaagtttgcaaaaggaaccaagactttggaagatatttaagaatagcatgcatcattacacaacaaaagaacagttatcaataagacatggtatggtataaggtaactactgcagagacggaaaaagtacagaaacccaaaagaaagcaattatgtgtgatatgtatatgtctgaaacaaaaaggtactgaaagtcacagcaaaccaagcaaaccactgtttaaaaattagttataggccaggtgtggtggctcatgcctgtaatcctagtactctgggaggccaaggagggtggatcccttgaggccaggagtttgagagcagcctggctaacatggaaaaaccccgtcctagtaaaaaaaaaaaaaaatacaaaaattaggcttggtggtgcatgcctgtaatcccagctatttgggagactgaggcataagaatcacttgaacccaggcaggggagggtgcagtgagttgagatggcgccactgcactacagcctgggcagcagagtgagactctgtctcaaaaaaacaaaaaagtaaaataaaagttatagaataatcctatgctttaaaaactctgcatgacactcacataataaataagacacctacatgtaaaaatagtgaggaaattctctcatcacctaaagcatagtccaactcttatataaactctctataaatgcatgtatacagttctaggtagcacaacttaaaaaaaaaacttggatgtagttatttagaagctacagatttaaggaagcacttggggagacccttagactctgctgataaagtttcttagctcacttcaacagggatttactattaaggccccgaatctcctgaagtctacaatcttgttgggagagaaaaacacaagcaactgtaaagataacctgctaaatatgtaccaaatatcactgctgctgacattcaataactaaataacaccaaacatgcctcaaatcgttcaaatcccttcttgtcaccaccaatctaccaaagacaaaaaacaaaaaaaaaagacaatgttgaggcttgaaataatgtgtaagcattctcactgaacatttctttttttttgtttgttttttctgagacggagtttcactcttgtcgcccagactcgagtgcagtggtatgatcttggcttactgcaatctctgcctcctgggttccaacgattctcctgcctcagcctcctgagtagctgggattattacaggcatgcgccaccatgcctggctcattttgtatttttagtagaggcatggtttcatcacatttgtcaggctggtcttgaactcctgacctcaggtgatccacccacctcggcctcccaaagtgctgggattacaggtgtaagccaccatgcccggcctacattattatagaatataaatgatttattgaagttgattcaaatgcttgtaatgcattttaagactgatccaaaaatgacaggcaatgtgggaatactgagttaaattacatggaggtacaagaagcattttacctctcctcatcagaaaggaaattcaacaagttattttatgcaggaatatagtcaagagcttgtgactaaaagaacacaacaagaaatcctaactctatctatgactcactctataaccccaaatccaaaacctttccttgtttccttgccagtttccataaagcaaacaaaacataatccatatacttataccaaagagtcctgtgaggaaggtgggtaaaaactggtgttgtgctttgatagggttgattgaaaaaggctatagaaatacatatgtttttgttagtttaataagcaagtttataagctattttgcaacattaaagtataactactgaatatacagtgttaatacagaattaaatcacgcacaaccaagttttaaaaaaaatattttcaggacttagtaaagtgctaagcccgcagcaataatacattttggtacacagccatcactctacaacagactgaaaatgttttaaaggaaacatcaatattccttatacacattttcccaaagacagaatccagagtgaagcttcaggcctaaaaaacctgtactctctttaaaaggctatgcattagtcaatactatgtaagccaatatagagagtaaattttacaaaattactctaaatcacatagctttgctgtactttataatatttatgtagcatttaatactcttaggccaatattaaacaagttcccaagaatccacaccaacgagggcagggatcaagaagaactaaagtaagtatcagggaaaacagaagaaacaactatttgctgcatatggatatgtccttagagggtttatttctcattcgtgcctgcaagcaacataagtaggttgcaataaccaaatgaagatttaacatctcttcagagttcctccatttattatttcctgaacttaattttatataaacgtaaaattagaaaaattgaaacctgaacacttgctgcaacaatcacatattttgaaaagtaacattcaagtggtcagagatacaaggttagctgggaacacaagcttcacttctccagggatgcctcatgaatttcaaagcactgaaaacgtaccacacatactcagcagaaaatatgaaaacactgataattcattcacagttacagttttccctgaactttataaagattccccccaaaaaggagcatgtgttttactaagaatggacttgatgatgtgagtcaattcagctattcataaacaggaataaaaagataaaggtaataagaacattacaggcatgagctgggcatagtggctcgcacctgtaatcccaacactttcgaaggccaagatgggagaatcacttgaggccagcagtttgagaccagcctggggaacacagtgagactcccatctctgaaactaaaaactaaaaaaaaaaatttttaagaatttaaaaagattgaactgtaagatatattactgggccaatttactgtactaacctgtagccaatcatatatgtgctcaatagagagttcaaaaggaagcagccaaaaaatgaattttaaggtttattttgtattaaaatggccccacaatcctgataacatttgaccgacatgcattcatacagtccacaaacatttgagtatattcttctctggatcaggcactgatgccaagataggaaacataagcaaatttcacaaaacaaaaacggtaaaacttgtgattcgacagctagtatctcaggttagaagttgtaccaccacaaccaacaagctgcaaccagtatttcctgctaaagataaattttttgacccaagaaaaagagctgaataccaccttcagcctctgaaattgctgctgtccctgcactggtgcaactggtggggctggatgagcatgactctggaccacctggcctccgtggggctgcaccgctgttgggtgatgatggctgctatgaactgctgctatagcgggcccatgactgccggagctctgtggcatggctgaaacctggggtgaacaaaatacagacaggaaacttcaaggcttgtacattcttccccaaatgagtctaaataactaacacaaatgcacaaagataattaattggaaacccaaatttctgctgggcgtgatggctcacacctatctcacctacataggaagatcgcctgaactcaggagttcaaggctgcagtgagctatgatcatgccactgcattccagcttgggccacagagtgagaccacgtctctaaaaagagaaaagaaagcctgggcaacatagtgacacccatctccacaaaaaataaaaacttggccaggcatggcaacatgcacctgtggtcccacctactccagaggctaaaggaggaggattgcttgagtccaggagttcaaggctgcagtgagctgtgatcacaccactgctctctagcccaggtgacagaatgagaccgtctctaaaaaaaaagaaagaaaagaaaaagaaagaaacccaaattttccacaaaaggaactggttaaataaattacagcccaccaaagttataacaaaattatttgtagctattaaaaattatatagccgggcacggtggctcatgcctgtaatcccagcactttgagaggccaatgcaggcggatcacgaggtcaggagatcgagaccatcctggctagcatggtgaaaccccgtctctactaaaaatacaaaaaattaaccaggcgtgttggcgggcacctacagtcccagctactcgggaggctgaggcaggagaatagcgtgaacccaggaggcggagcttgcagtgagccaagatcgtgccactgcaatccagcctgcacgacaaagcaagactccatctcaaaaacaaacaaacaaaaaaatatatatatagtttagctgggaacagtgtctcacacctgtaaccagcactttgggaggcccaggcagacagatcacttgagttcaggagcttgagaccagcctggccaacatggtaagaccctgtctctactgaaaataccaaaaaaaatagctggacgtggtaacacgcatctgtaatcccagctactgagaggctgaggcacggtaatcacttgaacctgggaggtggaggttgcagtgagctgagatcatgccactgcattccagcctagaaaacagagcaagactctgtctccaaaaagaagaaaaaaaattatatagtttatctcaaactgtctgtggtaaaggatgagtttttttcttaaaatttcaatccatcagggaccacaacttttataaaaatccaataaaaataaattactatgaaagtgaaataaaaaatacataaacccgccgggcgtggtggctcatgcctgtaatcccagcactttgggaggccgaggtgggcggatcacctgaggttgggagttctcgagaccagcctgaccaacatggagaaaccccatctctactgaaaatacaaaattagacaggcatggtggcgcatgcctgtaatcccagctattcgggaggctgaggcaggagaattgcttgaaccagggaggtggaagttgcggggagctgagatcacgccactgcactccagcctaggcaacaagagtgaaactccatctcaaaaaacaaaacaacaaaaatacataaacccgtaattttttttcttacctttttattgagacagggtcccgctctctcacccaggctggagtgcagtggtacaatcatggctcactgcagccttgacctccccaggctcagatgatcctcccaccccagcttcccgagtagctgggactacaggcatgtaccaccatgcctggttaattgtcgtactttttgtagaaacagggtttcaacatgttgcccaggctggtcttgaactcttgggtatggagtccacctgccttggcctcccaaagtgctggggttatagacgtaagccactgtgcccagcctgtaactttcattactggattttacaaataaaaaatgatcatgtccaattgctctaatagtttctaaacaatttctatacttatgccattacaaactagtaacaaaggatacagattagccatttttaagccacacttcaacaatgatatatatggatatatttgaatctgaaaaaaaagttcataatccacaagttgaacatattcatgtactgtatataaacttttaaatagttttttaaagcacattacactggctgacaaagaccctgtctcaaaaaaataataaaagcacattacaaagcagtatgataaaaagatttcaaaccttagacaactaatatatagcaaaatgttggcatttaatcttgtggttacagaattaaagatgactcttactttgtttctttttgtttttgaaacactctcgctctatcgcccaggctggagtgcagtagcacaatttcggctcactgcaacctgtgcctcccaggttcaagcgattctcctgccttagcctcctgagtagctgggattacaggtgcctgccaccatgcccagctaatttttgtatttttagtagagacagggtttcaccctggttagactggtgtcgaactcctgacctcaaatgatccacccgtcttgggctcccaaagtgctgggattacaggtgtgagccaccgcgcctggcctacttggcttattttgcttatcttgatttgctacgagcactgtatctaatgtaaaataaattttttccccctaattcttgatggtttggcctcaaacaaatgtcttttctattcttttatctcagtctttctcctgtcctcttacaagtttgaggaaataaaagccaaaactactttccttctatatctatttcaagaaatgctacaaaatttttttcagaacttttttcctttttcagaattgttgatcaccacagaagacaacaatctgtccaaatgcccaaatgccccatccccaaaataaggagactaaataacatgaaactttctttctctaaacaatgttaagttttataccacaatttaagagagaataaaactttttttcaaatcctcacttttataaaaattatcctggagggagatgaagaaatgagggagagggagaaaccaagcaactatgcataaatccacagaaacaaaacaaggtgtattaagagtaaaaagaaactatttagacaattctaaaagctctaatgtacctcaaagatgggctagtattctgagcttctgtattccaacatgcatgttttttacagggtttacaggctttcactagactgacttatacaaacacattatagtttccattcggaagaaatttaactatcccaaatgtagaaaacagtcattaacctgtttagataatgaaagtaatcacccaaggtaaacaagcaacttttttttcttccaagtcctaaaagatgccatctgttggcagtcttctgactgctgccccagccccacaggaagggattagacagcctcaaggggactcctgaggaagagtgacacctaaggaatcaccatttcctacttcagctgcatttcctcttctttatatttttatactaaattcctagaaatggaattgccaggtcaaaaactaacaaaaccatctgacacaaactgccaaattgctctcaaaaaagattacgtcagtttatattcccattaccagccgtacatttttaaggtcactaacaaatgaggttgaaggcctccccagaccagttatatgctgaagtagaaagatatccactatatattaaatgaaaagagcaaacagcacaatagtatgtaatgtatgatccacattgtacaaaaagaaaagcagaaagggcggacgaggtggctcatgcctgtaatcctagcagtttgggaggccgagtcgggcagatcacttgagtccaagagttcaagaccagcctgggaaacatggtgaaactctgtctctatagaaaaaatacaaaaattagccaggtgtggtggcatgcacctgtagtcccaactacttgggagactgaggtgctaggattgcttgagcccaggaggtgaagggtgcagtgagctgagatcatgccacagccttccagcctgggcgagagtgtgactctgtctcaaaaaaaaaagtaaatttagatagctagacaggttgatatagatgagcttgtatatgcatataaaactggatacccaagaaattcaccagtgggagaaaatctgaggtgtgacagaaaaaaagtcattttatatcctttttttaaaaaaaaatcaaagtgtggcagggtgcagtggctcacacctgtaatcccagcactttgggaggtcaaggcaggcagatcacttaaaaccaggagtttaagaccagcctgcccaacatggcaaaaccctgtctctactaaaaatacaaaaattagccgggcatggtggcttgcgcctgtaatcccagcgactcaagaggctggggcatgagaatcacttgaacctggaagccagaggttgcagtgagccaagatcacgccactgcactccagctggggcgacagagcgagacaccatctcaaaaaaataaaataaggccgggtgcagtggctcacgcctgtaatcccagcactttggaaggcagacaggcggatcacctgaggtcaagaccagcctggccagcacagcgaaaccccatctccactaaaaatacaaaaattagctgggcgtggtggtgcacgcctgtaatcccagctactcgggaggctgaggcaagagaatcgcttcaacctagaaggcagaggctgcactgagccaagactgaaccattgcactccagcctgggcaacagacagagagtctgtctcaaaaataaataaataaataaataaaataggctaggcgtggtggctcacacctgtaatcccggtactttggaaggccaagaggggcagatcacctgaggtcaggagttcgagaccagtctggcccacatggcgaaaccccatctctactaaaaacacaaaaaattagccaggcatggcagcaggtgcacgtaatcccagctactcgggaggctgaggcaggagaatcacttgagcccgggaggcagaggttgcagtgggccgagatcgcaccactgcactccagcctgggtgataagagcgaaactccatctcaaaataaataaataaataaataaataaatgaataaaataaaaaataaaaaaaccaaagtgatacattactttcataataaaaaagggcaaaaaccaaatttcttcacttctacaaaacagagtaacagatgaatgatcagtgttggtcaggacatagaacaggaatatacaatgcttgggggaacttgctaaagatgcatataccctgtgacacagcaatccctttcataggtacttgacaaactcttgtatgtcctcaaacctgctgactggtttccaacaggttaaggagtttgcaccacaatgtaaaccaacgatggtagacccttgaataacacgggtttttgttttgtttttaaggagacagggtcttgcactgttgtccagtctgaagtacagttgcttgatcacagctcactgcagccttgacttcctgggcttgagcaatcctctcacctcagtctcccgggtagctaggactacagatgcacaccactatgcctggctaattttttatttattttttcaaattaattaattaattctttctttttgagacaagttcacactctgtcacccacgctgggtgcggaagcatattcactggagcctcaacctcccaggctcaaatgatcctctcacctcagcctcccaagtagctaggaacacaagtgtgcaccattacgccctgctaatctttatttttaggagagacggggcttgctatgttgcccaggctgatctcaaactcctgggctcaggcaatcctcatgcttccaacttcgccaactgttgggattatgggtgcgagccactgcactcagcaacaacacaagtccacttatacatggattttctcccacctctgccaaccctgagatggccagactaacccttcatcttctttctccctcctcctcagcctcctcaatgtgaagacaaggatgaagacctttatgatgatccacttccacttaataaatggtagatatattttctcttccttatgattttcttagtattttgtttcttctagattattttaagaatatagtatatgacaaatatacaaaatacatgctaatcaaccatttatgttatcggtaaagcttctggacaataggctatttgtatttaagttttaggggagtcaaaaattatacattggccagacgcagtggctcagacttgtaatcccagctctttgggaggctggctgggggaggatagctttgggccaagagtttaggaccagcctgagcaacacagcaacacctcatctctacaaaaatcataaaaattagccaggcatggtggtgtgcacctgtagtcctagctactagggaggctagggcacgggaggactgcttgagcccaagagtttgaggctgcagtgagtcatgatcgcaccactacaccccaacaggggccacagagcaagacactatctcctaaaaaaagaaaaaggaaaaaagttatacatgtatttttgactgcatggggggaagtcagtgcctcaacccccacactgtccaagagtcagccatatttcactacaatgatgtttaattcagctgtcttttttaaaaataaatagcaaaactgtcttaataagtgcgttgatttaaattctggcacaagcttcttattttgtcatgaattgccactgagtgcactaagacaatatcacaatgttcacagcagcacctttgtaaaagcaaaaacctggaaacagcccaatagtccaacagtagaattgacaaataaattgagtatatgcatgtaatttacactacagtgaaaatggtggaattacagcgatctataaaaatatggggtttttaaaacaaagtgagtcaaagaagaaaatgtttccatttatataaaagttcaaaaataccgaaactaaacaattatgttagtttttttaagtaaataaagtcaagggaatgataaatacaaagtttagatcagtggctacctctgaagggagggaaaagaagggagcagagtgggatacgcagggaacttcaaaggtcatgacaacattctttttttaaaaacttgtatggtgagtacacagttatttttttttttaccttacacatactcaacaatttttaatatctaacacagtattaaaaaaagttttataattgcctaaaaccactatttctcttccctcattctagtcccttggttggctccagcttacctggtagctgggtgttacagagtactgaattcccgtagctgactgcatggtctcagacactgcttcatacacaggaggggcaggggcaagcacccggtgctggtgaggaaaagcctctgtgctgccagggatccgacgctgctgggctgcatacaccggtgactcctggtcatccaaacgccgcttcattctgtgctcatgctcagggatgcactacaaaacctgcagaaaccaaaagcaatagcatgcaagtcaattctcactccagtatgatgtacgccacttaggaccagtcacccaagtttagtaaaagcttgactcccagaactgatcatctatttcatcttagtgatgaagtttaagtgcatgtgggcataccaccccccaacacagtgaacaagttataactgaaaaagacaaatatttaaataacataattttaattaatttggtattatgaagttgaaaaatacgctccaatttaaaaatataaacacaaccttgtttccctttattctctagttttctcctcaaatgctatcactcctaatattaattacatatctacatgctgcaaaaatattcaagtgcttcttctttttttttttgagacggagtctcactctgttgcccaggctgagtgcagtggtgccatctcggctcactgcaagatccacctcccgggttcacgccattctcctgcctcagcctcccgagtagctgggactacaggcacccgccaccacacccggctactttttttgcattcttagtagagacggggtttcaccgagttacccaggatggtctcgatctcctgaccttgtgatccatccgcctcagcctcccaaagtgctgggattacaggcgtgagccaccgcgcccggcctcaagtgcttcttcttaaatcctctcaaaacctactactataattgtggtctaatttaaaatttgtttcaacaattataatggtatcatggaaagaataccgtgccaggaatgggaagacaaagattctagacttgccaatttaagatgctacgtaacttcaacaagttcctcattctatgtgaatttcagtttctccaactataaaataagaaaagttggaacagatcactcctaaattttcttctggttttaacagttataagaagagattctcttagcttaataatacctccgtgggagacaatttcattcctgcaggacacagtaatctacttggcccagtaatctacttgggtcttcagagcttttccatatcagtatcactaacacaagcataacacaccatcagtgagaaagaatgaatcagccatccaaagaaaaaaggccccaccacttttccagtcccaaaaaaatctcttaaataagataccactgctatggaaagaagataaaatttacagtaatagtgggagatttggcaagccaccccctcatctgaaatacggttaagttaaaaaaaaaaaaaatctttacctaattcataagtctacccaagatcttttctttatcctctgggagcacacaagccctgaagggaaagtagtctttacaaggactctccatggctgtttcaccttttctttgtcctcactatagtcctcaatctgcctgccactctaatccttagctctgaaatcctgtctcaggtttttctcacatttcacatacctaagtgggaccctgacacagcagcacaacccattaatttgcaagctggctacttttatctatttgtaaactcaagccacaaatatgctctctgtggcctatataacttcagactaagtctctcagctttgtgtgtgataatatgtggaactcagttaaatggagttgagaacgtttctgacagctgctgaggacaaataatttaaaatgtcttagctagttatgctttcctatgtttttctagcatgaaatagcatgtttagcttagtattcaaaaaccttttagacatattaagaggttgagtatatagatttatgcatgttatttgccactaatcaactacgaacactaaacctcagcgtgttttgggatgaggaactgagtctaatcacaggtagagtaaaatgtctttttagctatttcttatatacgttcatgactttcagtggtttggtcttgggttctgttggtttaaaactgatgcttaactcatcggagattaacctctgtaaccaaaaatgaagtcaatactttattggccggatgcagtggctcacacctgtaatcccagcactttgggaggctgaggcaggcagatcacctaaggtcgggagtttgggaccagcctggccaacatggtgaaaccctgtctccagtaaaaatacaaaaattagccaggtgtgatggcgcacacctgtaaaacctgctacttgggaggctgaggcatgagaatcgctagaatccaggaggcagaggttgcatgaggggaggtcccaccactgcactccagcctgggcaacagactgagactctgtctcaaaaaaaaaaaaaaaaaaaaattatagaaatgttatgatagggcagcactgggtttaaaaaacaaaaacttcataggctggtcacagtggctcacacccgtaatcccagcactttggaaggccgaggtgggtggatcacctgaagtcaggagttcgagaccagccaggccaacatggtgaaacccagtctctactaaaaatacaaaattagctgggcatgatggcacgcatctgtaatcccagctacttgggacgctgagacgggagaatcgcttgaacctgggaggcggaggttgcagtgagcaaattcgcaccactgcaccccaggctgggggacagcgcgactgtctcaaaaaataacaacaacaaaaaaaaactttataaataataagccaaaatcagatgtgaagagcacggcacgactatagaaaaaacactagagtaccttttaagaactggattctgttggatgggagaatgtttgagggcaaaaaataaaaacaaacaaaaaagaactggattctactccaaactctatctaccatgaagctttctaattttggccctgttttcaaacaggggcaaaaggaggggatcagcctacattagtgatttccaaatgctggtttatgaaccagtctataaggaaaaagaagattgtagtgagcttttcatacattaagtattacagtactatggtttattctgatatcatactctatcttttggctgttaaaatatcgtttcttttattaagtgattgggatttcatatggtacttaacttcatccacctccagagtttgctttccataccacctctacaacactacagaggctgaactttctctgaaccatactttattcctttaacaattaccactcataggccgggcgtggtggctcacgagatcaggagatcgagaccatcctggctaacatggtgaaaccccgtctctactaaaaatacaaaaaattagccaggcgtagtggcgggcacctgtagtcctagctactcgggaggctgaggcaggagaatggcgtggaccgggaggcagagcttgcagtgagccgagatcatgccactgcactccagcctgggcgacagagcaagactccatctcaaaaacaacaacaacaaacaaacaaacaaacaattaccactcaaagttctattcctaactctctctcaaataaattgcttccgctctaatcatacctcctggtttcaggccctgatcatccttcacaacaaccttataagcaaggtgttctctaatttatgaatgaggaaactgaaaaacaaagattaagtaaactgcccaaggttgcacagctagtaagaggcaaagctgtgatataaatccaggaaatctgtctccagagcctggctcttaactacttcactaccttacctctcacagaagagaagaagtgaaggaagaatccctttacttatttaaggcacacatgcagggagcaagttcagctttttttaacctttcacacacttagctaactcatccttcttcagcctaaacctaataaagcagaaatgctttagtagcattcattcattaaaagcaaatgttcagtgagtagatatgaagttggtagatgatttcagcccttgccctctaaaaccatatatagcctcactagtaataaaaaacgtgtaaagtaggccgggcgcggtggctcatgcctgtaatcccagcgctttgggaggccgaggcaggcggatcacttgaggtcaggagttcaagaccagaccggccaacatggtgaaaccctccctctactaaaaatacaaaaattagccgggtgtggttgtgggcgcctgtaatcccagctactcaggaggctgaggcacgagaatcacttgaacctgggaggtggaggttgcagtgagccgaaatcgcgccactgcactccagcctgggcaatagagtggaactgtctcaaaaaaaaaaaaaataaaaggtcaggcgccgtggctcacacttgcaatcctaacactttggttcgccgaggcgagtggatcacctgacgtcgggagtttgagaccagcctgatcaacatggagaaactctgtctctactaaaaacacaaaattagccgggcatggtggtgcatgcctgtaatcccagctactcgagaggctgaggcaggaaaatcgcttgaacctgggaggcagaggctgcagtgagccgagatcgcgccactgcactccagcctgggcaacaagagcaaaactccgcctcaagaaaaaaaaaagtaatttactccaaagcaatttaaaaaaaaaaaagatgacagtgtgggtaaggatacagggaaacactgatggaggaggctttaattggtacagcctatttagctggcaacttgtaggtatttattaaaattttaaatgtgcatacccatcccatgcatattatggaaaactatgtaagaatcagatcaaagtttatccacgagtataagaaatgaactctaaaacatactagattttggaatactgaaactatcaattccactttcaggcctgtatcctacacatctgctgagtatatttattgcagcaaaatatgaaaatctaaatatctatcagctaaataaatgtgatcatgcatattatggaaaactatgtaggaatcagaaagatcagggtttatccacaagtacaaagaatgaactctaagacatattaagtgaaaacagcaggctaggccggatgcagtggcttacgcttataatcccagcactttgggaggccgaggcgggtggatcacctgagtttgggagttcgagaccaacctgaccaacatggagaaaccctgtctctactaaaaacacaaatattagctgggcgtggtggcgcatgcctgtaatcccagttactcaggaggctgaggcaggagaatcactcgaacccaggaggtagaggttgaggtgagccaagatggcgccactgcactccagcctgggcaacaagagtgaaactacgtctcaaaaaaaaaaaaaaaaagaagaagaaaacagtaagctatagaatacatacagcatgatctcatgtatgtatatatacacatacaaaatgtactaaagatttgtacatttcattgtatgtaaaatttgcattgaaagaaaaatgtgcctgggcacagtgattcatgcctgtaatcccaacactttgggaagctgaggctcaaggatggcttgagcccaggagctggagaccagcctgggcaacaatgggatgaccctgtctctacaaaataaagaaacaattagctggaagtggtggcgcacaactatggtactagctactccagtgactgaagtggaaggatctcttgacctcagaagttgaggctgcaaggttgtagtgagcagtgataacgtcactgcactccggcctgggcaacagagtgagactctgtctcaaaaaaaaaacaaaaaaaacaaaaaagaaaaagacaaagaaaaaacatgctagccacgcacaatggctcacaaagtgcctgtaatcccagcactttgggaggccgaggcaggcggacctcttgagcacaggagttcaagaccagcctgggcaacatggcgagactccatctctacaaaaaatacaaaattagccatgcatggtggcatgtacctgtaatcccagctatttaggaggctgacgtgggaggatcatgtgagtccaggagacagaggctgaggtgagctgagatctcgctactgcactcgagcctggacaaaaaagaaaaatgctataaacaatattaaactctagataatgataaacatgctcaagtgcttagatgaagtatactaatgtctgcaatttattttgaaatacatcaaaaaatcagattcattgatggagcgatggatagatggacaggcatatgttaaacctagtagtagaaaaatgataatggtaaaatctaggtagtgtgtatatgggtgttcattatatttactaaaattctatcaactttgttgtgtatttggaaattttcttgataaagtcttggaaaaaaacatccacaggttctgaggattaggaaaaaaaaaaacaggaagaaaagccaacaatacaaaccagctcttgagtggaaaaaataagtactataaattgggaaagggatacagacaggtacacttgggaagactctataaaggtaaatattcagctacatcttgaaaattagagatgaattagaacacaggggtatagagcatgaaattaaaatagtaagtttagacttgcaggcaatagttatttacaatctttgccaagtcattcatcccacaaataattagcaagtgcttaagacatgcctggccctgtgcggagggttagaagtccagcactgagccagagatttcctccccgacaacagccaagtcttccatgtatgactgctatcagctgatgtcctcctcgcaacaatcctgtcagataggcagtcccagaaccctttttttttttttgcaatagcataccattatgtccaccaggctggagtgcagcagggctatcacggctcaccgcatccccaacctcctgggctcaagtaatcctcccacctcagcctcccaagtagctgggacataggcagcgccaccatatctaacttttgtattttttgtagagacagggtctcgatatgctgcccaggctggtctccaactcctggcctcaaacaatcctcctgtcttggcctcccaaagtgctgagattataggcatgagccactgcgcccagccagacccctctttttttgagggaaactgatactcaaattaaatgacttattcaaggtcacatacctgactaaaagagcaagaggttaaattcttcctccttggaatatgaacaatctaaagtagaaacattggacaagactgtaaaaccacgcttgcagaggggtacagtgtaattctagaatataaagaaagccaaacgatggaaccacaaagtcagccacaaaagtactgtcaagtcccgcttcagccaacatggttgatctccatctgtttcaaatttggagtttatagtactatcagaactctagtctaggaagacattataaaaagaaaaaaaaagcactttgacgtatagaaactatggagagaagactaaataatggcagcagaacatttaaaggtcacctggtgggcacagtggcttgcacctgtaattccagcactctgggtgactgaggaggaaggatcatttgaggccaggaggtggaggttagattaagcaagattgcaccactgcactccagcctgagcgacagaggaagatcccaaatacacacacacaaaaaaaacacctacaggtcctaaaagtcacctggccatgtgttataataaaactgggcgcggtggttcacacctgtaatcctagcactgtgggaggctgaggcaggcggatcacttgaggtcaggagttcaaaaccagcctggccaacatggcgaaactctgtctttactaaagcacgaaaaacaaattagccgggtgtggttgtgggtgcctgtaatcccagctactcaggaagctgagacacaagaatcgcttgaacccagggtgcggagggtgcagtgagctgagatcgcgccaccgcattccagcctggttgacagaacaaggctctccgtctcaaaaaacaaaacaaacaaaaaaaaaacgggtgggatgctgggtgtagcagctcacatttgtaatcctagcactttgggaggccgtggtgggaggattgcttgaggccaggagtttgagatgagcctgggcaacaaagtgagacaccgtctctacaaaaaaattttattaaaaattagctgggcatggtagtgagcacctgtagtccttgctgcttaggaggctgaggtgggaggatcatttgagcctgggaggttgaggctacagtgagctgtgattatgccactgcactccagcatgggtgatggaataagaccctgtctcaaaaaaacaaaagtctatcctggtcagtttgtttaaatgcatactcttagaacaaaaaataaaataaataaatgcatactcttttttgcttatttttaaatgcatattcttgaaacaatggaaagtttctcttcaaaagcaaacttccatcgcagtattaagtcaatgtaaacttcaacccagtgcaattttgagtagtctaattcaaaatttgtccaaaagtccacctctggttttaaatctgctaagaaagaatctattacagaatgaaaggcactctatttagatttcatatattgattagaattattgcttggaaaaattaacaaccagctcttctcaaaagacaccattagatctaatatccaagcctcctttgaactcagtttttatattcttctaatgcagtggtcctcaactaggggagattctgcctcccaagggcacatgtagtaatgatggaagacatttttggttgtcacaactcgggaagatggaatgctactgatatctcacagatagagtaaaaggatgttgtcaaacatcctacaatgcacacgacagtctcctcacaacaaattatttggcccaaaatgtcaacagtgtgtgaagactgagaaacctaagtttaatcataaccccaactgtcacatatcttttttttttttttgagacagagtcttgctctgtcacccaggctggagcgcagtggcgtgatcttggctcactgcaagctccgcctcccaggttcatgccattcttcggcctcagcctcccaagtaactgggactacaggcgcctgccaccacgcctggctaattttttttttgtattttttagtagagatggggtttcactgtgttagccaggatggtctcgatctcctgacctcgtgatccgcccacctcagcctcccaaagtgctgggattacaggcgtgagccaccgcacccggccatcaatgcttcttttacggcatatgatacacctttaacccgcattataccattacgcattggccagacactctgacctaaagttttttagaactcttatctttttttacgcctggtctcctttcgtccctctcttaggcttgatctgtaaaactcttctgactcaaaattttagagcttttctgataccataatgctcattaaatctgtaaaaattaaaaataacgccaagtgtggtggctcacgcctgtaatctcagcactttgggaggctgaggcgggcggatcacctgaggtcaggagttcaagaccagcctggtcaacatggtgaaaccccgtctctactaaaaacacaaaaattagctgggcgtggtagcgggcgcctgtaatcccagcaactttggaggctgaggcaggagaattgcttgaacctgggaggcggaggttgcagtgagccaagatcacgccaatgcactccagcctgggcaacagagcgagactccctctcaaaaataaataaataaataaataactttaaaaaaaccccatatcgttattacttactattttaacaagaatgtaagtagcaaatttgtttttttttttgagacacagtcttactttgtcacccaggctggagtgcagtggtgcaatctcaactcactgcaacctctgcctcccaggttcaagcaattcctgtgcctcagcctcccaaagcagctggaattacaggtgtgtgccactacacctggctaatttttgtatttttagtagaaaaggggttttgccatgttggccaggctgttctcaaactcctgacctcaagtgatctgcccgcttcagccacccaaagtgctgggattacaggtgtgagccaccatgcccagccttaagtagcaaatctaaatttttattccgtactttcctggacactgggagatataaatatccaaaatgtgcaacatcctttaaaatgcaaccaagtactcatcaaatgtcatgcatgaacttggaacacagccattctataaattttttgtttcttttaagaaacaaggggtcgggcgcggtggctcatgcctgtaatcccagcactttggaaggccaaggcaggcggattacgaggtcaggagatcgagaccatcctggctaacaaggtgaagccccgtctttaccaaaaatacaaaaaattagccaggcgtggtggcaggcgcctgtagtcccagctgctcgggaggctgaggcaggagaatggcgtgaacctggaaggcagagcttgcagtgagctgagatcgcgccactgcactccagcctgggtgacagagcgaagactctgtctcaaaaaaaaaaaaaaaaaaaagaacaagaaaaagaaacagggttggccaggtgcagtggctcacgcctgtaatctcagtactttgggaggccaagtcgggtagatcacgtgaggtgaggagctcaagaccagcctagccaacatggtgaaaccccatctctactaaaaatacaaaaaaattagccgggcatggtggcgtgtgcctataatcccagctactcaggaagctgagtcagtagaattgcttgaacttgggaggtggaggttgaccgagatctcgccactacactccagcgtgggcaacagagccagactccgtctcaaaaaaacaaaaaacaaaataaaaaaaaaacagggtcttgctctattgcccaggctagagtacagtggcatgatcatagctcattacagactgctgggctcaaacaatcctcccacctcagcttcctaagtagctgggactacagagtggctaataagaaaaaaattttttttagagacagggtctccctacattgcacaggccggtcttgaactcctggccacaagcgatcctcctgcctcagcctcccgagtagctggtgtataccactacacttggcttccactctgtaaacaggtacacaccaccacgcttggcttccattttgtaaattttgattccaggtttcaggtacagctctagtaaggttctagcttatcacctctgggtctttttttccctttctgcccatcaaatgaaatactttgaaaactcacttcataattttgttggagagaacagtcatcttctttgctccataatcataagcattctcatttttagactaataaatgtcaatcagaatgaacaatccaggctgagcgtgtggctcttgcctctaatcccagcactctcagaggccgaggcgggtggatcacgaggtcaggagattgagaccatcctggctaaaacggtgaaaccccatctgtaccaaaactacaaaaaattagctgggtgcagtggcacgcacccgtagtcccagctactcgggaggctgaggcaggagaatcgcttgaacccaggaggcagaggttgcagtgagcaaagaccatgccactgcactccagcctgggtaacaagagtgagactctgtctcaaaaaaaaaaaaaaaaaaaaaaaaaaaaaaaaactgattttttttttcatttttacataatttttccttctaaccatctttatacatatacgtaactttggcacctgtccacttacaaactgcatcaactaagttttggtgtacaaatatcttgaaagatgaaagaatactatcatacatctttttggcaaagtgcagtggttttgattgtttttttttttcatttcttaaaaatagaaatggggtctcactatgttgcccaggctggtctcgaacgtctgggctcaagcgatcctcccacctcagcctcccaagaaggtgggattgcaggcatatgccactgcacccagcccagttctgattcttataaaaagaaaatcacattctagctggatgcctatagtgccagttacttgggggaactgaagcaggagaacagcttgagctcaggaatttaaatccagcctgggcaacatagtgagatagatcccatctttaaaaaaaaaaaaaaaaaaaaaaaaattcaccgctgggcatggtggctcacgactgtaatcccagcactttgggaggccaaggcaggtggatcacctgaggttgggagttcaagaccagcctgaccaacatggagaaaccccatcttttactaaaaatacaaaaaattagccaggcatggtggtacatgcctgtaatcccagctacttgggaggctaaggcaggagaatcccttgaacccaggaggcggaggttgcggtgagccgagattgtgccatggcactctagcctgggcaataagagcaaaactctgtctcaaaaaaaaaaaaaaaaaaaaaatcacattctaaactcatctagggtacagtcacatatgtatatgggtggagacagaatcttgctatgttgcccagcctggttttgaagtactgggctcaagtgatcctcccatctcagcctcccgagatgctaggattacaggtgcacgccaccatgcctggctgaagactcttattttacaacttggtttatataactttaccgtcatcctaacagtctagagtactactgtcacacagcattcatctactagttcctctgaaatgtcttctgtagtcagttttcttctctttgccattataggaggaagatgaaaaactatggatttttaaatatgtccaatgaaagcttaaaagttgaaaaatagtataaaaattaccatgtactccttcacctagattctccaaatgttaacatcttacataatgtttaagatggtatctcccaacttcttttatactttcttgaaagatgctgtaggctgggcatgctggctcatgcctggaatcccagcactttgggaggctaaggtgggtggattgtttgagcccaggagttcgagactagcctagacaacatggcgaaacgttctctctacaaaaaaaatacaaaaattagccaggtgtggtggcacatgcctgtagtcccagctacttggagggctgaggtgagattgcttgagtctgggaggcgaaggttgcagtgaactgagattgcgccactgcactccagcctgggtgacagagtgagaccctgtatccaaaaagaaaaaaaaagttgctgtaagttttgggaaaagcaataagaaaactgaagggctgcggtgcacacctatagtcccagctaccgaggatgcttaggagggatgatcacttgagcccagaagtttgaggctgcagagagctatgatcataccactgcccttcggcctgggcaacaaagcgaggccccatctctaaaaactgaagtgtaaaactaatgatttatttcactactgcatatccttttaagcaattctataattctccctttgtcatattattttagtcctctttagcatatttgagaattgatgagtaatgatgaaataattcctaggatgatgaaataccaaaacatttcaatatacaggaaaaataagatcagtaaaactccacaacattgtttcgatgtacaagtggtaatagctaaaatgagtttattcctttggaaaaaaaataaattttcaggctgggcatggtgactcatgcctgtaatcgcagcacttcgagagataagaagtttgaggccagcctggccaatatggtgaaaccccatttctactaaaaatacaaaaattagctgggtatggtggtacacacctgtaatcccagctactcgggaggttgaggcaggagaaccagttgaacccaggaggcggaggttgcagtgagccaagatcgcgctactgcactccagcctggggatggaacaagaccgcatctcaaaaataaaattaaaaataaaaataaattttctctttgctgttttgaagacctccaataaataaaagtcatgaaatatacatctttacaagtagttagtactgctttaaaaaaaaaaagcaaaactcaaaaactaaaattgagtccagaccaggtgcagtggctcaggcctgtaatcccagcactttgggaggccgaggtgggcagactgcttgagcccaggagtttgagaccaatctgggcaatacagacttcggtgacactgatgttacccagacatttcttactactgtaggtagaaaatgaacagaaatttagttaaattcaaaatgtattaataattgttatcaatgttgattttctgatttgatcactgtattgtggttttaaaagatgcacttggggaatctaggtgaagattatagggctattatttgtattatttttgcaactctctttgaagtctaaaattatttccaaagaaaaagttttttaaaaattaagtattaggccaggcatggtggctaacacctgtaatctcagcactttgggtgtctgaggcaggtggattgcttgagtccaggaagaccagcctgagcaacatggtaagaccctatctctatttaatataagaaatataatctttcaaaatatctataaggccaggtgcagtggctcatgcctgtaatcccagcacttcgggaggccaaggcaggtggattgcctgaggccaggagttcaagacaaggctggtcaacgtggtaaaaccctgtctctactaaaaatacaaaaaattagccaggcatggtggtggcgcctgtgatcccagctactcaggaggctgagacaggagaactgcttgaacctgggaaggggagattgcagtgagctgagatcgcgctactgtactccagcctgggcgacagagcgagacactgtctcaaaaaaaaaaaaaaaaaaaaaaaaattagccaggcatggtggtgggtgcctgtaatcccagctactcgggaggctaaggcagaagaatcacttgaacccaggaggtggaggttgcagtgagctgagattgtgccaagccgagattgcaccactgcactccagcctgggagacagagcaaaactccgtctcaaaataaataaataaataaataaatagctgggtgtagtggcgcatgcctgtaatcccagctgctcgggaggctgaggcaggagaatcacttgaagctgggtgtgtgtatgtgtgtgtgtgcaatgagccgagatagtaccactgcactctagcctgggcaacacagtgagaccttgtctcaaaaaaaagaaaaaaaaaaaaaaaaaagaaagaaagaaaagaaaatagagcattacaaagaatagaacttgagatagttcttgaaaggacaggtggaagtgtcactcacatctcacactgcttttatcacattagctcttctgctcccacacaaacatgggcacataacatctttaaccatctatgtatcctctaccatgctcagcatactgctttgtcttgtctgtggtggaaaccaaatcattcattcatgtatacattctctaatatctactgagcacatactatgcaccaggtgttttaggagctggagatacaacggtaaacaaaaatctcttccctcaagaagcttatattttagtgaaagatgacacaatagacaaagtataatatttagaatagtaggcagtgacaggtatcaagaacaaaaggcaaggaagagtttttgaaattgtagataagaatggtcagataatacctactgataaggtaacttctgagtaaaggaagtgagggagctagtcatgcagaaattagtggaggaagccttctaggcagaggggacagcaaccgcaaagaccctcatgtctttgtgagggctcacatgtgcttgacatgttccaaaacagcatgaaggctgggtagctgaagaaaaacgaaagaaggactagtcagaaatgtagtcagagaggtactaggataagggtggcaggcagagggtacatcagatttgttcttacaggtgtttttttattttttgacacagggtctcattttgtcgtcaaggctggggtgcagtggcacagtcatggctcactgcagcctcaagctcctgagctcaagcaatcctcctgcctcagcctctcaagtaactgggactacaggcacgcgccagcatgcttggctaatttttaatttttttatagagacagggtcttgttatgatgcccaagctggtctcaaactcctggactcaaacgatcctcccacttgagctcccaaaatggtgaaattacagacatatccttttttttttcttttgagacagtctcgctctgtcgcccaggctagagtgcagtggcacgatcttggctcactgcaagctccacctcccgggttcacaccattctcctgcctcaacctcccgagtagctgggactacaggtgcgtgtgccaccatgcccggctaactcttttgtattttttttagtggagaccatgttagccaggatggtctcaatctcctgacctcgtgatccgcctgcctcagcctcccaaagtgctggtattacaggcatgggccaccgcgcccagctcattacagacatatctaaataaggactcaggtttaatactcagactgaaatggaaagccactggatggttttaagcagagaagtgacacggtatgacttaggtttcaaaagaatcacttgggttgctatgttgagaacacatttaagagccgcagtaacaaaacaaggagaatagaatccaagctagagatgcacaggcactgactagggcagtggagatgcagatcctaagtggtctaattctggatagtattttgaatataaagcagtaaaatttactgatggaccacatatgaaaaagacacagaagagtcaacaatgtctcttagttatccaagaggagacatcgagtggagaccttgagtgggccactaaacatattagtctatggtagagggagagatccccgttagagtcatcagcattgtttggattttagaaaggtaatatggtacatatactgtatcatctctctctcccagctagggctgagtagctccccataatcaagcagtcacatttctgcatcatgcaggatagcccaggtcaggctgtaccccaaaactagttgtggaactagacttaccaaaaaacaaaaactcttgcatttcagaactgcaaataaaggatgtggacctgcatatcctccaatagcccatatgtcagcaagcctagccctggaggacaccaagaagactcatgaagggtccactgtcatgctgagaaatatgggtaacatacaagcatacaagacaaaaagtgggtagggaaaacaaaagcaaaaggggcaaataagaaatacatcaggtagaaattgccacccatgaccgggcacggtgactcacgtcttaatcctagcacttttgagaggctgaggcagaaggacctcttgagcccaggagttcgagaccagcctgggcaacacagcaggacttcacctctataaaaatataaaaaaaattagccaggtgcgtggtggcacacacctgtagtcccagctacatgggaggctaaggtaggagggtcgcttaagtccagaagatcaacactgcagtgagctgtgatcatgccactgcactccagcctggtgacagagcgagacttcgtctaaaaaaaaaaaaaaaaagacatgagaaaaaaagacattatgcggccgggtgcagtggatcatgcctgtaatcccagtactttgggaggctgaggcgggcggatcacgaggtcaggagtctgcgaccaacctgatcaacatggtgaaaccctgcctctaccaaaagtacaaaacttagccaggcgtgtggtggcgccccagcttcttcttcgtggaggctgaggcaggacaatcgctagaacccgggaggcggaagttgcagtgagctgagattgcaccactgcactccagcctgggagacagagcaggactccatctcaaaaaaaaaaaaaagtctagtgcctaacacagtatctgtgacacagtaagtgctcaataaatatcagcttttatttttcaaggggcgaggaaggtgtattttgaaaaagcatatactatttatttttttaaaggcctacagaaagtaaagcttaacaaactcttggctggtggattgcccagaaaagagagaaagccatgaaaagcactatgctaaactactgaatgccagggatataacctcttaattccagttaaaattcccaggtactaacatctgccatgcacagctctccagtgtcttgtctgctcccactgaagatgtaaaaagaattatacttcaccaggaatcttgtcaaattactacacacctccttccttaaaaaagaaaaaaagtctttctctgtatgtaaattattaaaaccctcttaattacgaagtgccaatctttctaagctatttatctctgaacaaaattatagtatataaaataattatctggagattatgaagcatttatgaaaatgttcctaatacagcaaaaccaggttcttacttgaatccttatagactcttctgtgttccccagtatacagcactgcaaatcatgggaactatatatgtagcccaaattttcctcaatggtcaatcgttctccactatctctctcagtttatggcatcagaaaaaaccacctggattttttgtctccccaccaattctattacagccatcatttgctaaactaaaatgctattgcttttgcaacttccttagcagagaaggtaggacccacctacccttttcacataaatatagcacagggtaccactcaggccctactaaccaaagcacaaatctagaatttcacttcagataattaaccagaggctcatttagacattactgcataaataaacattggttccatgtttatttttctcatgaaaaatgtgaaaaacattgaaataatttctctcaataggaaaagataatgtatcaagtgaaagcaaaaacctcatctaatgtggttctgctatctaaatctgaaatgccctaaggcaactctccaatacaggctggagggcaacgctacagaagtcacatacagaaggctaccctgatccacaattccaccctcctctgaaataaaaagggcaacaacactgtactatgtagagtataaatagaaagtggtctagatggtctaacataagtacataaaataaaaaagaaaagacttttcacctatagttacctaaatagcaaattctttaggaaaccaagtttttttggttgttttttgaggcggagttttgctcctgtcgcccaggctacagtgcaatggcaccatctcggctcactgcaccctcgcctcccgggttcaagtgattctcctgcctcagcctccccagtagctgggattacaggcgcttgccaccacgcccagcttttttttgtatttttagtagaaacagggtttcgccatgtaagcctggctggtctcgaactcctgacctcaagtgatccacctgcctcggcctcccaaagtgctaggattacaggcatgagccaccgcgcccgtccaggaaactaagtttatatagcagaaccatgtgcacaatgaaagcattcaaaaatacaactgtcagagatatcggagtattttattcaaagtctgagttcttaaaaaaaaaaaacaaaccctactttataaacagaccagttttgagattaaaatgtaaatccaaactttcctgttataaatctcagccttgtaaagaggaggagcttccactgccttttcaaggctaacttcgtttaaagtcctaacgcaccgaaacagacgccaagtctactacccaccacccattggctcaaaggaagccccgccccgtacagccacggtaactgaacatcaagggaaccccagggaaggttttccctccgccacatttctagtctctgatgactccctgcccctcccctaccatcaccaccgcggatctagggttccagcaccagccacgcacgctcctacaagaggaccttgggcacttcgccccaatagttacaaccaagaggggagtgggggtgaccatgctcccactctcctggctgcacggtgccagacacgctgcatggagcaaagcggagaaagcagctccggcacagggcccttgtgcccccaggcagaaggcatgacccagccacaagagtaagtcctgacacctccacagctcccagtcggcgggtgcccctccctccccacggagacatagggcggggcagatctaggcgccgagactcccagccagacccgacagcgggctttccctagcacctcctcattgccaaggaggcggaaacccggggcctgggcggggtgcagggggggacggccaaggggagtggcatcacggatcagtacggcccctccggccaaccggatcccaagaaggcggaggaactcagacttcacgccccctccctgccgcgccctgaatctacacgcgggagacccccccctacccctccccgaccccagcaggccagagcgcggccgccagcccgaggccccgcccaccccaggaggaggggagggggtggtcggccgcaaactgcactcagcgcgaagccggccccgcccctttctccacaatcgcacgcgcgcgccggccccgcctctgagcggcggcgcgagagcccgcccccctccgcgcgcaccgggactacgctctcctccccctcccgcgcggagagctaccccgctccgccccccacccccctcacacaaccacacacctcccgcccgtctgctctacgggaagccgaggaggtcagccccccccccccaaaatacacaccctcgagtccggcgttacccgccaccaggctcccgcccggcccccggcccagcgtgctctcaccgcaaagctgcttcggccgctcgtcactgcgtgtccctctcagcgtgagccgcgagctcagcagggaggccccgagaacggcgcggggcacaggcccgccgaagcggactgccagctacctctccactaacgaagcggtcacaggctccggtgcccagactgggaaggagggagggagggagggagggaaactccgaggggggaaggggaggggggaagatggagaaaccgtctccgccgcctctaccgccgcggccgcttctctgttacccgggaaatcccgcccactcccccgaccccgccccgcagagggaagactcagcttcgttccaatacaggacgcaatacccgcccgtcaaagactcagccaaccaccgaggcctgtcttatgattttcccgccccttccccctcgactggtaggggagggggagccgctctccttctccacgcccctattggcggggagcttccctaactcaaccccgcctattggagacggactgctgaagcccacccccgagccccaacactattggaggaagcagggaagctcttcctgtctcattggaggacaccacataacccgccctgcagcgtctcagccacaggcctaacaagttggctcccgcctccgctggtcatcgcattggaaggctacccctggctctcccaccgccccagtaaggtaagtaaccgatgtggggtaaaatgtctgtaagtgaaacaggctccgcctaccgcactgccgggccaggccccgccccaagagtcggattggatatcttggcgctggtaggaccctccattggccagggcgcccgtctaggaaggagctaattccaccctgcgcgaggaggctgaaccttagcagtccttttgtggaatgtttacactagagactgaagctcggagttccagggcccgagataggagggggagcggagctcatcagcggagactccacatcctaggatttgaaggaaaggcagcccaccatggaggactccctcacaaaaaaaatgagagaatgagaactcatccttccgtccagttatctttacagtttacattctacacactgcgtccttgtaaacacaaatatccggagcagctggcaactcctttcagccaagtagagtacagaactaaggtctggagacctaggcggagaagtaaactccctagagctgaatatgcagtcctaagagggcggagataaccaaaagagaggcgggctctaacagccaccgccctggcaagcctccggaaggcggagcgtgaggcacaaggtactcacgatctcccgggtggatctggaggcatcctcagaactgagaaaggagaggaaaacaccaaaacaggccacggcataaattaacattggggacatgccacactcagagaatggataaaatttccgtagttggggacataagataacggctgttcaccttctccttggccgggagtgttaatagcagttcctgtgccctctctgtgtaggtaacagtgcctcgaacacacagtgagacaaagtgctttcaattcctagtttgcttttatttattcaccaaatagggcgtgggcctgacgctgatcttactttggggggcgctctctcagcgccaggagaggtgacgggattacgttgttaccgctctcccgaataagtagaaccctcctcccagagagctaagaccccaagggacacgcccagggaacccacgcctaggtccaacactgtcctccctctgcaatccagcggaaacggccaggaacgagctctggcagcaggtgggcctgactccagcgatggcttcgagccgcgaaaccacagcagcgaattgtgaactccaagggtagccgacaggtgggagcagcctcgccagtagccaagccctgccccaggacagagctctaaaaataagtcagaccaacgaagcgaccccagggccaaactgctcggaggttaggaggaagcggcactccagcagaactgacccacggctacttttaactttgcgccgccttccaccactagactgagtaccacagggcattcccaccatggtatcaagaactactcagaacccaagccagcattaggccgcccacgacttcccgtgaacacagggtaccacctgcgctaagatctcgcctaagggccccaggccagggcactaggttgtcagagtctcagatacagccaactaaggacagccgctgccatgcctaggaaagaacagacacttgcagcgtctgcagagttctcgagcttaagctcagggaagtcaaggggcacggaaatagccaagcgacagggttagaactttagtacttggccccggccccgaaaggcagatctcaaacccagcagaacctccggagtttcgctcccgaaatccactccgcactgtaatcccctggcttcaccccgaaggctactaggtctcgagcctcggtggaacctttgtgtggcttctcggctctccccgcccccctcgccaagggcgccgagcctaggacttccgggcgggagggcagttcgaaggagctaggcgggcctcacacatgtgcggagcgcgctcaagagcggagggaggcggggagcaagggtggacttcccctcccagctctctccgccggaggaggccgggctacccgccccaccaatcagaggcgggggcgggaccttgcgcctcacgtcatccgcaagaaccgtccctcctccctccgcgaaaaaaaaatcctagcaacttaaactccagcccggcctcccgataggcggagctcgggagaatgtcatccaatccacatccaagaaggagaaaaaaagggagtctcgcctagccagtggaagacaagagaaggcggggcctccgggagagccggaggtgggtgggagagaggaaaggggtccgcccctcagctcccctgcaggcgggttgcacaagccgccggcggagtagatagtaaacagtctgggccgaggagtgcaggcaagggccgcccggcgctcggtggactgggcccctgcgccgcctctcccggcgtcgccccgcccggccgggacggttcccgccggcgccccgcctacccgcccgcggccgccatcccggctgacaggcgcgccccccgcgcccctccccgcccgctgatgcatttccttttcccgattccgagcgtggagactgttttcccagtttccgaccttcactgcccctttcaggccaccccctcgtgggcgcgcacacgcccgcgcccccgcccccgccccatccgcgccgagcggtccgcagcagcacctcgcgggaagggggagcccggcggcggcacggtcgggggaggggaagagagcagcagtcgccgccgccgccttggggtgggcggggaagcaggcagctccatgtttgcaaggggatcagccggggccgcggacgaagccgccgagtttctgggggttttccgcaccaccgatgcgagctccttgctgggtcgcggcctgacgggttccggcaccgaatgctgactcgaccgccacggccagggagtttggagacccggcagctcgcagggctagcggcgaggcgcaggggctctttccggtggcctctcccgcccccggccgcccctcccgcaagtccggtgttgcccccgcccccagagtccataacaaccgcgggcccacagtgcccgcgcctctccggagcgcgcccaccgccccctccaagtttgcgggcaaaaacaaaaccctcggggcggctgccgcccttgtccagcgtgggtagccagggaagccgcgggccccggctcgctcgctaactccagctctcgagcaactccgagcgccgcgagctcagtgggccccgccgaccatgctcgagccgccgccccctgccgagcccgcacgccgcagctccggcccggttctagtcggtgtgcggaatcccccttttctttccagtatttttctttttaaaaaaacggcacaacaggagtcgggggtctcctgcccgccccttctccagtccgccgccaaaacctaccgaaaccgactgctcggtgagataaactaggctacacggccggcgcagggacgaccccaggccaggcccacccctctcccacggctccggccaggctgggaaacacacacactggcgagcgggcggcgccaagagctctccttcctggcctgtccctcgcctacctcggccgcggaactccgagcctcccctcagctcggtcccagggcccgcagggcccacaccacgtcgggccggccagaccgagcggccggcggactagccccccaaacgcctgagattggggggaccaaattaaaagcagctgtttaacataccttccgagccaggcgaggagtcctgaatgggggggaacgccccccacgggctattggctccccggcgctcacgtcagtcaccctgggcccgcctccgcccttcgccccgcctcttccccttcattgaacgccccctccttccaaaaaatataaattaattaattaaactaaacgcgagtgggagacgcatccgtggtagaggcccatatagctccctcgccgccgactcgagtttcttgaggtcctcggactggggggaggccgcctgggactcggagatccgctgggtggacgcggaggacgagccagcggagctacccggccccaacttccttcacacacacaacccatttggaactaggtaggagagaagggtaggagcaccctagtcactggctggagtgggcagactcctgtggctgtgtgacctaaccgtgttcggtccgctctgttaggcgactaaaaatgagtgatgcaaacaggaagccctgcgtccgcgggcaacaggcacttgcctgagcacctactgtgggtgaggcagacattcatacgtacctgctgctgggtgcaattacagactggatgacatgcttactctacccctccaagggctccagattcagccgaggagattctacgtaaggaactaaggcaaggcaggaatgtgtatgaaaataggaatgtgtatgtaaataggagctcagagaagagagattccttttcgctgaaggagaattgggaaaggtttcatgaaggaggtggcattcaagttgggtcttaaagatttcatccagcaaattggaggggcaggtcattttcatcaaaggacacaaaggggtgaatgcaaaaaaggaccttcatatgtggctgtagtaataaaaaaggaggggtggggagatggaacaaacagtttaagacttttagttgagtaaaattcttggacgtgcgcagcagaatgtgcaggcagcacggtcacaaggcccacagacccagaactatagtgtaagatgtttggcaccctggcagaaagatgggttctgacgatgcactgagagagaagtgcctataggcagcaaggggaggcccagaggctgttgtaatactgcgtttggagactgcagaagtgcctcttgtggaaggaatagctggggaaagagaaggcttcttttctctatcaaagccacccaatccgaaagctttccccaccttcagcagccctcaagtcaaagctttgactcagatccttccttgcctcatttgctttatttatcataacttctaaccaaaaggagtttctaggggacagaagccaccccacatgtctgtattccagagagctgagcctagagccagagcacacaatgtgaaacaaacaaaaaaacctgtttgttgaggcattgaggaaaggaagttaatgtggataaggtggggtgtgcagaatgtgaaggaccttggcatccaatgggcagaatgagggcctgctgccagttaggaaattattgggaagtctttcccaataattcaggagacacgaaaggaggattgaccagaacagtgacagtgggtgaaaagaattttatttttttttgagacaaagtctcactctctcacccaggctggagtgcaatagcatggtctcggctgactgcaacctccgcctcccaggttcaagcgattctcccgcctcagcctcccgagtagctgggactacaggctacaggcgtgtgccaccacacccggctaatttttgtatttttagtacagatggggtttcactatgttggccaggttggtctccaactcctgaccttgtgatccacccgcctctgcctcccaaagtgctgagattataggcgtgagccaccgcgcccagccggtgagaagaatattgaaggagagcctgtatttgagaaagactcaaggggagtaggtgagtgattcagtgtgggtagtagagggaaagaagtagcctgtggcctgctgtgtgaagagttgatagagcttgaggctactagttaggtaatctgagttctgcacttagcatggtcagcaactggtgttatagtcttaggcaagtctcttcctccctctgagcctcagtttccctgtgaaatggggttggaaattggaatagaaagatagactcggctggacgtggtggctcacacctgtaatcccagcactttgggaggccaaggtgggcggatcacaaggttaggagatcaagaccatcctggctaacacagtgaaaccctgtctctactaaaaaatacaaaaaattagccaggcgtggtggtgggcgcctgtagtcccagctacttgggaggctgaggcaggagaatagcgtgaacttgggaggcggagcttgcagtgagccaagatcacgccactgcactccagcctgggcgtcagagacagactccgtctcaaaaaaaaaaaaaagaaaaagaaaaaagaaaaaaagatagactctaaggacctcacataggatccaggtgggggaagcttaccactgaggagacagggtaggtgggaagaactactgattttggaagggcagtgggtcaccccaactggagtctggagactggaaaataggcagtagctcagtcaattgaatcactgggtgaaaagtatggagagggaaaggccaggagataaggactatgtgttcagcaggaggcccaccctggcagagccatggagtttgaggttcatcctccctagggtgaggaccaagtttttcttcagaacagagatcccagctgggcaacagagcaagaccctgtctctacaaaatatttaaaaattagctgtgcgtgggctgggcgctgtggctcgtgcctgtaatcccaagactttgggaggccaatcacctgaggtcaggatcacctgaaggcggatcacctgaggccaggagttcgagactagcctggccaacatgaagaaaccccatctctactaaaaatacaaaaaaattagcagggcatggtggtgggcacctgtaatcccagctactcgggaggctgaggcaggagaatcacttgaacccaggaggtggaggttgtagtgagctgagattgcaccactgcactccagcctgggcgataagagtgaaactccatctcaaaaaaaaaaaattagctgtgtgtggttgcatgtgcctacagtccgagctactcgggaggctgaggcaggagaatcgcttgatcctgggaggtggaggttgcagtgaaccgagatcacatcactgcactccagcctgggtgacaagagcaaaactttgtctcaaaaaaaaaaaaaaattagctgtccatggtggcaacatgcctacagtcccagctagttgggaggctgaggcaggagaattgtttgaacctgggaggcggaggttgcagtgagcctagatcgcgccacttcactccagcctgggcagaagagtgaaactctttgagagttttttttgagacagagtctcaaaaagaacccagtcgggtgcagtgcctcacacctgtaatcctagtactttgggaggcccaggtggttggatcacctgaggtcaggagtccaagaccagcctggctaacatggcaaaaccccgtctctactaaaaatagaaaaattagctgggcgtggtagtgggcgcctataatcccagctactcaggaggctgaggcaggagaatcacttgaacccgggaggcagaagttgcaatgagccgagatcatgccatctcactccagcctgggtggggaagagtgaaactccatctcaaagaaaaaaaaaaaaaaaaagaaccaatcccctgatggctggatccccatctcaaattcctgctctatttcttaatttcttaaggggctctagctgaaggcataacagatactgtgtcaaagtgagatgaggcagattggtggagcagaaagaactagtctggaagttgagtcccctggttcccacttagtcccttcttatctgtggatcagcttcctctcctatataagaggataacatagcaatccttgccctgttatgaggatcaaatgtgatgataaagtgtgctttatcacctggtaaggttctgagctgctgtggaagccaaagacccagcatttgacagtgatactaggcagcacgtgttgtgctgtggatgcagttactcatggaggatttgcaactgcaacagttacctccactcagagaaccaggctttgctgacactgcccatggtcctatgtgtgccaccctggtggagacctcctcctgaacacttggcagactgagtttcttgaggacagacacttcgatgcacctctgagtccccagagctcactgcagtcagatacagggggccctttggaaggggtccagtgatggtttctcactcagtatgttgacacctggacagcacggcaagtcccacattctttgggaaagagaacgcttgatttggtgacattgtccctccagctgccagctgcactgagggattacatccatgctactcccctgactaccctatcagtgaagacaaaactaagtggactttgtgaaccaactggtataggtaaaaataataataatgataataattaaaataaaattaagtggatttgggtaagggccctcctaggagaaatcacactggtaggtcaggttctgattcctggaggcccgttttatgtgaaaagtctcatagaccagcctgggcaacacagtgagactgtctctacaaaaaataaaaacaaatttagttgggcatggtggcatgtccctgtggtcccagctactcaagaggctgaggcaggaaggtcacctgagcctgggaggttgagactgctgttagctgtaatcacaccgctgcacttgagcctgggagacagagcaagaccctgtctcaaacaacaacaacaacaaattcttgtagagtttgtgagttagggattattatccttagttatagatgagcaaactgaggctaacagcagtagagtgacttgctcaagtcaaatagcttaagggaagtctgggtccaaagtctaagctttgcctccactcccacacgctgtctttgtgcactccggccagtgacccaggttggggcctggagaaaaacagcctgactcccctgttgctccacactcctcacctccctaacttaaagatcagtttatcctcagacaattctaaatgatttctggccgtttccagaaaattatccagaaaagcaacatttgtctgatgcacatacatacatacatacacagaagacctaaactcgcaacacataaactcaaatctatcacacctcctgacaccctcaatctcacaggtgtctcacatacaccctctctctttcacaaaaaggactcattcaaagttctttagggcacttatggtaggtggtgactgagagacatttagggcctgcacttcagtgactctgccaaggatatcagtgccagcaccctatccacacaagctctgagggctaagactctcagtaatatccaggtaaggaggatatgaggctggctccccagggacccacaacccaaagcatcttctaggttcaaggcaagatgattttggcaaatcatttatcttttcagtttctttatctgtaatctaagaatcagaatacctacttcggtgggaagatgtgagatttaaaattaagtatgcctgccgggcgtggtggctcacgcctgtaatcccaacactttggatcacgaagtcagatcaagactatcctggctaacacagtgaaaccccgtctctactaaaaatacaaaaaaattagccgggcatggtggcacgcgcctgtagtcccagctacttgggaggctgaggcaggagaatcacttgagccggggagccggaggttgcagtgatccgagatcatgccactgcactccagcctgggcgacagagactctgtctcaaaaaaaaaaaaaaaaaattaagtatccctagcattcagtcaagagttctcatatctttttcccctcctttatctcatccctacctccctcttctcctggccattcaaatgcaaagtccgattgagcaatgagccctggagcaggcctagagggccaaataatcccatgatgtgaagaaactccatttctcttgcaaccaggtttagatggtatatattccgtaatttctgatttctgggtggccttggaggctcggaattttttttttttctttgagacggagtctcgctctgtcatccaggctggagtgcagtggcgcgatctcagctcactgcaagctcagcttcccggtttcacgccattctcctgggaggctcggaatgtttgaaggaatttttatgactgctactcactgccttgaaatgtttcccctggctgagcattagtttacccttctgggtcactcagcatgttcctcagtttacctggctttatgttttcaaagtgtttccttctctttaccagttgtttggtggcttttttttttttttttttgagacagagtttcgctcttcttgcccaggctggagtgcaatggcgcgatctccgctcaccgaaacctccgtctcctgggttcaagcgattcttctgcctcaacctccccagtagctaggattacaggcttgcgccaccatacccggctaattttgtatttttaggagagatggggtttctctgtgttggtcaggctggtctcaaactcccgacctcaagtgatccacccgccttggcctcccaaggtgctgggattacaggtgtgagccactgcgcctggcctgacgtttttttttttttttttaaagcaacgagttcctttgttactgctttttaaaaatagaatagcttgccatttgagaatttattatttttatttatttttttagagacggggttttgccatgttgctcaggttggtctgaaactcctggcctcaagtgatcctcccaccttagccccccaaagcactgggattacaggcctgagccactgcacccagcaaggtcctttgttcaaagaaaatcttattcagaagcctaatgtgtaagagatcaaggtgggccttgttttggtttaagtgaggacagcctgggcactgcagtctattccttcacatctctctcatgcagcctccctaacagccacatagtcccttcgaagacttctaatgaacccacatttcagatcttgttcattcgtcccagccactacctacctctcagcagcctgtgacaaagcagcctggctttgtgctcagttacctctgcctgttcattagtatccttcagcagcttttcttcctccgcccattacctaaatgttggtgacatccaaacgtatctcctctcttgccttcctcattctcacttcaaggctcattgcttctgtctaactaagtcctaaactgacatctccagaccagtatctgccctgcacatcagactccagacttccactggatgctggccacagaaaattttttattaaaaatacattttttcacagaagaaaattcattaaaagtcaagaaagagcccccagatgaaatggctgacctttactcaggtgcacatctggccagtcttgaggctttaagacaaactacgcagcagcattagagaagtagtagattataatgtgcggggaggggagacggacgtgagcctggagtctgagaggggcactgtaccgttttttccaacacccccagctaggattctagtggagttagctatgtccaccatggccttagcctgaaaaatatgggcatttaagacttcagcaggccacatttagctcaaacaggaggattttatgacagccaaggtaaagaagggagatttaaacattgtaacaggtttcaaggtgctagattttttttcccccaagaaaacatctccaagtaaaagtgatatatttctatttgtggagaagatcctagtcttctctgtagtcaattatgaacagtgcagtctagaacacttgatattcacaagtgttgtgtaaaggtaactatagggcggatacctcctaagagaaaaagatggttcccaggctgatgggcatttccattcctgcccttggtaggctcacagtggtttgtgggagtaaccaaggccagagagaaatctaaggactaggttgggagctataggacccttggtctgttcatgctttgcctctgagaaaccctgtagaccccacattaagaaacagggaaactttaaaggcctataggctggtcttggagatgacagagacctgacctgcttttcctccaattggaaggccaagggggaagagaactgagggaagctagggaagtagcagcagcttgaaagaagagactctgaaaacacactaaaactggagaggctgggtgtggtggcccatgcctgtaatcctctcactttgggaggccgaggcaggaggattgcttgaggctggagttcgagaccagcctgggcaacatagtgagatcctgtctctagagagagagagagaaaaaaaaaaaaagctgggttcctgcttgagcccagttgttgagactgcagtgagccatgatcatgccactcccctctaacctaggcaacagagtgagactctgtctctgaaagtaaaaaaaatgaaaagtggggagtgctagtgggagccaactcaacccaagtaaaggcctaatagctcctctatgggtgtttgcactgtctaacaaagaactggaccctgacagtcagaggacccatggtaggatcatctagtgtagccccttcttttacagagggaacctaggacttgggtttggttcagtggtaagacctcaaaaccacaaaagagctgggtcactctagagaagcttttctacttggccaatgcctcttggcccaattccctctaggtctctgatttataaaagtttttgtatgtgtgtctgtctgtcccaagagacaggaagcattcctttcagggaaggaaccaaatttccctagggctatgatgctaaatagtccattctcccaagaacaagtcctactctgtcatttacctgcatactgtcacatgaagactgataagggtgggcctccgaggctgaggatgctggggcacccttcgtctcaggagtcccatcctagccaatgaggatgggcaagatgaagggagcaatgggaaaaaggacacagggattatctcatgtttgaaaaattatatagcatgggaatgttagagaaaggtgaaacaaacagccatcaaatcagaagcagaagcctgctttagctcagtgttttcttctttcctgaacactgtctttcttttttatttatttattttttttgagatggagttttactcttgttgcccaggctagagtgcaatggcgcgatctcggctcattgcaacctctgcctcccagattcaagtgattctcccatttcagcctcccgagtagctgggattacaagcacataccaccacacccgggtaatttttatatttttagtagagatggggtttcatcatattggtcaggctggtctcaaactcctgacctcaggtgatctgcccacctcggccttccaaagtactgggattacaggcataaagccactgcacttggaccctgagcattttctcttgctttgttcactaagtctcctgtatgagaaccctgacttgccaaacagattctgggttgcgtctctgccttccctttcctttacctcctcctttaacacctaacacaggtaggttcacgctggtaaaagctacaaacaatggcagtgggaggagttcctctgagttttactgaaaatttaggagacatcaatttgttaactctctatagggtcagaaacatgaactaaatctatggttcccaaacctggataatcctgtcactcactaacaacctactggatgggcccagaaatcagcattttatggagctgaagtgatagataacctcaccagtcttcagatatgcaatgaggaactcatgcataaccttaaattcacagggcagtcgggttacagcctcttcaaataaatgacaatttaaagttacctcctccaggccgtttatcattaatcccatttcttacatgttccaccaaacccctgacctctctggtttctcagatttccaagaatctctgttcacttcttatgtttgtgcactcccaagagaatggaggctcatctggagaaggaactagattaatcttctgctctacacttgagctcctgattatggtaagaaactcgataaaaatttattggcagatcagaagatggatccttagaggaagtctagtgtaagaggtgaaagaagatactttggagtcagatggtctgggatcctggctgtagcaaattaacattcctgtctctcaatttttttcttctgtcaatacctacctcaaaaggttgttgagggtgaatgagatgatacctagaaattactctgaacagtgcctggaatagagtgagcatccagtaaattggctgctatgactattattaagaacaccccaatatttcccagccacaactgccccaactgggcaggccatcaacagccaacaggtatgatatggggagtggtcttccatgtacaaagcttctggttcctttctttctaagagataaatgcaaatgactcaagatcttctcacaaagaccatgtacccatagatatggagtctcctggggagaatgataacccctttggtacgctgcagacatgaggaccctacatcaggaggtcctagctaggacagtcagtcaccaaccctgtcacccttcgcgtctactacatgaagcatgggcacaagaacaacaacctggaatttaagaactttttttactctgaaaggagagctaaacaaacctctgttctccaaacacaagatctccatcttccatgcagtgaagagaccacaggctttgtaagcagaccaacttgagctcgttttagagcaaatcactgtaaccctctggacctcaccttcctcatctatatagaaatgagaaaggggtgcacaggagaagggagagaagataatatctcactgaattgttgtgaggtttgaatgaggcagggtgggggaaaagcacctagcatagtgcttagcacatctcaagcactgaactggtgctggtccctctgtccagagatagggccatggcctacagacaaggtgaactcatagtgtcagaactcaaagtctcagatactgaaggcttgggtccctccctgcctccctcatccctcccagaccagctcctggaccccctccctcatgtcccaggctgctaaattgatgaagctaaaagggttttgatcatgtcggtatatttatatgtaaatacaaaactgtatcactgtaagatattgaatatgaacattacaattattttctgaatcagactcagtccattgatattaaatacaaaatgaaatgattgtaaaaaataataatatacacattcaaagagcttattacagtataaaattattgaggtctgatcagctgccaacctcatcttctgtcacaggggaaggtttaggagttcctgggattttttgggaatgtggagtgctgaggactcttgatttatccctagcacataaggatgagtgggctgggagcaggcagggacaggttgggtgggtaggggacaaacagtgattgcaggggaccacctcactcagccagggggtgaagctttttattgacacagaacccacccagtttgagggtctagcaggctagcaggcaggaagagatgggcatctcggtagacagggccaagctgcataaaggaaccatccagcaaaagaaaaagggccccagctcatcctcccagggaggtattttcttagtggttttttctttctcatacctgggctccccctccttccttctaagattcgtaccgattgcatttggctctggctgctcagtgagttcatctctaccctccgcctcccatccctgggatagtgaaagcaaagagagagtatggaatcacagtggaggtctgttccccaaattggccaagtaaatgtagaaaaatcatcggataagggaaatccatgctgagctaacccagtgtcaccacaaactaatacattcttggctccaacaggtggcaactggaaggagataagtcattacttaaggaaggggccctgtggcaggaacatggaggagatgtgtgtgtgtcctcttccaccactctgtagcctgacaagaggagacatgatcaccaacccaagctagtccaggataaatagtagggtccaagaagcaaggagtcctgaactgcaacacggagccccaggaacttctggaaaggagtatcgtgtgtatatgtatttatagaatacgatcatattatcacatacaatatatattatatacacacgtacatatggacccatacacataagtgcacacacacacacacacagaatgacagaaaggactggaatacacgccctacttataaacgtgcttggcactcaggacgatctctagaatatgtaacttggtcaagctctctggggagaaaggcaaatgctcatcaaacctccccataaaatcctaggaaagggaaggagtgggagacaggagacctcagaaaaagaatggcgggagaaaggaggagggaggttccttccccacttacctcggggaccctagcaaaaatcaatagccacaatttggttttaataaggcacagtttgatagcagatgctaggaattaagaacacattgctactggccctttctagtggcaatttcaccacatttatctagccaaagggaaaggctgccttgcgtgcacacgtgtgctgggagacacaagaaagaagttgatccatggcttcagcgtaactgatggcaacctataggctcagcggtgtccagggtagtttaaggaaggctggccaacaggtaggaggttcgtaggagagttactgactctccacggccagcaggttttggccagaggataccatgccctccttctctgcgaactccaggatggccttgtagcaaaaatagtactgctcaggggtctggatgctgaaggccctctgggtcctcatgcgtgacaccgtctggaacacattaagggtgccaagctcctccagctgtgccaggcagatgtccagtgagcagaaggtacctgaagaaggaaggaagtgatcacatctggtttacctctcttctcttcctccctctaccaaataacccaggcagaactgaatgaatgacttcacaggcaaagtgcctcatggcagaaggccaggtggccttaggcctgaaaggactcaagaaggaggtcacagggagtgttggaggccagagaaatgagaaggcctcttatttctcaggacatacacttggggtaacaggaagtggaaatgggaaggtgacacaggggaacttcctgcttcaatcccagacagacagactgacagcactcccacacctaatttccagagtccacaagtttttcagaggcctaacaaaaacctattctcaactttctcccaaagggacctttgaaatagaaaggccaacatttcctaccatgtacatgcccttaaggcaaaagctgctaactggctccagaatggagaacacagcacagggtggggagtccctccagggagggctggatgggaaggaagcagcagcccagctgagctctctgggatacctgcagtgacagttctaacaggtgacagagtcagcgttatgatggggtgtataaaacatcaacccctagaggacttggcttgtgaaatatatattctggccatcacttggtccaccaaaaggacattagatgagggatttttcacagcaattcaccaccaagggagcaagtgagttccttctccaatcacagatgtgggctaagagctttgtttttcctcgtccacccctactgcccctgcagacaccaagagctgcattaggtgcgttacctgtcctgccaatgcctgcactgcaatggaccacaatgggtggctcagggcactgccctttggagcgtgctcccatgttgctcacagccagactctgctggtttctgaccactctcaagaagtcaatgagggaagctgctgaggaagggacaccatagtctggccagctcaagaactggaagtgggtcacctggcgtttctgccgttccttagataagaaaagaagtaaacgttaacaaggttatttctgcctgcccctagctacctctggcttttccagattctcaacaccctggttatccctaccaccaaggctcctatccaccactgtcaacttttcccataattgcttctttactacaaacccaaaggaagggttggttaattggaaaaggcagaattcctatactgtaagatccagaattttttttgagacaggatctcactctgttgcccaggttggagtgcagtggcacgatcaaacttactgctgccttgacctcacaggcttgtgccaccatgcccagctaatttgttctatgttttgtagagacaggatctcactgtgttgcctagattatcttgaactcctgggctcaagtgatccttccacctctgcctcccagagtgctgggattataggcctaagccattgcacccagccccagatttctaaaattataagctttactcctatttaatgttcctatcgtgctgcagtaatatggctatattggctgtgagttaaatatcctcatcctgtccctagaaaaacagaagcaactcataacttccctggtatcctacctattccctctggagattttcattacagtaattattctccccctgtttcaacaaggtgagaaaaaagaaacctggatttacctctgtgttgtgaatttctagcgttgttttcttataatgattcatgttctccacgcctagattggtcactgtgaggaagccaaatcggatccgagagtctttttctaaaggccagtactggccacactttctcctgccgccttcctcaaagctgaagacacacagagcaaggtaagccttccatcgttcctctccacagcagtaacctggcttccccaaagacctgatatacccccaggcagcaatatcatctcttgcattgcttctaacttacaccattgattctcagcagaaaggaaaggaaacctcttcattctaaacaaatgtactcacagctaaagtttctgcatgtactcatatagcagacagttactgagcacttactacagcatttggtctttttcctaatacgcaatagtacgtctcacatatgtgggataaatactgggtgaacagagacaaaaacagtatagtagctgggtatagtggtgcatgcctgtaatcccagctacttgggaggtttaggcaggagaatcacctaagaccaggagtttgagaccagcctgggtaacatcatgagactccatctcaaaaaagaaaaagaaaaagaaaaaaaaagagtagagaaaatatgaaaatatgataggtcagagagaactctctgataaactgataaacacacatctactggtatgttagcaggaggtttgtgtaaaagcctgaagtcccagcccaggcaacatggaaaccctatctctactaaaaatacaaaaattagtcaggcatggtggtgggtacctgtagtcccagctacttaggaggctgaggtaggaggattgcttgaatccaggaggttgagactgcagtgagctgagatggcaccactgcactccagcctggatgacaaagtgagactctgtctcaaaaaagaaaaaaaaaaaaaaaaaaggcctaggccaggcgcagtgactcatgcctgtaattccagcactttaggaggccaaggtggcggatcacctgaggtcaggagttcgagactagcctggccaacacggtgaaaccccatctctactaaaaatacaaaaattagccaggcatggtggtgggcacctgtaatcccagctacttgggaggctgaggcagaatagcttcaacctgggaggcggaggttgcagtgagctgagatcgcaccacttaaggttgcagtgagctgagatcgcaccacttaactccagcctgcacaatagagtgagactcttgtctcaaaaaaaaaaggcctaaatctaccttgccaccctccagtggccccaaagtattccaaggtagaacttctcccactacctcctctccaaataagtggtggttataacagtgctaaggaagggaatttaacattcacattcatttttttccttcctcatctgaaataggttattccttaaatttgccagatttgtagaccaaaatttcaaaaatattcctttcattaaaatcttccggccaggcgcggtggctcacgcctgtaatcccagcactttgggaggccgaggcaggcggatcacgaggtcaggagatcgagcccatcctggctaacacggtgaaaccccttctctactaaaaatacaaaaaattagccgggcgaggtggcgggcgcctgaagtcccagctactcgggaggctgaggcaggagaatggcgtgaaccccggtgggggcagagcctgtagtgagctgagattgcgccactgcactccagcctgggcgacagtgagactccgtctcaaaaataaaataaaataaaataaaataaaataaaaataaaataaaatcttcctggccaggcgcagtggcccacgcttgtaatcccagcactttgggaggctgaggcaacagatcacgaggtcaggagttcaagaccagcctgaccaacatggtaaaaccccatctctactaaaaatccaaaaattagctgggcatggtggcacgttcctataatctcagctactcaggagaatcacttgaacccaggaggcaagggttgcggtgaactgagatcgagccattgtactcccacctgggtgacagagcaagacaccatctccaaaaaaaaaaaaaaagatattagccaggcgtggtggcacatgcccgtaatcctagctattcgggaggctgaggcaggagaattgcttgaacctgggagacggaagttacagtgagccaagatcgtgccacactgcactccagcctggtggcagagtgagactccatctcagaagaaaaaaaaaaaaagtagcaacaaatggagagcaaagggaatctggtaattcaggagtcaggaaggcagcacccctctggaaatagggaacagataaaaggagaattgtcccatgtttcccagaacttcctttagtggataaggccaggacctcaaaatagggtataactggcacagggttgccagagccagggattaaagctttaacaagttagatctattcatctccaccatacccgggttgtggattagctaagagatatctcaaaatctttgccctggctttcctaatcctcaatttttttttttttaattgagacagagtctcgctctgtagcccaggctggagtgcaatggcgtgatctcagctcactgcaacctctgcctcctgggttcaagtgattctcctgcctcagcctcccaagtagctgggattacaggcacgcaccacaatgcccggctaattttttgtatttttaatagagaaggcaccatgcccggctaattttttgtatttttaatagagacggggtttcaccaggctggccaggctagtctggaactcctgaccttgtgatccgcctgccttggcctccctaagtgctgggattacaggcgtgagccaccgtgccaggctgaccctcattatttctaaaagctaaacttccctctttaatcacccatgcctagggacagagtggaggtggagacctttggaaaaaagggattaactcaccgggtggtcatgacaatcaccaagactttttgctcccataccatgagccagaaatcacgataggtattctccaaaggacctgaaataaaaggagaagacaagaaacatgactctgggaaacactttttttcttttgtaggcgcttctgttttactccccaatggtaactccaaaccatagatggttagctccctgctcatctttccacatccctgctattcagtatagtccgtggaccaatcacaccagcatcgtatgggagagtgtaagaaacatgaatctgcatgtcaacgagatccccaggtgagtcgtaggtaggtttgggaagcactgctacataccctctcagagtcttaatcatcagaacttcagccatcacatccaggctgacagtgtcaaactgtaagaatctctagctgttttcatctcacctaagcttcagttttataatcacagattgcttactaaaccattaaccttctgtttcccataatctcagatccattatgtctgtaactaagtctcctccttcaaaattagctttatcttggccgggtgcagtggctcatgcctataatcccagcactttgggaggccatggcaggcaggttgcctgagctcaagagtttgagatcagcctggcaacatggtaaaaccccatctctatgaaaaatacaaaaattagccaggtgtggtggcacatgcctgtagtctcaggtacttgggaggctgaggcacaagaattgcttgaccccgggaggtggaggttgcagtgagccaagagcgcaccactgcactccagcctgggcaacagaacgagactctgtctcaaaaaaaaaaaaaattagctttatcttgcaactttcttatctctgttaacaatactagcattcttaaatcattcagtcttaaaaaggtgaagtcaacactgacttacccatttccttcatctcccagaagcagtcagtcaccaaatcctagagattttttacctttgaaatgtttttggtttttattcttttgccctcatcttctccccatcctgttcttcctgctcgatttcactgacacaaagaccacgtcatcttctaagttactgtaacaccctcttagtctacttttttgaataggcctttttcccttccaatctactctgggaaaccccaccagtttaatctttcttaaaaattacttcatcagaacatagacacaccatgctcactttggcctctattctttcgctcaagctgtctccgtcacctccaatgctattcattttctacccattttcaagtgccacctcttccttgaagctttctctgaccaccgcattccttgtgaagcttcttctcttttgcttttgatggcacagctggatctatacaggttgaccatttaatttatatactcttccatccattattttactttgtgggaattaatgatatctcactaaacatggtcctaaggacaaaggattacaggtgtgagccactgcacctggccaaattctcctttgcacagggctgagcactcagggctgagcactcagcaataactttgaagatacttgtgggctaccaactccactttgatcaagacagtaaccggccggcggcagggctcacacctgtaatcccaacactttgggaggccgaggcaggtggatcacttgaggtcaggagtccgagaccagcctggccaacatggtaaaaccccgtctctactaaaaatatgaaaattagctgggcacgatggcaggtgcctgtaatcccagctactcgggagcctgagttaggagaattgtttgaacccaggaggcggaggttgcattaattgcattaaaccaagatcgcaccattgaactccggcctgggcgacagcaagactccatctcaagaaaaaaaaaacgtaacaactcaagataattccttatactttctgggtgtttctttcctctctgctttcaggaaagcagggcagtactaatggttaattttggtctagaagtctgctggttctactacccttattgctaagtcttttagcaagcactaacatgatactggaataccctctctgcagaagtggatgatgtcaaaaacgtgagatcttagaaatacactaaatatccaataagagaggattaattaaattatgacgtatcaggtggggtgcagtggcgcacgcctgtaatcccagcactttgggaggatgaggcaggcagatcacttgagcccagaagtttgagaccaacctgggcaacattgcaaaaccctgtccctacaaaaaatacaaaaactagccaggtgtagtagcacatgcctgtagtcccagctactcaggagactgaggtgagaggatcacctgtgtgtgcctggagaggccaaggctgcattgagccatgatcgtgaaccatgatcataccactctgtcacccagcctaggtgacagagtgagaccctgtctcaaaaataaataaataaataatagcataccataatttatacagtctataaagttgatgttgtaagagctgtattttttgctatggaaaggtattcacagataccattaaatgaaacaagagatagtatagaaagagcacatttggttaaattaaaagtttagttttgttttttttgagaccgagtatcactctgtcgcccaggctggagtgcagtggcgtgatctcagctcactgaaacctctgcctgccgcgttcaagcgattctcctacctcagcctcctgagtagctgggattacaggcatgcaccactacgctcggctactttttgtagttttagtagagagggggtttcatcatgttggccaggctggtttcaaatacctgacctcaagtgatctgcccgccttggcctcccaaagtgctgggattacaggcttgagccaccgtgcccggcctggttaaatattttgtatgcctatatctgcatgtatgcatagataaaggtctaggaggagatgctgtaaaatgttaacattatctctgggtcctagggttatgagggattatttttgttttctaaatgttctacaatggacatgcattaccctagtatacacatcaagaagacagtaaggacaccttttccacatctctgaccctcagcctcatccacatcctactctcctgcaccacagcaactctcatatacttcattttccacattcagaccactggcagaattggagtactgagcagtcagagcatatggtaactcagttaccagactggggctgggcaaacttctcacaggctcaagagagatactaagaagggaaagttgtacttcccagcttagaccctttaacagtaaacttctctcaagaaataaagtcagcagtttatactgacataggtgaaacaatccacagacatggcttgtaaaaacttctgaaccaaacaaacatgggttcaaaccctggttctgccacttactagctgcatggtccaaggtcacgtaaacttttgggtttcagtttgctcatctataaattaataaacctcccttgcagagtctctataataattagatagcatttatgcatctgatatataataggtcttctcaatagatgacatcattaatagaaatataggccaggcgtagtggctgatgcttgtaatcccagcactttgggaggccgaggtaggcagatcacttcaggccgggagttcgagaccagcctaggcaacatggtgaaaccctgtctctaccaaaaatacaaaaattagccaggcatggtggcaggtgcctgtaatcccagctacttgggaggctgaggcaggagactcgcttgagccctggaagtggaaggtgcagtgagccaagatcatgtcactgcactccagcctgggcgacagagcgaaactccatctcaaaacttaattaattaattaattaaaaataaagaagttgcagacattatgatattttattcctaaatacttgagcacttactaggaaaacaaggacctcctcctatagaacattaccattatcaccttaagcatacattaaacatggatacaatgttggctaaaaaaaatctccaattgtctcaatagtttgtcttcaatagatttttttctcccagttgaggatctaatcagatactctttttttttctttttttttttttttgagacagagccttcctctgtcgcccaggctggagtgcaatggcgcagtcgcagtccactgcaacctctgcctcccaggttcaagcaattctcctgcctcagcctcccgaatagttgggactacaggcacccaccaccacacctagctaatttttgtatttttagtagagacggtgtttcaccatattggccaggctggtttggaactcctgaccttgtgatccgcctgcctcggcctcccaaagtgctgggattacaggcatgaaccaccacgcctggccgatcctctttttttttttctttttgagcgcaatctctgctcgctgcaacctccgcctcctgggttcaagcgattctcctgcctcagcctcccaagtagctgggattacaggcatgtgccaccacgcccggctaattttgtatgtttagtagaaacgtggtttctccatgttggtcaggctggtctcgaacttccaacctcagtttatccacctgcctcggcctcccaaagtgctgggattacaggtgtgagccattgtgactggccctttaatttatttatttttgagacaggatcttgctgtgtcagccaggctggagtgcagtggcacgatctcggctcagagcaacctctgcttcctgggctcaagtgatactcccccctcagcctcccaaagtactggagttacaggcgtgagccactgtgcctggccatggttctctttagtctccctttaatctagaacagttctctgcctttttgttttttatggcattaactttggagagtctgagccagttttcttatagtatgtcccacaatctggattgtttcccatgactagattcagattttaaaactggcaatacacaatgcaggtgatattcatttctcaatgcatcatatcaggaggtgtacataatgtccctttgtcctttactggtgatactaagtttgatcacttgattaaggaggtatccaccgtatcttgctctgcagtggtcaaagggccttacgcccatctgatggtctgttgtctttctgtattatgatttcctcctaccatctttgaaagtgacatgatattcttgagatggagaggccaggtcaggaagagtactaggatcataggaacatttatagaaactccacctgaaatcctcctagaggctgggcatggtggctcacgcctgtaatcccaacactttgggaggccgaagcgggcagatcacgaggtcaggagttcgagaccagcctgtccaacatggtgaaacccagtctctactaaaaatacaaaaattagccgggcgtggtggcacacacctgtagtcccagatactcaggaggctgaggcaggagaatcacttgaacccgggaggtggaggttgcagtgagtggaggtcgtaccactgcacaatagcctgggcgacacagcaagcctccatttcaaaggagaaaaaaaaatgagaaatcctcctagagctcagtattccactgtcagacttattagcacatactatctatgtcagaacatttgctggagtgctctgtgatggtataggaaccagcctaggcctattaggacagcaatactcattcctagattggactcaatctctgggaagtccactgctattcttggcctctcactagacaggaagagcatgaagagctcactggctgatgcattctgatgccctacacccttgccaatactaagaaatagccccaaaacttgcaggcagtagtgttatgtgtttaaatctccagtttatctctatgcggtgagtttccaggcacacctggtacagaaaccccaaactacttatttgcttttctcaaccaccacccatctttataaaaggccaggatctagtggccaaaacctccactcaagttaccattcgtttaaaaattatgctatcatttggcacaaggaatcataagtagatggcacaaaatcaacatgggagggacggaccagcttaccttgtgtgccaatgtaagcattcttctgcttgtagccatccatgaaactggcattgatgtaatctgtctaatgataaaaaggagacatcactatagctacacagaatacaccatttgggtcataaaatgatgtactcagtaagtaaaacccaaggtgtgaatattctcttcttgttgagcagaaaatgaggagtgaaatggccagctcaaaccctcacttcaataaatggtgctgggacaagtagatatctacatgcataaaaatcaagctgactccttcctcacactgtaaaactgactcaaaatgtatcacagaccaaatgtaagggattaaaactattaaaactctcagaataaaatataagagtaaatctttgtgaccttgggttaggcaaagctttcacagatatgataccaaaggcgtaagtgacaaaagaaaagagataaattggactatattaaaattaaaaacttatgccaggcgcggtggctcacgcctgtaatcccagcactttgggaggccgaggagggtggatcacgaggtcaggagatcgagaccatcctggctaacacggcgaaaccctgtctctactaaaaatacaaaaaaggtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcctggggcagtgcggagccgggacagtcgcggcgctgacgcccgcgggccccagctgcagatatgaagcggagccgctgccgcgaccgaccgcagccaccgccgccccacagccgggaggatggagttcagcgggcagcggagctgtctcagtctttgccgccgcgccggcgagcgccgcccgcgaggcagcggctggaggagcggacgggccccgcggggcccgagggcaaggagcagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccctctgggaggtgaggagcgtctctgcccggccgccccgtctgagaagtgaggagaccctctgcctggcaaccaccccgtctgagaagtgaggagcctctccgcccggcagccaccccatctgggaagtgaggagcgtctccgccgggcagccaccccgtccgggagggaggtgggggggggtcagcccccggcccggccagccgccccatccgggagggaggtggggggtcagcccccccgcccggccagccgtgccatccgggagggaggtgggggggtcagccccccgcctggccagccgtgccgtccgggaggaggtgggggggtcagccccccacccggccagccgccccgtccggaggtgaggggcgcctctgcccggccgcccctactggaagtgaggagccctcagcccggccagccaccccgtccggagggaggtggggaggtcagcccccgcccgccagccgcccgtccgggagggaggtggggggtcgccccccgcccggccagccgccccgtccgggagggaggtggggggggtcagcccccccgcccagccagccgccctgtccgggaggtgaggggtgcctctgcccggccgcccctactgggaagtgaggagcccctctgcccggccagccgccccgtccgggagggaggtgggggggggtcagcgcccctgcctggccagccgcccctccgggaggtgagggggcgcctctgcccggccgcccctactgggaagtgaggagcccctctgcccggccaccaccccgtctgggaggtgtgcccaacagctcattgagaacgggccaggatgacaatggcggctttgtggaatagaaaggggggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctccttaagagtcatcaccaggccgggcgcggtggctcacgcctgtaatcccagcactttgggaggccgaggcgggcggatgacgaggtcaggagatcgagaccatcctggctaacacggtgaaaccccgtctctactaaaaatacaaaagattagccgggcgtggtggcgggcgcctgtagtcccagctactcgggaggctgaggcaggagaatggcgtgaacccgggaggcggagcttgcagtgagccgagatcgtgccactgcactccagcctgggcgacagagcgagactccgtctcaaaaaaaaaaaaaaaaaaaaaaaaaaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaatacaaaaaaatagctgggcgtggtggcaggcgcctgtagtcccagctacacgggaggctgaggcaggagaatggcataaacccgggagatggagcttgctgtgagctgagatcgtgccactgcactccagcctgagcgacagagcgagactctgtctcaaaaaaaaaaaaaattcattcatcatcagccatcatggaaatgcaaatccataccacgagatactaatttatacccactaggatggctacagatatcaaagatagataatactgttggcaaggatgtggaaaaactgaaaccctcatacatgtgtaaaccctccttatacatggctagtggtaatgtaaaatgctgcagttactttagaaaacagtctggttgttcctgaaaagattaaacagttaccatatgacccagcaattccactccttagcaaaataacataggtgcatacaaaaacttatacataaatatccatagcagcattattcgtaatagccaaaaatggaaacaactcaaatgtccttcaactgataaatgaataaaagtggtatatccatacaatggaatattatttggcagtaaaaagcagtgatgtgatgatacatgctatgacatggatggacctagaaaacattatgctaaatgatagaagccagacacaaaaagctacatagtctaggattctctttgtatgagatccctagaacaggcaaatctatggagataggaaataaatcagagtgggttagagggaaataggtagcgactgccaagggtgtgaggtttctttgggaaatgaaaaaaatgttctaaagttgtttgtggtgatggtggcacaactctgtgaatatactaatagccattgacttatatactttaaataggtaaattgtatggtatgtgaactgttggaggccgaaagaatgagggtcatgatcaactcagtataccactggaggctacatgagcaaaaaggaaactgttctcatgaaagcaggatgttggcaaactgacaaactgcatctgccgcccagaaggaatgctgagggcagtcacgacccaggcacaagtgtttcttgtagttaggcacatctgaagcctgttagcaataatgtgtacctgtgatcaattaagcagctgaccaatcgttacctcctcctccctgctcttggtacccaataaatacaaagggctgtagaagctcagggctgcctttgctcactagaagcagggagttctcttcttccccatgttacccttcctttagaatagttatttttgtcttaagttttcattgctatgtttatcccccttcattcagtctcctaatgacggtctcaagtaataacaatagtaactgccctagtgacatctcaagcagtaattgtggcagtctgccagagtgaactatataactcaatagaaactgttatttacaagaaaagggtccatcaagacttgcaacactgtagcacaggaccaaatgagaggcaaggcaagcaagtaggaacacctggtccatcctgccacacacaaaaggcaaaatatgaatggagaagaaataaagctacatctcatacttaggaccatcaacagacgagccaaacacctggactccattattacctgaattaatgcaaagcaacttccagtcaaattcaaaggcatctcaatgaacagctcctgactacctctcttccagggtattctcccacctcctaatgtcctcagtcttaattacttcaacatcattttttataaatacctactcaaaagatcctttgatccaggctgataaaagagaaacatcaatcagctgcagttttatgttatagtataactagttgggagttgaatggatagaagcagtggaatggataagggaaggtgtgaagggttacagaaggacaaaagaaaagtttcaatagcaaactagggaaaactcataacccactgcattacagagaggtcagactgactctttcctcaacctatcactcgttctcctgtgggtcctatcactgggtgggcagtctgaactgtcagtatcccatagctaacctcctaagatatctccacctcatggtcaaacccatgttacttggatttgtgttcattagccagtcagtctaccaatttatcactctactatttatttagtcaagagtttcctccttagaaactgtttctttgactaaataaatagtggagtgataaactcggagttttccctcccatagcagctagtattgacctcatacgattactgtcctaccctgactcagacaacttcactgagctaatagaccacctgcagcagacccagcatgctaaaagcctcactcacttccaaacaggcttctcaatccagggtgcacccagtcagccaaagcccatcctctactcaacctggcacatgcaaatggtatacccactcgaggaccaaggggagaaggtatggaaaagcacaaaagatttacctagtatatgccagtcagcattagtaagaacataaggaggaactaacttcatgctttgaaaagaattgtcacttctttttttttttttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttagtagagacggggtttcaccttgttagccaggatggtcttgatctcctgacctcatgatccacccgcctcggcctcccaaagtgctgggattacaggcgtgagccaccgcgcccggccgaattgtcacttctttaaagaagacattatttctttataactaagaattaccagctttagcactggtctctgagctgatttttaattcccagggaattaaatttttaatttcagcaacttcggaagaatcactggatattaaaactgaaggccgggcgcagtggctcacgcctgtaatcccagcactttgggaggccaaggcgggcagatcacgaggtcaggagatcaagaccatcctggctaacaaggtgaaaccccatctctactaaaaatacaaaaaattagctgggtgtggtggcgggcgcctgtagtcccagctacctgggaggctgaggcaggagaatggcacgaacccgggaggtggaggttgcagtgagccgagatcgcaccactgcactccagcctgggcgacaaagcgagactccaactcaaaaaaaaaaaaaaaaacaaaactgaaaatgacccagagataaagtatacacttgggggaaaattggaatagcaggaagaacaaacccggaacactatgttgtgagccattgctatagactgatcatttgtgtcccccataacttcaaatgtgtaatcccaaccccagaccctcaatgtaatggtattaggagatggggcctttagacaggtgattaggaccatgaggacagagctctcacaaatgggattagtgcccttataagacagaagagttctgaagtgctccctcaccccttccccttctgccatgtgaggatgcaatgagtagacagtggtctatgaaccaagaaaggggccctcaccagaccccaaatctgccagcacgttgatcttggacttcccagactccacaatagtgagaaataaatttctgttgtttataagccatcctgcatgtggtatttttgttacagcagcccaaacagattaaggcagccatgttcaacagaaactgggactaatagctttaaaattccagaagcaaatcaagtaaacaattcactaaaaaacctgaatcctccaaataacaaggtattgtatacttgaaaattgcggacagcatattttaagtgttttcaccacaaaacaaggtaaatatgtgaagtaatgcatatgtggtgttttttttttttttttttttgagacggagtctttgctctgttgcccaggctggagtgcactggtgcgatctcggcttactgcaagctccgcctcccaggttcatgccattctcctgcctcggcctcccgagtagctgggactacaggcgcccaccaccacacctggctaattttttgtattttttagtagagacggggtttcaccgtgttagccaggatggtctcgatctcctgaccttgtgatctgcccgcctcggcctcccaaagtgctgggattacaggtgtgagccaccgtgcccggcaaagtaatgcatatattaactagcttgacttagtgtctctgcaatccatacatattttaaaatattatattgtataccataaatatatacaatttctatcaattaaaatttaaaaacaactaaatgtcagaaaacagaatggaaaaatagccccataggtggaaattccatgagagtgttaagtccccaaagctaagtaaataatttttttttttttgctttcggcccgcaaagtaaataatgtcaaaaaaactaaaaactaaaatcaaaataaaataaaaaaaaagcctaaatactccatttactataaaaataaagcctccgctaatgtttcagtaaggagagggactacaaatcagacaatgatcttcatattaaccacaggatgattagaagaatctcccagtacactaagattcactcattcacaaatatgtcctgagtgtctgatatgtggcaggcactgttctaggtactggagacagggaagtcaacaaaatggataaatacaggtatctctgactccagagccccaactcaaccactgtactccactccttcagggcatatacgatgatgatctcagcagtactgatgaatttaccctccagccagccagtctcttagctcaaatgctcctgcaggaaaatcttctccaagggtcctggataggactgtgaattcagtttatgtgcttgaaacaacagggacaagagagttggaaaccatgatcctggggtcccaacccacatgtcatatatgcccaaatacaaggcagtaagttttccaaaaattattccccagaaagagaagggatataacaagtccttataatgtgtgtcatgttaaagaggtactatttaaattactttactgtgtgtcatgttaaagaggcactatttaaattactttactttgccggcgcagtggctcatgcctgtaatcccagcactttgggaggctgaggcaggcggatcaccccaggtcaggagttcaagaccagcctgaccaaaatgatgaaaccccgtatctactaaaaatacaaaaattagccgggcatggtggcatgcacctgtaatcccagctactcgggaggctgagaaaggataattgcttgaacccaggaggtggaggttgcagtgagctgagattgcgccattgcactccagcctggacaacaagagcgaaactctgtctcaaaataaataaataaataaaaataaaataactttactttgaacaacctcagtcaatgctgggttttttttttttatgagatcacctaacaaaattgggtttttcggagatatcacctaataaaattggtatatcagaagggaaaaaaaggaagataataataatttagtcattcatctcaaaattctaaggttggatgttgctgtaaacaagttatattaaaaaggaattatggccaggcacaccggctcatgcctgtaatcccagcactttgggaggccaaggtgagaggattgcttgagcccaggaagaacttaggcaacacagtgagaccctaggtctacaaaaataaaattaaaaaaaatcagccatgtgtaatggcgtgtgcctgtagtctcagctacttgggaggcagaggtgggaggatcgcttgagcccaggagttcaagggtgcagtgagctacgatcaagtcactgcactcaagcctgggtgacagagtgagaccctgtctcaattttctgttttttaaggattttacaaaggaataagtgaatgaatcatattataggggatgcataagatgcaggatgaattaaaaaaccaacttgtcctggccgggcctagtggctcatgcctgtaatcccagcactttgggaggccgagacgggcggatcacgaggtcaggagatcgagaccatcctggctaacatggtgaaaccccgtctctactaaaaacacaaaatattagccgggcgtggtggtgggcacctgtagtcccagctactcgggaggctgaggcaggagaatggcgtgaacctgggaggtggagcttgcggtgagccaatattgcgccactgcactccagcctgggggacagagcaagactccgtctcaaaaaaaaaaaaaaaaaaaaaaaatttgtcctaatgttaccctaacagattttcctggtttaggataaaatttccagtcacaatgccacacacttaaaagtaaataaagatgttgtactctggaaaaccttgttagactgactcaaaaattggcctgtaattccagcacttagggaggctgaggcaagaggattgtttgagcacaagagttcaagaccagactaggcaacatagtgagaacttgtctctacaaaagtatttaaaaattagccatgtatgtggcacacacctgtggtctcagctacttgggaggctgaggtacaagaatcacttgagcccaggaggtcaaggttgcagtgagctgtgatcactgtacctagcctgggcaataaagcaagaccttgtcttgagggagaaaaaaaaaagtggctcaaatgtgacaaagacactaaagttaaaggtgtatgtaaagtgtttgaataaaatgttcattaaatatctctgttaatagattacatatgaggcttttaacatgtagatataatcaaattaatatattaaataatatagtcatttgaccatttcatctctatccctagacatttatgtatacataagttgtccacaatttcctcagatacagatggagaaatcagaggtcacttataatcaaagttgctttgtattgatgcatatatactcaccaaaggaattgcactatatgaccatgactttacaactaaggagtaaaatgataaataatttaacatctatgaagcacctacaatacaacagaccttgcactatcagcattcacataaagaatttcatttaatttccactcaatactgtgagatgggcatttgaggacttgcctatggtcacagactagtatgtagcaaaatataaactcaaacctaatctctctggcctcggagtctactttcattctaccgaagtattagtaagcttcactttggaagaagctctatttcccccagtgcacctaaaaagattacatttatctgtctacctgagtatggccacttcgctttgttagcttcactctagtttggtccaggcagggtacatccccataacggtttttctctaggtttcctggagacctgaaggaaacgaaacaaacaagcaagaataaagaaaaagtggggacagtatgtatgtacaaaatctgaccatgctaaaggggtgtcaattactcttaggggtggagacatggaagcttttcaatttctagcccatacagttccatatcatttaacattttttgtggtaagtacatactacttctaaaagtaaacatatctccattcaaaagagagagggagaccaggcatggtggctcacacctgtagtcccagcactttgggaggcaggaggattgcttgaggccaggagttcgtgagcagtctgggaaatgtaatgagagcttatctcttttttttttgagacggagtctcgctctgttgcccaggctggagtgcagtagcgtgatctcgactcactgcaagctctacctcctgggttcacgccattctcctgcttcagcctcctgagtagctgggactacaggctcccgccaccacgcccagctaatttttttgtatttttagtagagacggggtttcaccatgttagccaggatggtctcgatctcctgacctcatgatctgcccgcctcggcctcccaaagtgttgggattacaggcatgagccactgcgccctgcctaatgagaggttatctctagagagaagtcaaaaaattagccgggcatcatggcacacacctgtactcctagctgctcaggagtctaaggtgggaggacggcttcagcccaggaagtcaaggctgcagtgcgctatgacagcgccactgcacaccagcctgggtgacggagagaaaccctgacttaaaaaaaagagaagctgggtgtggtggctcatgcctgtaatcccagcactttgggaggccaaggcgggtggatcacctggggtcaggggttcaagaccagactggccaagatgataaaaccctgcctttactaaaaatacaaaaattagccaggtgtgatggcacacacctgtaatcccagctactcaggaggctgagccaggagaatcgcttgaacctgggaggtggaggatgcagtgagccaacatcacaccactgcactccagcctgagtgacaaagcaagactttatctcaaaaaaaaaaaaaaataattaaatttaaaaacagagagaaggagtggggatgggagtcccaaatggccaaggcagaaattggtactaagaagtggggtgcttctgtaacaaataactaaaaatgtggaagcagctttggacctgggtaatggacagagctgatagaatttggaagtacatgcagaaaaagcctatgttgccataaacaggcataaaaggcaattctactatgggctcagaaaaagaagagctatagagaaagcctcagtcttcttagagattacctaagtgatactgatcagaaaactggtagaaatatgggtggtaaaatccattttgatgaggtctcagacagagatgaggagcacattagtaaaaagagagagagggagagaaggggagagaaatggggtataccaccaaaaaactccagctgcagataaaaatttctactacttatttgtcaaaagatgttcaaaccaaatctcttcaattccaatttcattttctttttgggacagggtctcaaaggtctccagggtcgcccaggctggagtccagtggcacaatcacagctcacttgcagccttaatctccctgggctcagtcccagatgcacaccaccacgcccagctaatttttaaattttttgtagagaaagggttttgccacattgcccaggctggtctcaaactcctgggctcaagcaatcctcccgcctcagcctcccaaagtgctgggattataggtgtgagtcaccgagcctgaccttaaatgccagtttaacatggtaggttgataacacatattgactgcactccattcatccagtagcttcactaaaatgatgaaaaaggagtattcactacaaacccaaaaagtgacagtggagacatcagcacacaaagagtgttcaactcattttgacagagaaaaagcagataggaggattttggctgacgtggccagacacagaagctaggaccaagggaggtacctatagagagacaagatggcacacccttagaactcccttaccatggaaagcaaggtgaggaacagagctaaaaatgggaataaaatgaaaatctgaatgttatgtagtgaaaatccctgacccattctcattgtcctgacctacactcatatccaagtttggatcccctcagcggatccaaaggacaggagaactcttcactggataaagtaaacagcatcaggtgaaagaattctgtcatttggagaatacccaacaaaaagctagttgtctgatcattataatctgaagctcatccatgcaaaacgagcttccatgcagcttgtttttgtttttgttcatcactgtctgcttttgtaaccatgcagcttttaaggaccataaatgtgaactaaaagccaaggatctcaatgtaattaaggaaagcccttacacaaagactttaatacacaattcaaataacacaattcaggcttgtcacggtggctcatgcctgtaatcctaactctttgggagggccaaggtgggaggatcacttgagctcaggagttcaagaccagcctgggcaacatagcaagaccttgtctctactaaaaattaaaaaaattagctgggcatggaggtacaaacctgtagtcccggctattcaggaagctgaggtaggaggatcacctaagcttgggagacagaagctgcagtgagctatgattgcatccctgcactccaccctgggtgacaaagtgagaccctgtctcaaaatcaaacaaaaaataaacaaacaaaaaaacccataattcaaacacatgggggctacagaagtttaaaaaaaaagatagtcaataagagaaaagtaacctctaaaaggctatcattaatatcctcaaagagaaaatagatgatacaattatacataaaacaagaagagagtgcaatgaaaaaggaacagagaagaaaagctcttggaaattaaaaataatatccaaaataggaattttaatagacgagataaaagagaaagttgaggaaatttccagaatacaaaacaaaacaaaaaaagtgatgaaaatatgagaaaaactggccaggcacagtagctcatgcctgttatcccagcactttgggaggctggggtggacggattacttgaggtcagaagtttaagaccagcctggccaacatgttgaaactcgtctctactaaaaatacaaaaatcagcagggcatggtggcacacgctttgtagtcccagctactcgggaggctgaggcatgagaattgcttgaacacgggaaatggaggttgcagtgagctgaaattgcgccactgtactccagcctgggcaacagagcgagactccgtctcattaaaaaaaaaagaaagaaagaaaaagaaaatatgagaaagatgaagaaagttaagagaatcattctgggacacaagtcagcaaactatgccctggccacttgtttttgtaaatgaagttttactggaacacagtcaagcccatttatttctgtactcactaagtatatattgacagtgttgagtcagtaaactatgccctggctacttgtttttgtaaataatgttttattggaacatagtcaagctcatttatttctgtactcactaagtatattttgacagcgttgagtacttgtaacaaagactgtaaacctcacaataccgaaatatttactatcttaccctttaagaaaaagtttatcaatcccatatatatatatatatatatatataaaatctatatatttacatatagagagagagcgcgagcgagaactaacataatacaaggaaagaaatcatttaaaacacagtgtaataagaaaagccctagaactaaataacaaaccttcagattaaaagaatctatcaagtaaccaatgtaataaattttaaaagaggacctacactaaggcacatcattgtgaatctttttttttgcagggggtggacagagtctcgctctgtcccccagactggagtgcagtggcacaatcttggctcactgcaacctccgcctcccaggttcaagggattcttctgcctcagcctcccgagtagctgggattacaggagcctgccaccatacctggctaatttttatatttttagcagagacggggtttcgccatgttggccaggctggtcttgaactcctcacctcaggtgatctgccctcctcagcctcccaaagtgctggggttacaggcttgagccactgtgcccagcctctctcaatccttttaaatgatctattgtttttctttttccttccctgggcattttaaagataatttctttttctgtttaagaaatttagactgggtgcaatggctcactcctgcaatcccagcactttgggaggccaaggagggcagatctcctgaagtcaggagtttgagaccagcctggccaacatggtgaaactccgtttctaccacaaatacaaaaattagccaggcatgatggcacacgcctgtagtcccagctactcaggaggctgaggcaggagaatcacttgaacccagaaggtggaggttgcggtgagctgagattgtgccactgcactccagcctgggtggcagagtgagaccccatcttaaataaataaataaataataaatagattgagaaagaataagatcagacaattcacagacagcatcactagtaattggaaaggcattgccttaaaaattctgagataaagttatttctaacctagagttctatactccagcaaaatagaataaaagaaagaagatggtctacaattaggaaacaagatccaacaaaggaaagagggaaaactgcaagataaaaactgaggaacaagcctagagaataaccaaccacagtttagactagaatgaaagaaaaagttctgaaagtgaggtctcaggaaaaaaaaaatagatgcaattgattatctgatacattcaatcacttggaaactaatgataacactgtaaaataaatctgattgggcatatagaaaaataatgaagggccaagcacggtggctcacacctacaatcccagcactttgggaggccaaggtgggcagatcacttgaggtcaggagttcgaaaccagcctagccaacatagtgaaaccatgtctctactaaaaataacaaaaaacattagctgggcaaggtggcaggtgcctataatcccagctactcaggaggctgagatatgagaatcgcttgaacccagggtgtggaggttgcagtgagccgagatcgcgccactacactccagcctgggcaacatcaaaacaacaaccacaacaacaaaacaaaacaacaacaacaacaataaaaaacaaaagaaaaagaatgaggaacatatacagaaaactaaaggaaatgaaaaaatctggtaattaactccagaagaaacaaaaaattgaattgataagatcattaggccaggtgtagtggctcattcctgtaatcccagtattttgggaggctgaggcaggtggactgcctgagctcaggagtttgggaccagcctgggcaacatggcgaaaccccatctctaccaaaaatacaaaaaattagccagacgtggtgaagcatgcctgtggtcccagctactctggaggctgaggtgagagaattgcttgagtttgggaagcagaggttgcagtgagctgagatagagccactgtactccaacctgggtgagagagtgagagcctgtctcaaaaaaaaaaaaaaaggctggacgtagtggttcacacctgtaatcccagcactttgggaggccgaggcaggtgaatcacttgaggccaggattttgagaccagcctggccaacatggtgaaatcccatctgttctaaaaattaaaaaaaaaaaaaaaattgttaatatatttgatcatttcatagtagcccatgtagctctccagtaaaaataatttacatagtcataataatgtacaatgacgattcaatttaagaatgttacatataattattggaagagtagtcaaaatgaaagtggagacatagtataagagctaaatgagcacctacaataaaagtcactaaaagtattattaacttttttttttttttttgagacagggtctcgctctgtattccaagctggagtccagtggcacaattttggctcactgcagcctcaacgtcccaggctcaagtgagcttcccacctcagcctcccaagtagctgggattacaaacacacgccaccacaccaagctaatttttgtaatttttgtagagacagggtttccacctgtctctacatgttgctcaggctggtcttgaaatcctaggctcaaacgatctacccacctcagcctcccaaagtgctgggattacaggcatgagccactgtgcctggcatattataagcattttaatttagaattagggatgaaataccaggggaaacagctacaagagttgaatacatgattataggtaatggaactgagggtaaaataggaatttgctatttattttgtcattgcttgtcttctttagaactgtttggttttgaaaaaaattatttgcatatattaactgaaagcaaagaaattacaaaggtcacacatataaaataatactctatattgttcatgagtgcttatgcatatataacagtataaacaaaatcaactagaaagaaatatcatattcatactagtagctgcttatgatgagtggggagaactaaggatgcggattagaaggaatttcaactttataataaattctttctctcatataataattaaaaagacagctgggcacagtggctcatgcctaaaatcctagtgctttgggaggctgaggtgggagaatcacttgagcccaggagtttgagaccagcctgggcaacagagcaagactccatctctacaaaaacttcaaaaaaattagcaaggtgtggcaccccatacttcttgtcccagctactaggaaggctaaggcaagaaaatcacttgagcccaggaggttaaggctgccataagctatgacagtgccactgcacctgcactccaacctatgcgacagagcaagaacacatgtctctcttaaaaagaaagaaaaaggccaggtgtgggggctcatgcctgtaattccagcactttaggaggccaaggtgggtggatcacctgacgtgaggagctcgagaccactctgaccaacatggcgaaaccccgtctctatgaaaaatacaaaaaattagctgggcttggtagcgggcacctgtaatcccagctacttgggaggctaaggcaggagaatcgcttgaacccaggaggcggaggttgcagtgagctgaagtcacaccattgcactccagcctgggcaacaagagcaaaactctgtctcaaaaaaaaaaaaaaaaagatgaagcaaatataacaaaatattaacaagagtcagtgttgattctgtggtaggaacatagttgtctgtaaaatcttaaaaaatttcagcccagcgcagtggctcatgcctgtaatcccagcactttgggaggctgaggctggcggatcacctgaggtcaggagttggagaccagcctagtcaatatggtgaaaccccatctttactaaaaatacaaaaaaaaaaattagctgggcgtggtagcaggcacctgtaatcccagctacttgggagactgaggcgggagatcacttgaacccatgaggcggaggttgcagcgagctgagatcacgccactgaactccagcctgggcgacagagcgagaccacatctcagagaaatatatatatatatttctcccttcctatacgaatatgcctagtgaataaaaccaatcctaaaagattacatacagtatgtatgtaatttttttacattttatgtaatgttacttgatataacaacaatttggaaaggacaaaattagagaaatggagaatagattagtggttgcaggggttaggaatggggaggtggtgggaaggaggtatatgtttactatagggcaatgaggctgggcacggtggctcacacctgtaatcccagcactttgggaggccgaggtgagtggatcacctgaggtcaggagtttgagatcagcctggccaacatggtgaaaccctgactgtagtaaaaatacaaaaattcgtcaggcatggtggtgcacgcctgtaatcccagctacttgggaggctgaggcaggagaatcgcttgaacctgggaggcagaggttacagggagctgagattgcaccacagcactccagcttgggtgacagagcaagactctgtcttaaaaaaataagtaaataaaaataaaaatattgatcgcttctcagtcttttggctaagatcaagtgtaaaataaaaataatgaagggcaacgaggggagccttgtggtgacagaactctgtatcttgattatggtgacagatacacaaacctacatgtgtgacaaaactgcacagaactaaatacacaaaaatgaagtaaaactggggaagtctaaatcagattggtggattgtatctatattaacattctggctgtgatattacactatagttttggaagatgttatcatgggataactgtagaaagggtacatgtaatctgtctccattatttcttacaactgcaggtgaatctacaattataagaaaaagtaaaaagagaaaagggaaagaaagtctcttggtccaggggaatcctgggcaagagtgaatatacactgatagccacttcataatccagaattccaagggagacacagtttgttctttgtaagtagctctactgggagttggtgtaagtcagaggcttggagctgatgaggattctaggttctaaatcataaagtggggaatcagtcattcaataggcaagactaggaagtcctctcattagatgagagatctgttctctgattgtcaaatggtagctggtttggatgatggcaacaagacgatctaaacccacttttttttttttttttttttttttgagacagagtcttgctctatcgcccaggctggagtgcggtggcatgatcttggctcacagcaacctccgcctcctgggctcaagtgattctcctgcctcagcctcccaagtagctgggactacaggtgcgtgccaccacacccagctaatttttgtattattagaagagacggggtttcaccatgttggccaggatgttctcaatctcttgacctcgtgatctgccagcctcaacctcccaaagtgctgcgattacaggcgtgagccaccgcgcccagccaaacccacttttttaatggaggaggggagactccatagtagaaatgacatctcaagggcctcacagcagctggtagttgcaaaagcaccgagagcaaggtgaagaatccccaggataagtgtgcatcctcttagatcagcctagcatgcctccctgctccaacatatttccttgattcaagactgcaagggaggctgggcatagtggctcatgcctgtaatcccagcactttgcagggctgaggtgggcagatcacttgaggtcaggagttcgagatcagcctggccaacatggcaaaaccccatctctactaaaaatacacaaattaggccaggcatggtggctcacgcctgtaatcctagcactttgggaagccaaggaggacgaatcacccgaggtcaggagtttgagaccagcctggccaacacagtgaaaccccatctctactaaaaatacaaaattaaccgggtgtggtggcacacgcctgtaatcccagctactcaggaggctgaggcaggagaattgcttgagccgggagatggaggttgcagtgggctgagatcgtggcactgcactctagcctggccgagagtgagactctgtctcaaaataaataaataaataaataaacaaacatacatacacacacacacacacacacacacacatatatatacacacacaaattagttgggtgtggtggcacacacctgtaattccatctacttgggagactaaggcacagaatggcttgaacccacaaggcggaggttgcagtgggccgaaatcataccattgcactccagcctgggtgatggagtgagactgtctcaacaacaacaaaaaagactttaagggaataactgttctgtttgcaaaagagattggatataaacagggagtctggtagttgggtataggtagcacccataattccagcactttggaaggctgaggcaggaggatcacttgagcccaggggttcaagaccagcctgggcaacatagggagactctacaaaaaatttaaaaaattagccaggcatggtggtgcatgtctgtggtctcagctactcaagaggctgaggcaggaggatcaattgagcatcaagagatggaggctgcagtgagccatgatcatgccactatgcgccagtctgggggacagagcaagaccctgtctctaaaaaaaataataataataaaataataaatacaataagtaaaatgaaataaaaattaaataaaaataggggtctggagctggtagggaagaaacagagctgtatgagagaaaagaataatttcccttgttgatatatggtctgtgtcccctttttctcctcttattttcctttgcattcttgatctgattgacttctttctcaagtgcctcttatctcttactttccctatctcattattttccccaactcattattttccctctttgctttgctaaaagactctatccctgcatcttattcagaacacactgactacactggacaggagttacaagagagaagaggtactcacagaatcctagatttctaaaacatttaagctacaaaggtaggtgaatatcagagtccagtagtcacatattatacagaggaaaaccaaagtgctgagaagggaaataacttgtgtcactcacagagggaatttttggttaagttggaatatgaggctgggacccactaggatggcttccctcattttctttcttttttttttttcctcttcttttctttctttctttttttttttttttccttagacaaagtcttactctgtcacttaggctggagctcagtggcgtgatcataactcactgtggtcttgacctcccgggctcaagtgatcctcctgcatagctgggacaacaggagtgtgccaccatgcctggctaattttttcgttttttatttttgtagaggtagggtcttgctatgctgctcaggttagtctcaaactcctgggcacaaatgatcctcctatacctttactcccaaagtgctgggattataggcatgagccactgcccccagccctagtttctgtagttttcaacagtcacagctcactagctggagagaaagagatttctggggcagccaattaaaacatggtaagagaaatgacagcaacatggtaagagaaataatctgaccaggtgcggtggctcacacctgtaatcccaacactttgggaggttgaggcaggaggatcacttgagcctcggagtttgagaccagcctgggcaacatgccaaaaccccatctcttcaaaaaataaaaaatgagctggacatagtggcacatacctgtagtcccagctactcaggaggctgaagtaggaggatcgctttaacctaggaatttgaggaaaagaaaaggataaaagaaaagaaaaggagaagagaagaagaaaagaagagaagagaaaaaagaaaaagaggccaggtgcggtagatcatacctgtaatcccagcacttcgggaggctgaggcaggcagatcacctgaggtcaggagttcaagatcaacctggacaacatcgtgaaaccctgtctctactaaaaatacaaaaattagccaggcatggtggtgcgcgcctataattccagctacttgggagggtgaggcaggaagaatcgcttgaacctgggaggcggaggttgcagtgagccgagatcgtgccattgcactccagcctgggtgacagaacgagactccatctcagaaagaaaaaaaaaagagagggagggaggaaggaaggaattacaggtgtgcgccaccacacccagctaatttgtgtgtgggtgtgtatatatatatgtatgtatgtatatatagttatcaactagttacgagccagagttataaactagcgagatggttttgtgataggatttgagtagaatgaaaatctcaaggggttaaagtcctatgaggcaactgtactctctgactgtggattattttaagtgtaccacatacccctcctcaagaagtaatgttataccataaatgttatggggagaaactgcccaaatgaacagaccagcactcacactgagtactggaatagagagtagcctattttgaacctactttttttaaaaaaaacttgcatttcagaaaaatatccaaaaatatgtccaacagggttatcctgttggtaccaaagaccttcagaaatttcagagcataggatgttagcaagaagcacccaatggtgcccaggctggagtgcagtggcgtgatctcagctcactacaacctccatctcccagccgcctgccttggcctcccaaagtgccgagattgcagcctctgcccggccaccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgcctcttcccggcagccatcccatctgggaagtgaggagcatctctgcccggccgcccatcgtctgagatgtggggagcgcctctgccccgctgccccgtctgggatgtgaggagctcctctgcccggtcgcgaccccgtctgggaggtgaggagcgtctctgcccagccgccccgtctgagaagtgaggagaccctccgcccagcatccgccccatctgagaagtgaggagcccctccgcccggcagccgccccgtctgagaagtgaggagtccctctgcccggcagccaccccgtctgggaagtgaggagcgtctccgcccggcagccgccccgtccgggagggaggtgggggggtcagccccccgcccggccagccgctccgtccgggagggaggtgggggggtcagccccccgcccggccagccgccccgtccgggaggtgaggggcgcctctgcccagccgcccctactgggaagtgaggagcccctctgcctggccagccaccccgtccgggagggaggtgggggagtcagcccccaacccggccagccgccccatccgggagggaggtggggggggggtcagccccccgtccgggagggaggtgggggggtcagccccccgcccggccagccgccccgtccgggagggaggtgagggggggtcagccctccgcccggccagccgccccgtccgggagggaggtggggtcagccccccgcccggccagccgccccgtccgggaggtgaggggcgcctctgcccagccgcccctactgggaagtgaggagcccctctgccgggccagccgccccgtccgggagggaggtggggggctcagccccccgcccggccagccgacccgtccgggagggaggtggggggatcagcaccccgcccggacagccgccccgtccgggagggaggtggggaggtcagccccccgcccggacagccgccccgtccgggagggaggtgggggggtcagccccatgtccgggagggaggtcgggggggtcagccccccgcccggccagccgccccgtccgggagggaggtgaggtcagccccctgcccggccagccgccccgtccgggaggtgaggggcgcctctgcccagccgcccctactgggaagtgaggagcccctctgccgggccagccaccccgtccgggagggaggtggggggctcagccccccgcccggccagccgacccgtccgggagggaggtggggggatcagccccccgcccggccagccgcccggtccgggagggaggtggaggggtcagccccacgtccgggagggaggtggggggggtcagccccccgcccagccagccgccccgtccaggaggtgaggggcgcctctgccctgccgcccctactgggaagtgaggagcccctctgcccggccagccgccccgtctgggagggaggtgggggggtcagccccccgcccggccagccgccctgtccgggagggaggtgggggggtcagccccccgcccgggaggtgaggggcgcctctgcccggccgcccctactgggaagtgaggagcccctctgcccggccagccgccccgtccgggagggaggtgggggggtcagccccccgcctggccagccgccccgtccgggagggaggtgggggggtctggccagccaccccgtccgggaggtgaggggcacctctgcccagccacccctactaggaagtgaggagcccctctgcccagccaccacctcgtctgggaggtgtacccaacagctcattgagaacgggccaggatgacaatggcggttttgtggaatagaaaggggggaaaggtggggaaaagattgagaaatcggatggttgccgtgtctgtgtagaaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaatttaaaaaaaaaagaaaaaaaaaaagaagcaccaaagcagaaagtacctctttctgcatgcgagaaaccatcatttatgtgagagtgatgttccctaacataaggaagggtctctgctaagcaagtgaggggtggaaggagctgttgccagagcctaccagaagcatcctggtaaccagctgctggcccaaactttttctacttacatggaacagtggaaagtgccaacagggttctcacgacgaatgtcttcatattcctcatagattccttgcttttgcctggcattaacatagtccaccaactcttggatggtcatagcatggggacctggaacatgtactgagtcccagtctaaggcaggagggagggagaacaggatgatctcatcgaagggatctgggtggccgttcacctggggtaggaactggaaattccaagtggcgagatcaattttgacgtacccacccaggttttctggaagacactccctgggcagatgctgcgtgacctcagatgtctttaatatttgaatctggaaggttagaaagaaccatgtgagtatgtgggaggagggaaaggcatatagagtgacaaagaataaatgtatttatatcaggtttggaggatgggataagattttcttgaaatacaaggtatacttgtaaaagtagtagactacatttcatctgcctgagatttaagtcctatgaatttgccagataaaagtgtgaactcccagaatgtatataaaattcactcctggaattagggacactgttatacatcttctgaaaggacgatgtagtgaacaaaagctttatattattaacaaggcttcccagcatcgctgcatgctggtactctttttttggccactaagaatgcataggtagtagttatttttgtcaaccccatactcagacaaccaattctaaggcctgttagcttgtattttactcagcttggtataactgttcacaaagataggattctatgaaagcaagacacccagaggcagggtagcccaggaaaaatgtgagataacactttttttttgagacagggtctcactttttcacccagcctggagtgtagtggcgtgatgaaggctcactgcagcctcaacctcctgggctcaagtgatccttccacctcagcccctcaagtagctgggaatacagatgcacacaaccacgcccagctaattttttgtagtaaccataaaacttaattctgctctctgcttggacatagccatgctggaactaattagcttaactggttctccttaggatctctgtggaatggggattctcttcctcctaaaagctcatctcttttgctgtcgcctcttcttggaatgccttcctttcctcctctgcctcttcatggaccagcacagctcacctcttctgtgaagtctttcctgactgcctgaggccatatgctcctctgcgttcctgcagagccaaagtcctcctatgtgtatctctgtgttccctatcaagaccatgagctccttgagggtagactgtctcacttaatttttaattatcaggaaccagtgcttcgactacaaaaagtgcttaatatattttgagtttatacatgcatgtataattcctataattcaagtgcaagaacttgcctatggattcctctcaaagagttaccttagaaaagatctctccagctggcacggtggctcatgcctataatcccagcactttgggaggctgaggcaggtggatcacctgaggtcaggagtttgagaccagcctgtccaacatggtgaaaccccatctctactaaaaaaatacaagaattagctgggcatgttggcaggagcctgtaatcccagctacttgggaggctgaggcaggagaatcacttgaacccgggggacggaggttgcagtgagccaagatcatgccattgcactctagcctcagcgacaacagcaaaactctgtcgcaaaaaaaaaaaaaaaaaaagaaagaaaagatctctcctggctgggcacggtggcttatgcctgtaatcccagcacttttgggaggctgaggtgggtggatcacgaggtcagaagatcaagaccatcctggctaacacagtgaaactccgtctctactaaaaacacaaaaaattagccgggcgtgacagcacacgcctgtagtcccagctactagggaggctgaggcaggagaatggtttgaacctgggaggcggagcttgcagtgagccgagatcgcttcactgcactccagcctgggagacagagcgagactccgtctcaaaaaaggtggctcacgcttgtaatcccagcactttgggaggctgaggtgggcggatcatgaggtcaggagttcgagaccagcctggccaatatggtgaaacaccgtctctactaaaaatacaaaaattagctgggtgtggtagcgtgcgcctgtactcccagctactcaggaggctgaggcagaagaatcgcttgaactcaggaggcggggctgcagtgagccaagatcgtgccactgcactccagcctaggcaacagagtgagacactctcaaaaaaaaaaaaaaaaaaaaaaaaagaaaagctctctcctactctgcgtcattaggtctctaagcagcttccacagaaccaaatgttttcactttcatgtcctgtcttttaattgctgcaatcagtaactgagaccataaatcttttaatcatggaacacgcaggagattataacagaattaaagtttctggttttattgtggcggcggggtctcactgtgttgcctaggctggtctcaaactcctggcctcaagcgatcttcccgccttggcctcggactcccaaagtgttagtattataagcatgagccattacacttggcccagaattaaagtaattttgaacgcttttgaaattgggaagcaacaaggtattctgagaaaaaaaaatgccaggaataaatgtagaaagagacataacgaaaaactttcctccacaaccctggtggtcaagggattgaatgatgtttccagttgaacaaattctaatgccagttcaactaatgcagttatattacaagctgttaaatattaaaggcctatgcagcactaggataaattttggaagtagcagctatccctaagttacctccaggacacgttccttcagtactatcttatgcaaggtgctatagaaagtgagaaccagataaactgtgtttagttttgaacttcaagaagctcgtaggacagtaagagaggcagtctgtattgaactgactaatgcatcaggtagagaatataagtgaatgcactaacagaagcagaacaggctctagaagacacgccaggaggattttttgaaggtagaaaattaattggcaggaattcactgtatctattcacctccagataaaaaagggcaagcttgccttaccctctcccggactttgtccttcaggaggagactgatgatggaatagggcactcggaaccatatgggtgcccccacaatcagcaccttcttcaaacgagctggaaatgctccctgtggagaaaacacatgaggatttaagtgtaatggaacctgtgactcttcaagcccaagtttaggttttctgctcttctccccattcttacccagcagggggagtctacagcctaattcaggtttgatctcagcagctagaggaaaagtggttaaacaaactgaagaaattagaagctgatttacctttaaaaataacaatgttaagttcttgtctaccgtaagctttatggatcaaaaactattctgacttctcatctcaacagatatcctacacataccacacatcagcatacatatatgcctcttaaaaaagttatgttattaaaacttgaaggaaaaatgagatcatgaataaactgaacattaaacatttctcgaccaggtgcggtggctcatgcctataatcccagcattatgggaggccgaggtgggtggatcaccagaggttgggagttcaagaccagcctggccaacatggtaaaacccatcactactaaaaatacaaaattagccaggcacggtggcagacacctgtaatcccaactactcagaaggctgaggtaggagaatcacttgaacccaggaagcagaggctgcagtgagttgagatcaagccattgcactttaccctgggcaacaagagtgaaactctgtctcaaaaaaaataatatggctgggcacagtggctcacgcctgtaatcccagcacttctggaagctgaggcgggcagatcacttgatgtcaggagtttgagaccagcctggccaacatggtgaaaccccatctctactaaaaatacaaagattagccgggcatggtggcatgtgcctgtaatccctgctactcgggaggctaaggcaggagaatcgcttgaacccaggaagtggaggttgcagtaagccaagatcgcaccactgcactccagcctgggcgacaagagcgaaactccatctcaaaattttaacaataataaataaaaatttaaaaattttaaaaatttctctttcataacttttcattcagtctgatgtatgcataatctttttttaatctattcattcatctatgtatttaccaatcaataatctaatgtgcactatggcaaatgagatctaaaaaaaggagatatcctcatccacacaagatataaagatgaaaaaatcattcattcctaatccacagtgcttagtttttttgtttgcttggctgctctgtttttgttttgtattgtttttgagacaggatcttgctgttgcccaggctggagtgcagtggcacaatcgccactcactgagtcctgtacctcccaggctcaaatgatcctcccacctcaggctcccaagtaactgggactgcgccactacacttggctaatttttgtatttttagtagagacagggtttcaccatgttggccggctggtttcgaactcctgatctcaagtgatcctcctaccttggcatcccagagtgctgggattataggcattgagccactgctcctggcgtgaagttcttaattttcaaatggttaaatgtattactgttttcttttctggttagtgtgttgtgtgtcttaaatccttttctattttaatgtcagaaaaagtacttttttttttttttactgctgtaccaccgattccaccaatgtgtattaatttttctaatttggttttttattgtaaaatatacacaacaaaattgaccttttaaaccattttaagtgtacaattattggcgttaagtatgttcacaatgcagccatcaccactattcattttcagaactatttcatcatcacaaacaaaaaccctgtacccattaaataacatctccctattcccttctccccctagtccctagtaaccttggttctactttctgtctctatgaatttgcctattttaggtcctcgtattattggaatcctactatatttgtccttttttgtcttgtttatcctacttagcataatgttttcaaggttaatccatattgtagcatgtctcagaattacattgctttctaaggctgaataatatttcctcataaatataccacatttttcttatctattaatccgttgatggacatttgggttgtttccacttgtacacattggttgtttccacttgtccagatttgaggagctattttccacattgtttccacttgtccacatttgaggagctattttcttttaaaaatttaaacttttgtttttgtcctttttttttgagacaagttctcactctgttgcccaggctggagtacgatggcaccatcatggctcactgtagccttgaccacccaggctcaagtgatcctcctacctcagcctcgcaagtagcatgtgccaccatgcctgtctaattttgtatttttgtagaataaaaatacaaatggtttcatcgtgttgcccaggctggtttcaaactactgggttcaagcaatctgcctgccttggcctcccagtgttgggattccaggtgtgagcctccatgcctggcctgtttttgctatttaagactttaacctatctgaagttgatttttgaacatggtatgagatgtaggaatctgacatttttttctatatgggtagctgttttgttttccacctttacatattaaaaagtcccgtctttccccaacttagactttctatttgtcagttttaacaaagtcacaatatcctggggaataaatatgacataggtaatttaattaaccatgtaaccatcattctgattattcagtttgttttcaggcctaaataatcctgatatgctcattttatcttttccttttaattttttttttgagactcactttaatattttttttttttttagtctcacttggtcacccaagctggagtgtagtggcacgatatctgctcaagggttcaaccaattctcctgcttcagcctcccgagtagctgggattacgggcgtgtgccatcacgcctggctaacttttttgtatttttagcagagatgggttttcaccatgttggccaggctggtctcgaactcctggcctcaagtgatccgcccatcttggcctttcaaagtgctgggattacaggcatgagccactgtacccggcctccttttaaattattttaagaagctgtttctaagactgggattatttggctaaagattatgaatattctttttttttttttaagacagggttttatcaactgggctggaatgcaatcatatgatcatagctcactgcagcctcatatcctgggctcaagtgatcctcctgcctcagcctcctgggtagctgggatgataggcacacaccaccacatgcagctaaattttgtacagtcagggtcttgctacgtggcctagactggtcctgaactcctggccttaggcaattctcccacctcagcctcccaaagggctgagattatagatttaagtcactggagccagcttaaggtattatttttaattatctaaaataaatgtgcagtaaatactctttttatattttcctgattgtttccttagcatataatctcagaaatacaactgatcaaagggtatgtgcatttttaaggatttataatgccagatgccttccaaaaggtgttaacgacttactgaactgacagtatatgagggtgctatacagtcatttatttatttgaaaaacaaacaaatctttattgtctagaaatatatatttttaaaatcccccagaaaagacgctattctctcatttccccatcctcttcctcttccacacctctgagacaaaggacattattatactttagtaaaacttcatccagatgtccagacaataccccaactatgtattcttctgtatttgcaagctacatgttcttatagatacatctgtagatctggttcatctacagataccagttagcctttgtaatccattcgccacttaagtttcactgtcactggcttttctgttaatcccttgaggaaaggtttgggattgaggggtaaatcctttataaccacaggagaatgctgcaggctattcgctgctgaccaagctgccacccatccctggtgactgcagcaggtacccccagacagtcatgtaaatagactaggcccaggtctgcagttctttgctctgaaaaaagagacgtaatagcttctactttttatttatcattttgtggaaataacaggtgttttcctagaatggtttttgatttgctggtaaaaggaccttggacatttaggtcctgaaataaattgttgcatctttgaaggaaaagatgaaagtagtttatcacacttcagtgaagaggcctttggagaagtttgttctagatgctgtatattctccatagaggagtgctggggtttctccaaatcagtagaactaaagggtaactgaagagaacagagtgacatgtcagattgagaatcagtcttttgaggctgggcgtggtggatcacacctgtaatcccaggactttgagaggccaaggtggatggatcacttgaggtcaggagttcgagaccagcctggccaacatggtgaaaccccattgctactaaaaatacaaaaattagccgagtgtggtgatgagcacctgtaatcccagctgcttgggaggctgaggcaggagaatcacttgaacccgggaggcggaggctgcagtgagctgagatcaggccattgcgcttcagcctgggggacagagagagactccatctcaaaacaaacaaacaacaaaaaagaatcagtcttttgaaagtggcaaaaagggctgggcacggtggctcacgtctttaatcctagcactctgggaagccaaggctagtggatcacctgaggtcaggagttagagtctagcctggccaacatggcaaaaccccatctccactaaaaatacaaaaattagctaggtgtggtgacgagcacctgtaatcccaactacttgggaaattaaggcaggagaatcgcttgaacctgggaggcggaggttgcagtgagccgagatagcaccactgcactgcatcctgggcaaaagagtgaaacactctgtctcaaaaaaaaaaaaaaaaagaaagaaaagtggcaaaaagaataggctagaagatactagctacaattcctctttttttttttttcttttggatttctcaggaatgatttcttcctagttagaccgccagtgttgcatggtaaccacacccatgaaaagggccggaatattgaaaaactgcatgaaactaagcgctgtgggtcgggcacagtggttcacgcctgtaatcccagcactttgggaggccaaggtggctggattgcttgagctcaggagcttgagaccagcctaggcaccatggtgaaactccatctctacaaaagatacaaaaatcagttgggtgtggtggcacatgcctgtaattctagctacttgggaggttgaggcatgagaactgcttgaacccaggaggtggaggttgcagtgagccaagatcgtgccactgcactcagccttggcaacagagcaagacctggtcttaaaaaaaaggaacttctgttagtcaaagagcttcataaaaagtgaaaaaacaagctataaattaagagacagtttactgtgcgcacacattatatgtgtgtgtgtatatatgtatcttcatggattagaataatatattaaaaactattaatttctaaatggacaaatcataaatagacatttcacagaagaagaaaaaatatatagctaacgaatatatgaagatatagttaatttcactaataaaagaaacgcaagctataccacaagataccatctcatatccatttgattgggaaaaaaattaagaagtctgacattagtaagtgctggagaggatgtagatcaatggaaatcttcacacatggcaagggggtacgactgctttgaaacacagtttgacattgtcttataaagttaaatcttcacagactttaggacccaacaatctactcctaagtgtataccctagagcatgcattctcaatgggggagatatcacctcaccaaaggggtaaaattagtaggagagcagggtgaggtgagccagaataaaaaaaagaaatcgggccaggtgcagtggctcacgcctgtaatcccagcactttgggaggctgaggcgggcagttcacaaggtgaggagatcgagaccatcttggctaacatggtgaaaccccgtctctacttaaaatacaaaaaaattagccgggcgtggtggtgggcgccgtagtcccaactactctggaggctgaggcaggagaacggcgtgaacctgggaggcggagcttgcagtgagccgagatcgtgccactgcactctagcctgggcgacagtgcgagactccgtctcaaaaaaaaaaaaaaaaaaaagaaatcttacactttttatgtatacagagtacataaagaggccaggcacagtggccaacacctataatcccaacactttgggaggccaaggaggcggtactgcttgagcccaggaattcaagaccagcctgggcaacatagcgagactctgtctctatttaaaaaataaggccaggcgcagtggctcacgcctgtaatcccagcactttgggaggccgaggcgggtggatcaccccaggtcaggagtttgagaccagcctggccaacgtggagaaaccccgtctctaccaaaagtacaaaaattggccgggcggggtggcaggcgcctataatcccagctattcaggaggctgaggcaggagaatcatttgaaccgggaggtggaggttgcagtgagccgacatcgcgccaccgcactccagcctgggcgacaagagcaagactccatctcaaaaaacataaaaataaaataaaataaaacaaaataaaataaaaaataaattttaaagagtacatagagatatgcagtatgtttatggtattaaaatttcattagaagaggaattattaggggaaaaaatatttaaaaaggctccttagtgaggcaacaatgaaaaaaggttgagaaacactcccctagagaccctcttacacatatgcaccagaaaacatgtttaagaatgttcataacagcaccattcataacacaggttgggtattccttatccaaaatgcttgggactagaagtgtttcagattttgaatttttttcagattttagaatatctgcatatacataattagatatcttggggatgggacccaagtctaagcaggaaatttatgtatgtttcttcttttttttttttttttttgagacgaagtctcactgtgtcgcccaggctggagtgcagtggcacgatcttggctcactgcaagctccgcctcccggattcacaccattctcctgcctcagcctcccaagtagctgggactacaggcgcctgccaccaggcccggctaatttttttttttttttgtatttttagtagagacagggtttcaccatgttagccaagatggtcttgatctcctgacctcgtgatccgtccgcctcagcctcccaaagtgctgagattactggtgtaagccaccatgcctggcctaaatttatgtatgtttcatacacaccttatacacataagtatgcctcagattcccaaagtgctgggattacaggcgtgagtcatggcacccagcccatcccacttttatgactcagaatgttcctgtgcttttttttttttttttttttttgagacacagtctcgctctgtcgccaggctggagtgcagtggcacaatcccggctcactgcaacctctgcctcccaggttcgagcgattctcctgcctcagcctcccgagtacctgggactataggcacgcgccaccacacccagctaatttttgtgtttttagtagagacagggtttcaccatgttggccaggatggtcttgatctcttgacctcatgatccacccacctcggcctcccaaagtgctgggattacaggcatgagccatggcgcctggccgttcctgtgcattttttacccgaattcctcccatttcacttttaagatcatttcttgttctaaggaagcagagagtagtcatcatttacagatgacctttacattgaacataatgtctgaagtttgcatctttcctaaatcttttcccaaagaattaaaaaaatatatatatcccaagcattgaaggaaacttgagagggccctccatagccttaccttcagcaggtttaggactttcttgccaagatccagctcaaagttggcataattagaaccacacatgtcatagataaacaccagtccattcctctgagtttcaaagctgtaaatcaaccattgaacaaaaacatttgtaagtaagcagatggatgaggcaggttgaaagcctaatgccaaaacaaaacctgagagtatgagacacatctaggatcaaaacaactgcctgactgcacactggtcttacaaaaagatctcttatctttggtatctgctatgtttattaaggcagatttatccagatgtaccaaatgccaaactcgtaggttgagaatgctctacagcaactaagttatcaaaatctgaactgttttctcccacccctctgaatctacctacccaaatcatataacatattccgtactcaaccccaaagtttcctcttccatgaaagtttccctgataactgtaatcaaacatgctaccaattgttttttcccttaaagccccataaatctttctgtggatttttcttgtggccttaataaactctgtatagccatctgattctctcctaaaggacaagaacttgttgttccactcattacgcccaacaatccctagcacagcccttaaaaataaatggtcactgaattgtaattcagtagactggaagcccatctctaagaaaatatttcagacctgtgaaaaactgtgtagaacaaaactgcctctaagctcattgatagtaaatttgtctcttatgaccccatggaggaagagaacaaacccataaatggcctttggaaagcattcctaaaaagtagattaaggctgacatagtggttcatgactgtagtctcagtactttgggaggctaaggatggtggatagcttaagcccaggaatttgagaccaggctgggcaacatgacaatacctcatcatgtagtgacctatagtctcagctacttgggaggctcaggtgggagggtcacttgagcccaggaggtcgaggctacagggaggtcatgccactgcactccagcctgggagacagcgtgagatcttgtcttaagaaaaagtaagactgggcgcagtggctcacgcctgtaatcctagcactttgggaggccaaggcagctggatcgcttgaacccaggagttcaagaccagtctgggcaacatggcaagaccctgactctatttaaaaaaaaaaaaaaaaagagggaaaagaaagaaaaaaaagtagattaacaggtattaatagtaagccatggctgggtgtggtggctcacacctataatcccagcactttgggaggctgaagcaggtggatcacctgaggtcagcagtttgagaccagcctggccaatatggtgaagccccatttctactaaaaatacaaaattagctgggtatggtggcacatgcctgtaatcccaactacttgggaggctgaggcaggagaattgcctgagcccaagaggcagaggttgcagtgaatcgagattgcaccactgcactccagcctgggcaacagagcgagactccatctcaggggaaaaaaaaaaaaaaaaaagtaagcctattcccagaccaaactgaggaacatttgaagatacagaaagtattcctcagtccaatttcccagatttataaagatttctcaaagatgtactcttccaccaagccagatccgtacttatatgtgatctgcagacccaaatggtcattaggataaattatttgattggactactcacagatgacagcaagagttttcacatctatttagaattgagaaaatgtttggcacaaaactcattcctgaaatcaggagtctcaaagttattgttttttgttttgagacagagtttcactcttgtcacccaggctggagtgcaacggcgggatctcggctcactgcaacctccgccgcccgggttcaagcaattcttctgcctcagcctcccgagtagctaggactacaggtgcccaccaccacacttggctaatgtatttttagtagagacggggtttcgccatgttggccaggctggtctcgaactcctgacctcaggtgatccacccacgtcggcctcccaaagtgctgggattacaggcgtgagccactatgcccagcctcaaagttattttgtatcttactatttttgcaccagcacctcctgggaacctccatatcttcatccctttaacaaattccaaggcagaagcacccgcccatgagctaacatttcaaaaatgtctaattctgaggtacatgaaagtttctccagcagacttagtttcaactggcacctaatgtgttacattagtgttaaatctttactcctttttcttatttatttctttacttattttttaatttttagtagagatggggtttcattatgttgcccaggctggtctcaaactcctgacctcaagtgatctgcccccctcggcctcccaaagtgctgggattacaggtgtgagtcactgcgccctgcccttgactcctttttcacaaccccagagagactatgatccacaaaggtccaagatgctgttaaaatgtgtggcacaggacaggtccagtgactcacacctgtaatctcagcactttgggagactgagatgtgaagactgcttgaggccagaagttcgagaccagcctggtcaacagagtgaaactccgcctctacaaaaaaattttaaaattggacgggtttattagtacgtgcctgtggtcccagctccttgggagacagaggcaggaggatcatttgagcccaggagttgaggctgctgtgagttatgatgatgcaactgcacttcagcccgagcaaaagtgagaccctgtctcttaaataaaaagaaacaaagaaaatgtgtggcacaattattgaataggctatccagatctagatactttctatttctccatgagctcctcaagggtcaaattcaaattatgggctttcccctcatgactccaggttgtggcaggggactaaaacaaaaacaagtcagtgagggggcaaagagaatttaaaaaaaaagaagcttggatgcataatgaatgatccaggttctatattcccagatcaaagtgctcatcctgtgaaggcacataaaacatgaatgcagtaagattttcacactttagggtatagaatagatagatagatagatagatagatagatagatagatagatagatgtgtgtgtgtttatatatgtgtgtatatatatacatatacttttttttttttgagacagagttcgcttttgttgcccaggctgaagtgcaatagtgcgatctctgctcactgcaacctccgcccaagttcaagtgattctcctgcctcagcctctcgagtagctaggattacaggcacccaccaccacgcctggctaattttttgtatttttactagagacggggtttcaccatgttggccaggctggtctcaaactcccgacctcaggagatccacccccttggactcccaaagtgctgggactacacgcgtgagccaccagaatatatatatttttaagacagcattttactctgttgcccatgctgtagtgcagtggcacaatcatggcgcactgtagcctcgacctcccagggctcagatgatcctcccagggctcaggtgatcctcccagggctcaggtgatcctcccagttcagccttccgtgagtgtctgggactacaggcaaataccaccatgcctggctgcctaatttttaaactttttgtagagacgaggccttgctatgttgcccaggctggtctcgaacttctgggctcaagcgatcctctcacctggcctcccaaagtgttgggattacaggcatgagccactgcacccagtttaagatttacaatgggccgggcacggtggctcacgcctgtaatcccaacactttgggaggctgaggtgggtggatcacgagctcaggtgatcgagaccatcctggctaacaaggtgaaaccccatctctactaaaaatacaaaaaaaaaaaaaaaaaacgggcgtggtggcaggcgcctgtagtcccagctactcgggaggctgaggcaggagaatggcacgaacccgggagtcggagcttgcagcgagctgagatagcgccactgcactccagcctgggggacagaccgagactccgtctcaaaggaaaaaaaaaataaaaaaaatatttttttaattcttgagctacatgttacagaaaacaccaagaagtttaaaatacagtccctgacattggttttaaaaaaacggagaagccagatgcaatggcttatgcttgtaatcccagcattttgggaggccgagatgggaggattgcttaagtccaggagttcaagactgcagtgagctacaatcatgctactgcactccagcctgggtgacaaaccaagccctagtctcaaaaaacaaaaaagaaagaaactgaggataggagatccatgaggggctaccaatgaaacaagactgttacagatcactttgaagaagacggatgatggatatgtggatgttcacgataccattctctctcaacctacagagattcggatgttaaaaagaaagtttcctgccctcaagaagcgagtggattcatcatgttgcccagggctggtctcaaactcccgggctcagacaatctgcccatctcagccaaccaaagtgctaggattacaggcatgaatcaatgcgcctggcctcaatatagcacttctaatccggaggaccagccaaagatgtcgagagcagtaagaaactgtaaattacaagcaccagggaaaaaggaatagcagaacaacagcatgggaggacagaaataactctgcccaagagtgaagaaaccaggatcttagaaccagctggactaacatatgatgactgtaaaaaacttcttggggcttgagtttaattgtcaattgaattgtaacaataccaattaccttagcaggaagagagtgatgacctgagctggttctttatgcttatgcacctctttttattaaggatggtttttgcttaactttatacttctgggcttctccctgaatgtttttttgttgttgttgtttgttttgtgtgggcttttttgtggggttttttttgagacaggtcttgctgtgtcacccaggctggaatgcagtggcgtgatcatggctcactacagcttcaccattctgggctcaagtgatcctcccacctcagcaacctcccccacctcccccaagaagctgggactaaaggtgcacgctaccacacccagctaattttttgtattttttatcagagacagggtttcaccatgttgtccaggctggtctcaactcctggcttcaagcaatccacctgcttcagcctcccaaagtgctgggattacaggtgtgagccactgcacccagccctcccctgaatgttgagtctcaaaatcctctgaactaaacggcattattcctgttatgcagacaaagaaactgaggccttagaggttctgatatgagcaaaaagaaccagcacaggtcatctccccctcattcttttccaataagtagttttccatacactgaagattgccgataattgactttctcagcttctgttttcctgacatagagccaaggtggtaaagagaacgcccaccatcttgatagtgcctgcaaacatgccgagttctaaaggacatggattgttttctattcatagcattgcccagggcacatcctaggagaatggcgaaggcactgctgaatttaatcaagtaaaaaactgtcactttcctacctgcatgtagaatacctaaaaaataatctcaatgcttacctatccacagctctgtctagcaagtaaaacagagcctgaagtaccacatgttggactgacttgtggggatgatgcaacctggcagtaaagagggcaatggaggctcctgttgggtcccgaacattctaaagcaaataaaacaagaaacattaaaaaaatcaaatagaaaatcacagcaattactaagacttatatactggataagggtttgatacatgtagaaaacagatgctaacaataattccctgacttcaccaattgctgtccaaagggaagagtgttaatatcatcctttgtctgattctcccaggactccctggaccatatttctgtggtaagaaaaaaaaaacacattctctttgctcttcaactacagacagatcaaaggatggctgtgcactggcttcctagctaacttccctggcagaatggcaaaagaaacaagcagcaggagagaaccagggaacaggaccatgatttccaccctctgccttaaaagtgccattgtatgtttacttgaaaggctgaggtctcaactaagtggagagcttgcgttaaatatggaagcatgggtgtctgacacattgcatatctctcccaaagaccatgactaaccttaatggaccaactgaagaaacttttctaagtctactgtacaactgattttccataattcaattattcaattatcattagtaactctaattactagaaactattagtaattcaattgttactaaaataattttataccaaactgcatggctgtttcacatctgctcctaactgtggagactctctagattcaggataaggtatataggaacaaagtccaaacagggggggatggaggagggatagcattaagagatatacctaatgctaaatgacgagttaatgggtgcagcacaccaacaaggcacatgtatacatatgtaacaaacctgcacgttgtgcacatgtaccctaaaacttaaagtataataataataaaattaaaaaaaaaaaaaaaaaaacaaagtccaaacaggacaccagttaaaaaaggaagtaataaggccctacaagataggtccctaaacactcactaagatggtgaattttccactgaggatctcagaacgaagaggttcctcatgaggtttcagctttacaatgccttccttccttcgagtttcctaaaaaggaagcacagcaaaatgtattaatatgaaaatactgtatatccaggacagcaccatgtaaccaccaaatctcagagataaggtggttatcaatgaatgaatgaattataaatttcataactaaataaattttgtaactaatttcataaccaattctacttcatttagttgaattagaattcaattaaatgggccgggcgcagtggcccacgcctgtaatcccaccactttgagaggccaaggcgggcaggtcacctgaggtcaggagttcgagagcagcctggccaacatggtgaaaccttgtctcggctaaaaatacaaaaattagcctggcatggtggtgcgcgcccataatcccagctactcaggaggctgaggcaggagaatcgcttgaacccagaaggtggaggttgcagtaagccaagacagcaccactgcactccagcctgggtgacaaaatgagactctgtctcaaaaaaaaaaaaaaaaaaaaaaaagaattcagctaaatgaataatgaagtcaactaaatgaattatgaatttctttgtaacctgcctccaagccagtcaagcattttcggaattcctgtccaaagctactttatcagcccctcaggtagggtatttttctctgactcagtaagaaccctaaccctgaagagtaaccagtatgttacattcaggtgcaggatcaaggttcttaaacacgcagcagcactgacatggtaccaggacactaaaatatggacctcaaaaatgtctggatgcctacgttctcacatattttctaggtttaggcctctcctatgtttaaataggagccttctctccacctgatattgtctccaacagcagctaccatgacttcattttcctcaccctgatggccagattctttttttttttttaattgagaccaagtctcacactgttgctgaggctggagtgcagtggcatgatcttggctcactgcaacctccacgtccaagagattctcttgcctcagcctcctgagtagctgggattacaggcacgtgccaccatgcctggctaatttttgtgtttttagtagagacggggttttgccatgttgcccaggctggtctccaactcctgggctgaagcgatccacccgcctcggcctcccaaagtgctgggattacaggcatgagccaccgcgcccagcctcttcagttctcctcttaaatgacaaggttgaccacctacacttcctttttccggagacattctctacctttatataccgataacaaaaaaatattatcttggtttgtcttatttcatcaaccgcttgttttaaacctcttaggctgggcacggtggctcatgcctgtaatcccagtactttgggaggccgaggtgcgtggatcacttgagctcaggagttcgagaccagcctgggcaacatagcaaaaccccgtctctactaaaaatacaaaaaattagccaggtatggtggtgcatgcctgtggtcccagctactcgggaggctaaggtgaggtgggaggatcacttgagctcaggaggcagagatctgcagtgagctgagatcatgccacttcacttcagtctgggagacacagcaagactctgtctcaaaaaaaaaagtgcttccacagaatccagtgctgccttatcataacatttctacaactctttgtttattttctctttcttttttttttttttaaacagtctcactctgttgcccagactggaatgcaatggtgtgatctcggctcactgcaacctccacctccttggttcaagtgattgtccctcctcagcctcccgagtagctgggaatacaggtgccactacacccagctaatttttgtagttttagtagagatgcggttttgccattttgttcaggctggtctcaaactcctgacctcaagtgatccacctgccttggcctcccaaagtgctgagattacaggcatgagccaccgcacccagccctagtctctctttctaaatagtaatctctgcacctggaacacagtaagtataaaataagtatctgttgagtaaatgaatgaatattgaatgagctggtccacaagacagatgtaaccaaacttcagttaagctaatcctagtgcttgttatcccaatttttttttttagggagattttgtatttctttagaaggattctgaccccaaagtaacatgctgtatagtgttttatcaaagacactactaactgagaaagcaaacaagcacaaaaccaaagtctatgccccctcaaaaaacaaaaatcaaaacaaagtaaaatcctgatgccgctacatttgcataaagatactttaagataatggacctagctaatacacagttgctcttcttttccagtgttaaaacttcccttcctgaactgcccactaagctcatcattcatctgaatggcaagtttctaaaagccttagacaacctgaaaaccaagattttcatgtggccagaggccaatgaaaagagctaggattaaaactctaggaagggtgaacccctatcctgccaccaggatgctgtcaggctacttcctccgtctcaatcattagatgtggcatcctggtctacgatcaaaacttaggtacaaaagtagtgccttccagtagctgccttgcccagcttcagctctcacaagggctcctggatatggatccattttttatgaaagtgaggaggaacacttagagaaccaatgtgtgtgtcgagcatgacagggacaacagcaacacttaacccaactgccacaggtctggtctacccctgagccacatactctgtaggagtggaacaattctatggcacggagcacatcaaacttccttgccatgaggaacttgacagccacattccaagacagcggggaaacattgtactgaactgtccacttgttaatctcttcgagaaactgcttggtagcctgtttgacaaagaaagaaagaataattagtaagaagagagcatatttatggagtcaaaaaacaaacaagtgaaaactatcatcccttctccaagcaagtctgaacccagtttgctacagggagcagggaaagacaaacaaaaaggtagaaacaggtctgaaaccagacatagttaaaatttgtataattcaatgaggccagaagccagatctaggttcagaaaacaggacttagtgcaggtatgcatgaaaaaatgaggggggagaagagggatcctaaatgagatgcaaattactagtcccaaagcaaaaaataaaaaaatttaaaaattttgggaggccacactttgggaggtagaggtgggaggatcacttgaggtcaggagttcaagactagcctgaccaacatggtgaaactccatccatctctactaaaaatacaaaactagccggatgtggtggcgcacgcctgtaatgtcagctacttgggaggctgaggtaggagaactgcttaaacccaagaggcagaggttgcagtgagctgagatcatgccattgcactccagcctgggcaacaagagcgaaactgtctcaaaaaaaaaaagaaagaaagaaaaaaaaagaaaacaaaaagaaaagtggccaggccttccgaaggattattgcctaatgcagtgtagtatagcagtctcagctgctgctttggtcccacaagccaaatggacacagcaaaagaatcagaaaatggttttggctttggaatttgaggccagtaaaattattaagaagaacttagccaatcaaaagagcagctattctttgtgctaactgaccccactggacctcttcatgctttatatggcaaccccaaaactggatactagtacccagagtcaataacagcccctctggatagtggttttggaaaggggaggaaaattttcatttttactgtctgacccaggctggcaagatgcctgcttccagaactgtttctatctctcaactaattcatgttcttttatgcactctcatcctatttctccttacattataaccaatttcctttttagacaaactacttttctgtttcttcattttagaatgatttaaattgggatttttttttttctttttttgagacagggtctcactctgtgacccaggctggaatgtagtggcacaatcttggctcactgcagcttcgaccacctgggctcaaacaatcctccagcctcagcctctcgagtagctgggactataggcatggcatatgtcatcacacccagtaatttttttctttgttatttttagtagagacaaggtctcactacatagcccaggattggtctcaaactccggggctcaagcgatcctctcatgatccctctcaaagtgctgggattacaggcatgagccactgccctcagcacattttttttttttttttttttgagacaatatctcactctgtcacccagcagactgcagtgcagtggcacaattactgctcattgcagcctcaaactcctgggctcaagggatcctcctgtccccgccttccgagtagctgtgactacaggtgcacaccaccatgcctggataatttttttgattttttgtagagacgaggactccctttgttggccaggctggtcttgaactccagtgctcaagtgatcattccatctcgcattcccaaagagctgggattgcatctgtgagctaaattggaattttttttttagatagtctcactctgtcacccaggctggagtgcagtggtgcgatcttggctcactgcaacctctgcctccagggttcaagtgattcttctgcctcagcctcccgagtagctgggactacaggggcacaccaccacgcctggctaatttttgtatttttagtagaggcaaggtttcaccatattggccaggctggtctccaactcctgacctcatgatccgtccgcctcggcctcccaaagtgctgggattacaggtgtgagccaccgcacccagccaggaataatttttttgtaggcattctacactactaaaagcttcatgcatggctattctgtcccttccatccagaaacttttctcagctgtttgtctgcaatatgacgaacctgatgagaattctgaattttaaccatacctctattcccaatcaacccacagttatgacttatttattcatatttaataagcacctgttatttgttaagctaatacttgcactgaaaggtataacgaataaaaaaatgaggtttgcttcgaaaggtataaaactagcctaccatgtgaccatggacacggtaattctgtctttgctaatttttcaattgaaaaataaagggaggaccgggcacggtggcccacaactataatcccagcactttgggaagccaaggcgggtggatcatttgaggtcaggagttcgagaccagcctggccaacatggtgaaaccctgtcactattaaaaatacaaaaatcagccaggcatggtggtgcatgtctgtaatcccagctactcaggaggctaaggcaggaaaattgcttgaacccaggatgtggaggttgcagtgagccaagattgtgccattgcactccagcctgggtgacagagcaagactctgtttcaaagaaaaaaaaaatggctgggcgtgttggcttatgcctgtaatcccagcactttgggaggccgagggcagatcacgaggtcaggagctcgagaccagcctggccaatatggtgaaaccccgtctctactaaaaatacaaaaattagctgggcatggtggcatgcgcctgtgctcccggctagtcaggaggctgaggcagaagaatcgcttgaaccaggaggtggggttgtagtgagccaagatcgcaccactgcactccagcctgagcgacagagagagactccatctcaaaaaaaaaaaaaaaaaaagaaaagaaagaaagaaagaaagaaaaagaaagggagggctaggcacggtggctcatgcctgtaatcctagcactccgggaggccaaggcaggaagatcacttgaggccaattcaagatcagcctggccaacgtagtgagatcctgtctctataatagatatatatattacattatatatattacatattatattattatatattatattataatatataatatattattattataataaaatatatattataataataaaaatatatattataatatattatattataatatattataatataatttattatataatattattatattataatatattatatattattatattataatatactataatatatattattatattataatatactataatatatattattatattataatatactataatatatattattatataatatactattatatatattattatattataatatatataatatatattattatataatatatataatatatattattatataatatatataatataatatattattataattattataatataatatataatagaatatattataatatatcataatataatataatatatattataatatattatatattatgatatattatatattacgatatattatatattattatatattatattatatattataatatatatttttattattataatgtatattttatattatatataatatatataagaaaaataaagagaaaaagcataatagcaatgacctacttcggagtcttggcaacaagtcctaccttacaaatacaattcaaattgctacacactatttaaacaactggcaaactaaaatcccaggagagtcagcaatacctcataacagagcatctgattcatcccccaatttctaggaaaggacaaaagtactttataaaccccaggaaagtctaaacggcctgaggctgcacctgagctttagagccttacgattaaggcaacatagcttacaccattggagaaggaaagaaccagcaaaaccaatcaggcaaagtgcatgaaaagagccaagaaataaaggccatgaagaaaagctttcagaagatcattctggcctggaaccagctgaagccacgccagagaaatgagtcccagagaagacaacaggacaaacttagaatgctccttcagaaaatagtttgaattgcctctgtggagtgagtggccagcatcaaaatgaggaaagatggaaggaaaaagaagtgagcacagaaagatcccagaaataaaactctagccagtcagtaaattccccaggagacatggtacctgtttttgttttttgttttttctgctttttttttttcttttgagacagaatctcgctctgtcgcccaggctggagtacagtggcgcaatcttggctcctggcaagctccacctcccgggttcacgccattctcctgcttcaggctcccgccaccacacccggctaatttttttgtatttttaatagagacagggtttcaccatgttagctgggatggtctcgatctcctcacctcgtgatccacctgcctcggcctcccaaagtgctgggattacaggcgtgagccaccacccccggccgagacatggtacctgttttttaattaacctattatcctttaaatacagttctctagtgggcctctctgatgttgcttatagaataaaacaccagaataatagaacatatttttcctgctacttagctgggtatacaatttctaataaaaaataatcaacggataaatcaatgtataagtagaagtggaaaatgtaaatgaccaagaggtgatatgaactcatcacatatccatctgttaagataaattttcattttttggctgggcacagtggctcgcccctgtaaacccagcactttgggaagccaaggtgggcagatcatgaggtcaggggttcgagaccagcctggccaacatagtgaatgaaaccctgtctctactgaaaatacaaacaattaacagggtgtggtggcaggtgcctgtaatcccagctacgtgggaggctgaggcagtagaatcgcttgaacccaggaggcagaggttgcagtgatccaagatcgtgccactgcattccagcccaggagacagtgcgagactctgtctcaaaaaaaaaaaaagataacttttcatttttcataaataaaccatgtcctaataagagaaaggcatgcaggtttcacacacttccttcaaagtacatcttgccttcctttttattaagctcagttcctccaaggtccttaatgttctgtagctcccaagagctgttgccttgagctgacctctgtccccctgctggtcaggatgttattcttggctttaagcacaggaacaattcctcctggtttggcctgaccaggccttgcatgtagagtccagtgtactataaacagtgatgtgatatttacagatacaaatacacatgcgtagcacctgctctgttcagcctcagattcaccctcctgcacacccatccctctggtggaagagatgaacctctaaaaggagtcagaaagaatggcctcatcttcaacaaccttcctttagacagttaatcagatttctccctctgcttacacataggtttaacatgaccactgagtacaaagtaatttgtagctctgctggttaccagaaaaacaagtcccagcaactttaatcagcaacacagtcttcagaagggataattgaaattctcaaaattaaaactcagtttatttcctagtgaaagaaagaatgagccaaaagatgagtcacagcttagaaaatattttaactccaggacaatggtttgaatctatctatgcttatgaaacacaagttgttaacacctggcagctaaggaagagctggagttcaaacagctctggtcttcctttgggataaggtctgaattgatatatggagaaactaacattaccacttacaaccctccttaaccagtttttcaggtaagggtaagatttgttttgttttgcttttttgagacaggttgttgctttgtcaccgaggatggagtggagcaatcatggctcactgcagcctcgacctcctgggctcaattgatcctcctgcctcagcctttccaagtggctgagactacatgcacacgtcaccatgcctggctaatttttgcattttttagtagagatggggtttcaccatgtagcccaggctgatctcgaactcctgggctcaagaaatccacctgcctcagcctcccaaagtgctggaattacaggcatgagccaccgtgcctggcctcaagggtaagatttgttcctgcatagtcaaaaagcatactataattatctacttctcccacaaccatgtttaaataaataaaaacaagtttcttgactatggccatgaagataaagatactagagaacctgctataaaacagctgagaaagctgtcaattaagcagggtacaccctggacacaattcattagtgttgaaataatggtatcagagagaataaaaccaacaacatagcctccatgttacatcaaactcccaagagcagctataattttgagatgagctttgggcaaggaactagccactcaagaggacaagaataatgtgctggcactctcagttccacaggtagtaccttaaatcctatatcccaagacaacctaggagagtgaagagccagacctgtaagaaacctgctcttgaaataaacaaaaaacttctgtctcctgaaatatcagttacctagcaacaaaggagaaagtttagtgtggttttggggattataaagaaccaatccatcttcttattcactactgtgtgttatttgggcaagtcatttaacctctctgagccacaatttcctcaccttgaatgagaaacggatggaagagcacccactaccatacctagcacttggtagtctctgaatggatgaatgttcattctcttttttctttactctggtcatttcacactaaaacttctttcaacaaagatagaatttcttagaatcatatgacctctgttgcttccctttagtctgtatcaatgcaatctctctaatccattttatacaaaaccatacatttaaactagaaatatgtgttcaggctgggagtggtggctcacatctgtaatcccagcactttggaaggccaaggtgggaagactgcttgagcccaggagttagagaccagcctgggcaacatggtgagaccccatctctacaaaaaaatttaaaaattagccatgcatggtggcacatgcctgtggtcccagctactcggggggctgaggtgggaggagtgcttgagcctaggatgccaaggctgcagagggccaagatcataccactgcagtccagcctgggtgactgagtgagactctatctcaaaaaaaaaaaaaaaaggccaggtgcaatggttcacgcctataatcccagcaccttgggaggccgaggcaggtggatcacctgaggtcagaagtttgagaccagcctggccaacagggtgaaacctcgtctctactaagaaaacaaaaattaaccaggtgtgctggcttgcgcctgtaatcccagctactcaggaggctgatgcgggagaatagcttgaacccaggaggcagaggctgcagtaagccaagatcatgtcattgtactccagcctgggtgacaagaaagaaagaaaaacaaaagaaataaacattcaactgaaaacgattttttttttttttgagacagagtctcactctgttgcccaggctggagtgcagtggcgtgatctcggctcactgcaagctccgtctcctgggttcacgccattctcctgcctcagcctcctgagtagctgggactacaggcggccgccaccatgcctggctatttttttgtatttttagtagagacggggtttcactatgttggccaggatggtctcgatcccttgacctcgtgatccacctgcctcggcctcccaaagtgctgggattacaggcctgagccaccgcgcccggcctcaactgaaaacactttttaaaggaccaattattccttattcaaggctctgtggctataaagaaaaagctgaggccagaagtatttagacttcagttcccatctttttgtccctactctcagacttctctggcagctccagagattaacaatgccatcctaggcacaagctccttttaacagcgcaaactatggagaggtctcaatacaataaagaaacaggtgttgattacaggtgttgtgcagaacaaacaccatgaaaaaatgcagtcagtcatcctgcaatgaagacctaaataaggaaagtgattcaagataagatgcaatgtctggcttttaacaaatttgaagatacttctgtatttcaacaaatatgccatttctccattatttcagtgatggatgcattaatgaactaccttcctctcatgacctgtttcccccctctctccttcattgtgattactgcctttttatatctattgatctcttcagcccatattaatctgctaggtgagactctgagcaaagacacactggtttgctataaggcagcaagaggtttgatgaatttccaaactaaaactacgatttttccataagcactttgttaatgtaccaaaaaaggaaacaaatccagtccctttaatatttactggtttatctcaaatattttccacttctcaggaaaacattgccttttcttaaaatgtgattttaaaagagataatgctttcttaaataggctcttactgcatttgggaaaagttttaagtatattttctgattttatcgtattataaaacaatgtaataacaaaaatttgcaaaaagtaaaaggccagtcataatctgtgcacacacacatttaaagaaaaacttaagggaaggggaaaagaaaggattagtcaaacattcacaacaaatatttgctgagggcccattctgtgctaatcagtacagtagttgttgagaagacacaacatagatcgcttcttggcctttcgctaagatcaagtgagaagacacaacatagagacataaagaccctattccaagcagtttacaatcatttaactatggagacagatgtataaatacatctttaccacataatgtaataaattctaggaaggttctatgaacagaatgctatgggattcaaactctctctatggatataaaaaaaatttttttaggagtgccttgaaggatgagtaggaatctgtcaggcagagaaaagtattctagtcagagaacaaaatgtttcaaatcagggtcatgaaagaacagggcttattggggatatcatatagctagtgtgtccaatgtgtatgagggagaatggtgggagatgtgtgaacaggggggctgaaccagactgggaaggcccttgtatgctgtacttcaaattccagacatgatcctataaacataaaagattcaatagagatctttaagcaaagggatgagatgatgagtttggttcccctctcccacctcaaaaaaataactataagcagtggggaagtcagactgaaaggaaaaaaaatctagcaacagggaggtaagttccctgaagacagggatcatatctattttattcacctagttcctagcactgtgcctggcacaaagcacttacttaataaatatctatgatgaatgaatgaattaattattgaagtctcaatattattaacatttagagggcagacagaagatgaagaacaaaggaacttttacaattttcttttagaaatactagtgattgcaggccaggcatggtggctcacacctgtaatcccagcactttgggaggccaaggcaggcggatcacctgaggtcaggaattcgagaccagcctgaccaatatggcaaaactccgtctctactaaaaatacaaaacttagctgggcatggtggtgggcgcctgtaatcccaactactcaggaggctgaggcaagagaattgcttgaatccaggaggctgaggttgcagtgagccgagatcatgccattgcactccagcctgggtgacacagtgagactccgtctcaaaaaaaaaaaaaaaaaaaaactagtgattgctgaaaatcaaataaatggtgatctaaacaaaaacaagaggaatcgtcaaatatcttccctaaaaaaaaaaaaaaaaaaaaaaaaaaaaggccaggctcggtggctcacgcctgtaatcccagcactttgggaggcttaggtgggtggaccatgaggttaagagatcaagaccatcctggccaacacggtgaaacccccacctctattaaaaatgcaaaaaacttagctgggcgtggtggtgcgcacctgtagtcccagctactcgggaggctgaggcaggagaatcacttgaactcaggaggcggaggttgcagtgagccgagatggtgccactgcactccagcagggcaacagagggagactccatctcaaaaaaaaaaaaaaaaaaaaaaaggccaggcgtggtggctcacacctgtaatcccagcactttgggaggccaaggcaggcggatcacctgaggtcaggcgttcaagaccagcctggccaacatagtgaaaccctgtctcttctaaaaatacaaaaattagctgtgtgtggtggtgcctgcctgtaatcccagctactcaggaggctgaggcaggagaatcacttgaacccaggaggcagaggttgcagtgagccaagattgtgccactgtactccagcctgggagagagagcaagactttgtctcgaaacaaaacaaaacaaaacaaaacacacacacacacaaagcttcacagtaaagatagctctcacattacaggcttctccgaggaatgtaaagacttggtttaacatcaggagatctatcaaagcaatttttatgttaacaggaaaggaaaaaaaagtatataaccttctcaacagatgctgaaaatgcactgcgtaaaatccatcacacataggccccgtaatttttttctattaaagatgagaaggccagcaggtacctgctattaccaccactatgtaacattgcactgaaggtcatacctaacagaagccaaaagatgcgtaacaacctgatgcaaaaagacaggaattttaggccaggtgtggtggctccaatctataatcccagcactctgggaggccgaagtgggcagactgcttgatctcaggagttcgtgaccagcctgaggaacatgacaaaaccccgtctctacaaaaaatacaaaaattcgcccagcatgatggcacacgcctacagtcccacaagtgggaggatcacttaagcccgggaggcagaggctgcagtgagctgaaactgtaccactgcatggccccccagcctgggtgacacagccagaccctgtctcaaaaaaaaaaaggaatgttaaagaagagaataaaattcagaaaccacacagtgtatatctaagtatacagtatatgaaacaagtaatatgactattagtaagcaaaaagtattataggaatttagatatgcacataaatatttgtaggatacacaaaaaactggtaataatggtcacctctggggagagaaaatgaactggggctgggtgtaatgcttcacacctgtaaccccaacactttgtgaggctgaggcaggaggatcacttgaatccagtagttccagaccagcctaggcaacaaagcaagacccagtctctataaaaaaaataaaaaagaaagaaagaaagaaagaaagaaaatgaactgggaaacagcattggaagataactataagcaacctttaaaaaatttttttttggccgggcgtggtggctcacgcctgtaatctcaggtgtttcaccattttggccaggatggtcttgatctctcgacctcatgatccgcccgccttggcctcccaaagtgctgggattataggcgtgagccactgtgcccggccagtgatttatctttagtaaacaaattacatttactatcttctctctgaaggaagttggtatttagaagattttttttttttttttgagatggagtctcgcactgccacccaggctggagtgcaatcgcacaatcttggctcactgcaacctctgcctcccaagttcaagtgattctcctgcctcagcctcccaagaagctgggattacaggcgtacctgcctactttttgtgtgtgtttttagtagagacggggtttcactacgttggccagactggtctcgaactcctgacctcatgatccgcccgcctcagcctcccaaagtgctgggattacaggcatgagccaccgcgcccagcctagtagagaagatttaattggaggaccacgaaggtagaaatgttcacccatttgaatatgtgaacttttttattgttgttttttgagatagaatctccctctgtcacccaggctggagtgcagcggtgtgatctcggctcactgcaaccttggcctcccaggttcaagtgattcttctgcctcagcctcctgagtagctgggattacaggcgcgcaccaccacgccaggctaactttgtatttttagtggagacggggtttcaccatgttggccaggctggtctcgaactcctggcctcaagtaatccgcctcaagcaactcccctgacctcccaaagtgctgcgattataggcaagagccgccacgtctggcctgaatgtgtgaacttctaaattatatgtcacgttttatttattaggaagtgtgaagtatagaattccttatggctaagacctataaaggtatcattaaaaaatttaaagacataaaatacccctcagtttctctgcctttttgaaggaaagcatcagaaataaaaaacaaaagtgaaactgacttttacaaaagtttagtccattgagatagagcaaataaataggcacaatgaaagaaaagggaatagagtcaactaagtttgagtgcactgtaaatacttttttaaaaataatgtgtggccgggcatgttggctcacgcctgtaatcctagcactttgggaagacaaggcaggtggatctcaagagttcgagaccagcctggccaacatggcaaaactctgtctctactaaaaatacaaaaattagccagacgtggtggcacatgcctgtaatcccagccattcaggaggctgaagcaggagaatcgcttaaacccaggaggtggaggttgcagtgagctgagatcgcaccagcctgggtgacagagcaagactctgtctctaaaaaaaaaaaaaaaaaaagaaagaaagaaagaaagaaagaaaaatgtgaatcaggtctgattggaagcactacttctgctgccttcctgtttgtacttttcagttgctgcaagaatgatccaggcggctgctaggtgaggtgacacataattccagcattttgggaggctgaggtgggaggattccttgagaccagcatggataacatagtgagatcctgtctctatttaaaacaaaaaaaggatgatccaggtgggacgagatgactcatgcccgtaatccaagcactttgggaagctgaggtgggaggatcgcttgagcccaggagtttgagaccagcctgggcaacacagggaaacctcgtctctaaaaaaaaaattaaaaattagccaggtgtggtggtgcacacctgtagtcccaggtactcaggaggctgaggtaggaggatcacttgagcctaggaggtccaggctgcagtgagctgtgatcacaccactgcacttcagcctgggtaacagtgaaaccctgtctcaaaaaataaaaaaataaaaaataaaaaaaaagagacaggatcttgctcttgcccaggcttgagtgcagtggcatgatcatagctcagtgtaaccttgaagtcctaggctcaaatgattctcctgccccagcctccctagtagctggaactacaggtgtgtgccaccacatctggctacttttttaatttttgtagagatagggtctcaccagccgagactggtgtcgcactcctggcctccagtgatcttcccccattagcctactgaagcgctgggattacaggcatgatccaccacacctgccctcattttattattattattattaattaattaattaattttttgagacagagtctcgctctgtcgcccaggctggagtgcagtggcatgatctcggctcactgcaagctccgcctcccaggttcacaccattctcctgcctcagcctccccagtagctgtaactacaggtgcgcgccaccatgcctggctaattttttgtatttttagtagagacgggatttcaccgtgttagccaggatggtcttgatctcctgacctcctgatccgcctgcctcagcctctcaaagtgctgggattacaggcgtgagccactgcacctggcctttattattttttgtttttgagacggagtcttactctgtcacctaggttggagtgcagtagtgcgatctcagctcactgcaacctccacctcccaggttcaagcagttctcctgcctcagcctcctgagattgagaccatcctggaacatggtgaaaccccgtctctgctaaaaatacaaaaattagctgggagtggtggcgtgcacctgtagtcccagctactcagaggctgaggcagaagaatcgcctgaacctaggaggcagaggttgcagtgagccgagatggtgccactgcactccagcctggtgacagagcaagatgccatctcaaaaataaaataaaataaaataaaataaaatataaatcattaataggtctactcccagcaatctggataaatgtatattgggaactcagaaccaactgcttaaaactacatgtggcacagaatctttcacaatgagtttacaaacattttcttcctttaaaagataacccatattatcaggtctctttattctgatatccacatgttgcaagatagaaagtctttcttgttcatccgttaagggactatgtgcacttcaaactcaaagccctacaaatctcatcagaaagggtaaggccaaataaccatgaagaaaggcctaacacccatctgcctaatgaaaccaaataggatggttctgaaaccatgggactcttccatctaccacatcaagcattatgcaagaacccaagaagaaaaaaagctaactgctattaaaggattaatatcccactgggaacggatcaacaggaaaccagggttgaccaagtgaagtttcccatctgagtccaaagcttcaggcaacactgaggggccagagttaactgaactgttaaacacgaaaagctcctcagtgttaatgacttcctaccagcagaagtgaagggctaaggtttatcagcactccaccagccaagtgtgacagccccagatcaggaatagtttgtctccaatacctgatgagcagaaaatgttctattccttttcaaatgctatttctgtctcctttggctcatggttcctttgtacacataagacagcattagtcacatattaaagaaggcaattcaatcccttcattttttttttggctttttttttttaattatacttttaagttttcgggtacatgtgcacaatgtgcaggtttgttacatatgtatacatgtgccatgttgatgtgctgcacccattaactcgtcatttagcattaggtatatctcctaatgctatccctcccccctccccccaccccacgacagtccccggtgtgtaatgttccccttcctgtgtccatgtgttctcactgttcaattcccacctatgagtgagaacatgcagtgtttcgttttttgtccttgcaatactttgctgagaatgatgttttccagtttcatccatgtccctacaaaggacatgaactcatcattttttatggctgcccttcatttttctagagcaagattttgcccctcccagttcacacagaccaaagagcaaagtcctgcaagaaatcacagtagtagtaaccatgtgtgaagcatttaagatataccagagaaggaaccatactacatcatactcaacactgacaagctaggtattattaaccgcataaagaaatcaaaggctcacagagccgaagcaaactgtccaaggttactcaaccaataaatggcagagctgaggttttgagcactgaatccaagtcttttcaaatccttatagtctttccacttcactaaatgggcatgagacatacaagacacatatcattcatcttattgggtaatatatatgtcatttgtttgttgatctatgcacaaaattactctggaagaataaataagaaactggtagcatcagctgtctcagaggagaactaggtagctgggagacatggtgagaagattaatattttccatattcctttctgtatctttttaagtttaaatcgtatgactatattatccactcaaaaaaataacaataaaacatattagttttatatagcctttaactaaaatatacataacaggaatttttgaacataatatttttgaaactatgccaccaaacaataataagtttgttggtaatcttcatttcagggccaaaaaaatgagttagggagctctacacaggggtaaaggatgacagctgtttcacgaactgctagccttagatggggatgcttcaacgaggagtgtgccactctcactttcctgctggaggcatttgccaatagcatatttactaaacacaagctggcatctctcctctcaggtttaaaaaacacttgccaggccaaagttatcaaagaggatgaagaattcccagagacaacagaggaaataggtaaacaaggaaaacaaggaagtaaacaattctaaattgtcataggagaaaattcatgttaggaggttgagaggcagaatataacacagaagagaaacggaaaaaaacgaaacctgccgagtaaacaagcagctcctggccaggcgtgggggctcacacccataatcccaacactttggaggccaaggcaggaggatcgtttgagcccaggaatttgaaaccagcctggacaacacagggttatccaatctccacaacatatgaaaataaattagccgggtgtggcagtgtactgctgtggtcctagcaggaggctgaagggggaggatcacttgagcctgggagtccaagtctacagtgagctgtgatgatgccactgtgttccagcctgggtgacagagcagaacctgtctcaaaaagcaaaacaacaacaaacaaacaaaacacacacacacaaaaacaagaagctcctcatccaccaacaagagcaacatcatctaggttcccagagggaggtaacagaggtagctggtcacactctccacaagaacctgtagacagcttgccaactgccactcatgccgctaaagagtgagtgaaccacacaaccagaagaaacctgtaaagtctttctgggggaaaaaaaaatttaaagagcttggtaaacatagagagtgggaggggcctttggtaacattttttttttctcttcttccaactgatagcttagactttaggaaagaaaggaggaatgtgaatggctgtgaggaaattgaagttggctttccagatcatgctaaaacattcttacccttcctctactcccaaacctggcttattcctatttctccttcaggtcagcctaaatcctacttcatcctataaatttctactgctttccagccaagcactgaccaaacagtattataaagcatgttattgtctatctgctcccactaaactgtaagcttgggaagatgcaggggccaagggttctgtgccacaactgcatactcaacaccaagcatagtgacaccattctgataagtaaatgtgtcaatggtgatgggctcttggcctgctaaaagagtgtggttcagagagtaggaagaacacatttgaacacttgccaatctgattatgggaacttaaaatttaaaatacaggagagggccgagcatggtggttcacacttgtaatcccaacactatgggaggctgagatgagtagaatgcttgaccccaggagttcaagaccagcctgggcaacatagtgagacccccccatctctagaaaagatttaaaataaagtaaaacaaaacaaaacaaaataaaataaagtaagaggacagcaaaaaattcctaaataaaactgggaaagaacatcaggaaaataacatgagaagaaaagcaatgaaagaggtgactattaaatcacagaagaaactatctggaaattagatatcttaattccctgccaatatcttaacgtcagacatctataataggatatacaaaataaaataatttaaaataaatttatggccaggcgcggtggctcatgcctgtaatcccagcactttgggaggcggaggcaggtggaatcacttgagatcaggagttcgacatcatgacaacagcctggccaacatggcgaaaccccgtctctactaaaaatacaaaaattagctgggtgtggtggcgcacgcctgtagtcccagctacttgggaagctgaggcacgagaattgcttgagccagggatgggaggatgcagtgagccaagatcacatcactgcactccagcctgggtgacagagcaagattctgtctgaaaaaatagattaaagtaaatttatggattttgtaaaataagtaagacatggtctctacccataaaaatctgagtctggcagaactgtgaacacaatacaccaactaatgggcaaatggaattcaaatctttattatttttacttatttatttttgtcttttacaaacaaaagtaagtaattcagatctcaagaggggaagtggaatgacagcacatcccaaaatgatattccctggagaaatccacaaaccacagtagaaaatttctgaatgaggataaaagagagtaatggacatgatacagctactgggagaccccttcaaacttctcaataacagaaaatatagattgttttcttgactcagatcccaaaattgtcagggtgataatggtgtatagaaatagggaacttcagccaggcgcagtgcctcacgcctgtaatcccagtactttgggaggccgaggcgggcagatcacgaggtcaggagttcaagaccagcctggctaacatggtgaaaccccatctctactaaaagcataaaaaataagccaggcatggtggcacatgcctgtactcccagctactcaggaggctgaggcaggagaatcgcttcaacctgggaggcagaagttgcagtgagccgagatcatgccactgcactctagcctgggcgacagagcaagactctgtctcaaaaaaaaaaaagaaatagagaacttcattaaccttgacatttgctggatatcacatttaacttaaaaagggtgggtgggcacagaaagcctgataaattcttgtggacagtttcatcctaaaatgataagagaacgactacactggacattatccagactaaggagaaatactagatgaaaaattgaaagggtttcaagaagaaagtaaccacataatccttaacagtgtgatagccaacaactaagtgttgtcaacaggaggcagttaagaatgcaagttctagacagagcactagtcaccctacattaaagacccagttctgccacagcagaactctcactcaggcaagtcaaaaaccacctgtgccaggccaggcacggtggctcatgcctgtaatcccagcactttgggaggcctgggtgggtggatcacctgaggtcaggagtttgaaaccagctggccaaatggtgaaactttgtctctactaaaaatacaaaaacattaccagatgtggtggtgtgcacctgtagtcctagctactagggaggctgaggcaggagaatcgcttgaacacgggaggcagaggttgcagtgagctgagatagcaccactgcacttcagcttggccgacagagcaagactctgtctcaaaaaaaaaaaaaaaaaaaaaaggccaggcacagtggctcacaccggtaatcccagcactttgggaggccaaggcaggtggatcatgaggtcaagagttcaagaccaccctggccaacatggtgaaaccccgtctctactaaaaatacataaattagccaggcgtggtggcagacaaaacaaaacaaaaaacaaaacaagacaaaaaaaacctctgtgccatacattttctcatccaaaaaaggaaacctgcctatgctgtctcgcatgatcaaataactggctatccttgaaggcattgtgtaaaacttaactacactgcattaagtaacaccagaccttaacaatagctaatatttactggatatagggttctttttttttttttttgagacgaagcctcgctctgtcacccaggctggagtgcagtgactcaatcttggctcactgcaacctcggcctcctgggttcaagcaattctcctgcctcagcctcctgagtagctgggattacaggcatgcgccaccacacccggctaatttttgtatttttagcagagatggggtttcaccatattagccaggctattgtcgaactcctgatctcaagtgatccacttgcctcagcctcccaaagtgctgggattacaggtgtaagccaccatgcctggcccctactgggtacagagttctaatcacaagtcagagactaagatttagatagattatcaaattctctcaatagcccttaaagattgatactattattatccctatattacagttgagaaaacagatttcgaactgttaggtaacttgtccaaagtcccagaacaagaaaagtggtagagcctgaatcagaacacaggttttctgactctagagaatccacattataaccactgtattacagtgctttcaaaatgcagatttaactaaattaaaatatcataatataaacttcttctttttttttttttgagatggaatctcactcttgtcacccaggctagagtgcaatgggacgatctcggctcactgcaacctccacctcccaggttcaagctattctcctgcctcagcctcccaagtagctgggattacaggcgcccaccaccatgcccagctaatttttgcacttttaatagagatagggttttgccatgttggccaggttggtcttgaactcctgatttcgtgatctgctcacctcagcctcccaaagtgctgggattacaggcatgaaccaccacgcccagactaatatcataatatgaacttctaaagagaagacagatggtggtattgcttttttgttttaatttttgtttttgttttttcctttagagacaaggggaaatttttttttttttttttttgagacagagtcttgctctgtcacccaggctggagtgcaggggcgcgatcttggctcactgcaagctctgccaccagggttcacgccattctcctgcctcagcctcccgagtagctgggactacaggcgcccgccaccacgcccggctaattttttgtatttttaatagagacggggtttcaccgtgttagccagaatggtctcgatctcctgaccttgtgatccgcccgcctcagcctcccaaagtactgggattataggcatgagccaccacacccagccaaaaatttcaaaaaaagaaaaatagaaacagggtctccctctgtaaccaaggctggagtgcagtggggcaatcatagtccactgtaatttcaaactcctgggctcaagcaatcctcccatctcagcctcccaaagtgctgggattaacaggtgtgagccaccacacccagccagatgctggtgttttttaaagaaatccttaaaagtgagataatatgaattatgcaattaattataaattattccaatttcatttttttttctttgagacaaggtctcactctgtaactcaggctggattacagtggtgaggacatggctcactgcagtcttgacctcccaggtgcaagtgatcctcctgcctcagcctcctgagtagttgggactacaggggtggaccaccacacttggctaatttctgtattttttgtagagacgaggtttcaccatgttgcccaagctggtctcttaactcctcagttcaagcgatctgcctacctcagcctcccaaaatgctgggattacaggtgtaagccaccacatctggctaatttcaaatttaaaaagggaacaatctgaagagactagcacaatcgaaaagcattcttgagtacagatgttaaaaggccactcacaaacacgtacaaaaaacagaaggcatagttaaaaaaaagagtggtggctctaacctaaaagaaaagtaacagcccataatgaggcaaggcttgttaataaagctaaggataacaagaagggttttgtgagaactgtctagaccttggaaggctggggcggaaggattgcttgagaccacgggttcaaaaccagcctaagcaacatggcaagccctcgtctctactaaaattaaaaaattagccaggtgtggtaaagcatgcctatagtcccagctactcgggaggctgaggtgggaggattgcttaagcatgggaagttaaggctgcagtgagccatgactgcatccctgtactcttgcctgagtgaccgagtaagacccttgtctacccccacccccaccaaaaaaaaaactgtcttgataaactcctttttccgtttctctatcaagtacaatgttcagtttgaagtgggaaaaaataagccctgtaaatagagagaaatgaatttcaaaacagcagagaccctaacaatctgacaatcctgagaactccaaggcagcctgataaacccctgtggtagttttttttttttttttgagacagagtcttgcttcttcacccaggctggagtgcaatggcgctatctcggctcactgcaacctccacctcccggattcaagcgattctcctgccttagcctcccgagtagctgggattacaggcacccgccactacatccagctgatttttgtactttcagtagagacggggtttcaccatgttggccaggctagtctcgaactcctgacctcaggtgatccacctgccttggcctcccaaagtgctgggattacaggcgtgagccaccatgcccaaccagtggggtcaattttaaaggacataaaaaataaaaagattggctgggtgcagtggctcacgcctgtaatcccagcactttgggaggccgaggtggacggatcatttgaggtcaggagttccagaccagcctgtccaacatggtgaaaccccatctttactaaaaacacaaaattagctgggtgtagtggcgcatgcctgtaatcccaactattagggaggcagaggcaggagaatcgcttgaacccgggagaaggttgcagtgagccaagatcgcaccactgcactccaacctgggcaaaaagagtgaaactccatcttggaaaataaataaataataaaaataaaaagtttttttttcttttttgttgagcagggtctcactgtgttggccaggctgctcttgaactaggctcaagcgatcttccttctttggccacccaaagtgttgggattacaggcatgagtcaatgtgcctggccaaaaattaaaagattttaaaggaaaagcctggaaggagagagacaaacagaccaatgtttactgagtgcttatagtgtgctgggccatgaggcaagtactttacatccatgttttattcaacctttccaacaggcccatttgtagatattaagacttttaaaaaaatttttttcagacatgaaatctcactgttgcccaggctgaacttgaattcctgagatcaagggatcctcctgcctcaggctccagtgtagctgggactacaggcatgcaccaaccaccctgccgagggctgttaagacattttaaatatgaggaaatgaaggcccagagaagttaggacttcaccaagtcacattgcttcccatgatacaaccaagattgcaaaaccaagtctgactctaaaacccacgctctttttctttttgaaacggagtctcgctctgtcacccatactggagtgcagtgccacaatctcagctcactgaaacctctgcctcccaggtgggttcaagtgattctcctgcctctgcctcccaaatagctgggactacaggcatgtgccacaaagcccagctaatttttctatttttagtaaagagggggtttcactatgttggacaggctggtcaccccatgcatgctctttccattaatttactctgtatctgtctctggcctagtcccattgatggcaatgagcacattacagaggcgtagcatcccaaacaaggaggcttactagacctcatctgtaatatagacagtccccaatttatgatggtctgacttacaattttttgactttagccaggcatggtggctcatacttgtaatctcagcactttgagaggctgaggtgggcagatcacttgaggtcaggagttttgagaccagcctgaacaacatggtgaaaccccgtctccactaaaaatacaaaaattagctgggcatggtggtgcacgcctgtagtcccagttacttgggaggctgaggcagaagaattgctggaaactgcctgggaggtggaggttacagtgagctgagatttcaccattgcactccagcccgggtgacagagtgagactccatctcaaaaaaaaaaaagaaaaaagaaaaaagaaaaaaaaatttgttttgacttaacaatggtacaaaagtgataagcactgccgggcacggcggctcacgtctgtaattccagcactttgggaggccgaggtgggtggatcacctgaggtcgggagttcgagaccagcctgaccaacatagagaaaccccatctctactaaaaaaaaaaaaagtagaaaattaacggggcatggtggcgcatgcctgtattcccagctactcgggaggctgaggcagtagaatcacttgaacccaggaggcggaggttgcggtgagccaagatcacaccattgtactgtagcctgggcaacaagagggaaactccgtctcaaaaaaacaaaacaaaacaaaacaaaaaaacagtgataagcattcagtagaaactgtactttgaacacccatacaaccattttgtttttcactttcagtattcaataaattacatgagatactcaatgctttattataaaatcacctttatgttaaatgatcttgcttaattctaggctaatgtaagtgctctgagcatgtttgcggctcagatatgagctgaacatcataggataagctatgctcagtaggttaggtgtattaaatgcattttcaacttatgatattttcaacttacgatgggtctattgggacataaccccacagtaagtcaaaaagcacctaggctgtcttcagttctgagtgctgaactttaagagagtcaccggcaaactagatatggtcccataaaagatttagataagggcactgggtcatgctgaccatacagaaggagggcctttagctaagagaacaaatatatggtaaaaatagaacacaaatccaaaagatcaaaactggatggtgcaatgggctagaatggtactaaaaagcaacggcctttagagtcagacagccaagggtttgtattccagattctatcactcactgtttagaatccaggcaagttacttaacttctctgaaccttaatttcgacatttataaaacgggggtaatactacacaaaattgcaagaggggagaaaaggtaatatttgtaaaattcttgggacataagactcaacaaatggtagtgcacattaaatctaacaaaatgaaatttaaggatatgtgcaagtaaatcaattttagaagcaccagatgaaacttaacaggagtacataagaaaagaattaaagatcttagtagacttgaatctgtgaatcaacagcttgctaagactgccaaaaattattgtgaatttggagaccattacagaagcacagtgtccaaaacaaggagtcctatcagacttcattcatgatactgtctttagtcctgagtgctaaactttaagagggtcaccggcaaattagaatcaatccaggacagatgagaaaagttagtagctctgaaaacacagtaacttgcctcttcttcctggctctatattccctccactccatccaaccaaagctacctgacaactgcttctatctctatgccccagtaacacattcatgctcatatatccccccacaacatattcacgtccctcaattttgccccagttccaaagccccaaatggatctgacagagtgacttgttcacttctagtccaaaaatctaggatgaggcatgtgagacttgctgctaatctggccctgacctgcagattatacttgatgctaatctgcaccaaatctaactggcccctgcattcttcctgaggctgagacccaaccctgtaccctgggtaactgaattaatcctgagtctgagtcacatactcaagaaagtaggactcttcctgaatgtctccttgacccacagctccattactcccttaaagggatgaagctggtcagaagtatacaattagacaatgtcagtcatctcagccatttcaaacctgctagaccaatactttctttcttttttttttttttttttgattttttttaagacagaatcttgctctgtcacccaggctggagtattgcagtggcacaatcatgggtcactgcagcctcaaccttacaggctcaaatgatcctcccacctcagcctcccaagtagctgggactacaggagtatgccaccatgcccggctgaaaaaagaaaaaaaaatttttttttttgaaatagaatttcgctcttattgcccaggctggagtgcaatggtgcaatcttggctcaccacaacttctgcctcccgggttcaagcgattcttctgtctcagcctcccaagtagctgggattacaggcatgcaccaccacgcccggctaattttgtatttttagtagagacagggtttctccatgttggtcaggctggtctcaaactcccgacctcaggtgatccgcccgcctcagccttcccaagtgccagaattacaggcgtgagccaccacgcctggcctttaaaatttttttgtagaggcagggtctccccatgttgcccaggctggtctcaaactcctggactcaagtgattttcccacctcagcctcctaaagtgctggaattacatgtttgagccaccatgcccggcctagatcaatactttcaaatccaaaaaggccctcagataaactcaggaacaaacgtatatattctcacaaaatggtacaagttgatcagcttattgtacctaagagactatttgcaaacctacaaagaatgaagtcttaaatagctgcctgtaatctggatgtcctcactgcagtgaggcatcagctccccagcagaacccagacagtaaaatctgttaactcacatgtccagactctcagggcaactaacactggagtaacatgagcttccccctatggaatggtcttgtcaaaactggcaggttttcctggctgaatcagaacagcctgggtcttgtttcattcaatactcccttggaagccaagcatctctctagggaatgccatctgcagtggacatcaggtatctcaatgccctctttgcaaccatgcaaatatcctggttccatttctatatctcaagagactctgctctttcttcagatgagaaaaatcatgataaatgctagtctttgagaagtctgccttgctgttcctcttccagggaacagttcagttctagtccagaaccaaatgattcctggagctttcatccagttcagactgcttctatacctagttccagagccaatttataaattcaagacttcccttcctcaactgtacctgaatgtctaaattcacttctagatgtttccttgatcaacaacagcaccctagatattctctggatcactggttgtcagactttgagtatgcatttagagacgttaaaatacatattactggatcccacctcggagtttctgattcagcaggcctagggcaggacttgaaaatgtgcatttttgttttttatttacttttcattttattattattattattattatttttgagacagtcctcgctctgtcacccaggctggagtgcagtggtgtgatctcagttcactgcaacctccacttcccaggttcaagcaattcttgggcttcagcctcctgagtagctgggattacaggcgtgcaccaccatgcccagataatttatgtattttttgtagagatggggtttcgccatattggccaggctggtctcgaactactggcctcaagtaatccacccacctcggcttcccaaagtagtgggattacagttataagccactgcgcccggccaaaattttgcatttttaacaagctcccaagggatgctgatggtggtggtcagggaaacacactttaagaaccactgctctagccaggtgcagtagcctacacctataatcctagcactttgggaggctgaggcaggatgatcccttgagcccaggaaatggaggtggcagtgagctatgactgcaccacttcattccagcctcgatgacaaacaaagcgagacccccgtctcaaaaaaaaaaaaaaaaaaaaaaagagagagaggcactactctagatcaacaattttttttttctgtcgcccaggctggagtgcagtggcacaacctcggctcagtgcaacctccacctcccacgttcaagcaattctctgcctcagcctcccgagtagctgggattacaggcgcccaccaccacgcttggctaatttttgtatttttagtagagacggggtttcaccatgttggccaggctggtctcgaactcctgacctcgtgatcccccctgcctcggcctcccaaagtgttgggattacaggtgtgagccactgcaccggccttttttttaattattattttattattattattttgagacagggtctcgctctgtcacccaggctggagcgtagtggcacaatctcggctcactgcaacctccgcctcccaggttcaagcaagtctctgcctcagccttctgagtagctgggattacaggcatgtgccaccacacctggctagtttttgtatttttttgtagagacagagttttgccatattgcccaggctggtctcaaactcctgagctcaagtgatccacctgcttcagtctcccaaagtgctgggattcaggtgtgagccaccacacctggccgcattttctttattgtggtaaaatatacctaacaatatttatcatttttactattcctaaatatgcaattcagttgcattaaataaattcacattgctgtgtaactagcacctttctataacccaaaattgttttatcatacccagcaaaaactctgtacccattaaacaataattcccccttcccaactttccacagcctctggtattctactttctgtccctatgaatgtacctattgtaggtacctcaaacaagtggaatcacaacagttgtcctcctgtgtctggcttatttcatgaagccgaatgtttccaaggtccatcatggtatatagcatatatcaagactgccttccttttaaggccgagtaatattccattatatgtatatacaccattttgtttattcttctgttgatggacacttgggttgttccacctttggctattgagaatagtgctgctgatcagacgcagtggctaatgcctgtaatcccagcactttgggaggttgaagtgggcagatcacctgaggtcaggagttcgagaccagcctggccaacatggtgaaaccccgtctctactaaaaatacaaaaattagctgggtgtggtagcgcatgcctttagtcccagctacttgggagtctgaggcaagagaatctcttgaacctgggaggcggaggttgtagagggctgagatcacaccattgcactccagcctggtcgacagaatgggactctgtctcaaaaaaaaaaacacaaaaaaacaaaaaagagaatagtgctgctatgacatgggtgcacaagtatctctttgaggctctgtttcaattcttttatatacttaggagtgaaatttctgggtaatatggtagttctacctttaatctttagagaaactgccaaagtgttttccacagtggctgtaccattttatattcctaacagcaatgccaacacttgtttcccattttgttttgttttacttctaaccatcctggtaggtagggcttagctattattattatcacaagttttgatatgggcttttaccaatacttgtagcactgtaaagatagcatgacaacatgagaggttctgactattttccagcttcaaatggtttagcagttccattcaaaagacaagttttcacgattgcttctaattttcttgaaaaatcacctccaaggctagcatttacctagcttcaggttgactaagaaagaaaatgggctgggcgcggtggcacacacctgtaatcctagcactttgggaggccaaggtgggtggatcaccagaggtcaggagttcaagaccagcctggccaacatgccaaaacctcatctgtactaaaaatacaaaaattgaccaggcgcagtcgctcacacctgtaatcccagcactttggcaggccaaggcaggcggatcacgaggtcgagaaatcaagaccatcctggccaacatggtaaaacactgtctctactaaaaatacaaaaattagctgggcgtggttgcttgcacctgtagtgccagctactcaggagcctgaggcaggagaactgcttgaacccaggaggcggaggctgcagtgagccgagattgcgccactgcactccagcctggcaacagagtgagactccatctcaaaaaaaaaagaaaaaatagaaatacaaaaattagctgggcgtggtggcacacgcctgtaatcccagctactcggaaggctgaggcacgagaactgcttgaacctgggaggcggaggttgcagtgagccaagactgcaccactgcactccagcctgggtgacaagagtgagactctccctctccctctccccctccccctctccccacggtctcccgatccctctcttgccacggtctccctctgacgccgagccgaagctggactgtactgctgccatctctgctcactgcaacctccctgcctgattctcctgcctcagcctgccgagtgcctgcgactgcaggcgcgcgccgccacacctgactggtttttgtatttttttggtggagacggggtttcgctgtgttggccgggctggtctccagctcctaaccgcgagtgatctgccagcctcggcctcccaaggtgccgggattgcagacggagtctcgttcactcagtgctcaatgttgcccaggctggagtgcagtggcgtgatctcggctcgctacaacctccacctcccagccgcctgccttggcctcccaaagtgccgagattgcagcctctgcccggctgccaccccgtctgggaagtgaggagcgtctctgcctggccacccatcgtctgggatgtgaggatcccctctgcccggctgccaggtctgggaagtgaggagcacctcttcccggccgccatcccgtctaggaagtgaggagcgtctctgcccagccgcccatcgtctgagatgtggggagcgcctctgccccgccgccccgtctgggatgtgaggagcgcctctgcccggccgccccgtctaagtgaggagcccctccgcccggcagccgccccgtctaagaagtgaggatcccctctgcccggccaccaccccgtctgggaggtgtacccaacagctcattgagaacgggccatgacgacgatggcggttttgtcgagtagaaaagggggaaatgtggggaaaagatagagaaatcagactgttgctgtgtctgtgtagaaagaagtagacatgggagactccattttgttctgtgctgggaggaattcttctgccttgggatgctgttgatctgtgaccttgcccccagcccgatgctctctgaaacatgtgctgtgtccactcagcgttagatggattaagggcggtgcaagatgtgctttgttgaacagatgcttgagggcagcatgcttgttaagagtcatcaaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatggtcaacaaaaaaaaaaaaaaaaagaagaaagaaaatatttggggtggctgaagaaaagaaaaaaatgaatatttttttctttttaaaaactttctcactgggcacgatggctcatgcttgtaatcccggcactttgggaggccaaggtgggcagatcatttgaggtcaggagttcaagaccagcctggccaacatggtgaaaccccatctctactaaaaatacagaaattagctgggcatggtggcatgtgcctgtaatcccagctactcaggaggctgaggcaggagaattgcttgaatctgggaggcggaggttgcagtgagctgagatagtgccactgcactccagcctgggcaacagagcaagactccatctcaaaaaaaaaaaaaaaaatttatctgataacttaattccataataacgttgttttacccataaacaaaatggcacacactggcattcagtttccggaaatgtctaatggtttctctagagcatttagaaattaatctagaaaggttatttttgaaaacaaaagtatgtggaaaatcttgtatattttaatcttgctggctacaccacttctaagtccctaacctagccagaaataccattttttcttcatttttggggttttcaaggcatggaagagctagagcctccttagtgaggcaaatggtcattcccaaataaaactgtttaattgtcctcatatattacatttaagtcttcaggcctttctctcagtaactcttttccttcatgattccaagaaaaaaatcaggaaaatatagaaagtataaaagagcagtaaaaataacttcctggctgggtgcagaggctcacacctgtaatcctagcactctgggaggccaaaagaggaggattgcttgagcccaggagcacgagaccagcctgggcaacacagtgagacacccatctatattttgttgctgttgttgttaattactttaaagccaggcgcggtggctcacacctgtaatcccagcactttgggaggccaaggcaggtggatcacaaggtcaggagttcaagaccagcctgaccaacatggtgaaacgccgtctctactaaaaatacaaaaagtagccaggcatggtggctcgtgcctgtaatcccagctactcaggaggctgagacaggagaatcgcttgaactcaggagtctgaggttgcagtgagctgagatcacaccactgcactccagcctgggtgacagagtgagagtaaaaaaaaaaaattactttaaaaagccaggcatggcggcccatgcctgtaatctcagcactttggaggccgaggcaagtggatcacttgaggtcaggagttcaagaccagcctgaccaacatggtgaaaccttatctatattaaaaatacaaaattagcccggcacggtggcgcatgcctgtaatcccagctacttgggaggctgaggcaggagaatcgcttaaacccaggcgatggaggttgcagtaagctgagatcacaccactgtgctccagcctgggcaacaagaacaaaactccatctcaaaaaaaaaaaattacttaaaaaagaattccgttttttggaaaattttcttcctcaactttcttacatttgacccaagttgaaaaaaaatctagcttaaaaacagaaaaggaaaaaaaaaaatgggcaaaacgaaagtatcatggaaaaacaatttcaaaagctgttgtcccagatattgataggcaagtatatgaaatatactttcccattatactcactgtggtacttgagagattaaactgtatatatataagactgtggctccagctggagtgcagtggcatgaccatggttcattgcaaccttaaactcctgggctcaagtgatcttcccacatcagccaacaacagatatgtgccaccatgcccggctaatttattttttattttattttttattacttttatttgagaaagagtttcgcttttgttgtccaggctggagtgcaatgacacgatctcggctcaccacaatctctgcctcctggattcaagagattctcctgcctcagcctcccaagtagctgggattacaggcatgtgccaccatgccaggctaattttgtatgtttagtgagatggggtttctccatgttggtcaggctggtctcgaactcccaacctcaggtaatccacccacctcagcagcccaaagtgctggcattacaggtgtgagccaccgcacccagctaatttattattattattattacttgtgtagacatggggtcttgctgtgttgcccaggttggtctcaaactcctggcctcagatgatcctctcgccttggcttcccacagtactgggattacaggcatgacccactgcgcctggccaagatggattttcataaaggcaaagagcagaccttctattctgagagctacagccagaggcttatatgaactccccaacttcattaacctcattaaatcatataatttctgtcatacgtaaatgtacattaaacagtgacatcttggaacaataaataactgggaacaatgtagccacacctctacagggaaacttgtgagtggctgaaaccaggaatgttgaacccacaaatgtccagggagagctatctctggggtgtgtgtgtcatacacgaacatacatggttaaaggcagaggaagtgcactggagacagcagttaaccagaagagtgagtctcagcgcttctactgaaagcctctgaatatcatccctatatcttaaagacaatcatcctaggccgggcgcggtggctcacgcctgtaatcccaacgctttgggaggccgaggcgggtggatcacgaggtcaggagatcgagaccatcctggctaacacggtgaaaccccatctctactaaaaaatacaaaaaattagccgggtgtggtggcgggcgcccgtagtcccagctactcgggaggctgaggcaggagaatggcgtgaactgcactccagcctggatgacagagcgagactcgtttcaaaaaaaaaaaaaaaaaaaaaaaaagacaatcatcctaagcaaaacaatacctgcttcgtaggctatgtgaagaataaacaatttcaaaaaagtttcactcattctttagcaaacatattttagtttgttttctgtttttctttccatcttttattttaggttcagggggtacatgtgcaggtttattacataggtaaattgtgtgtcacagggtttggtgtacagattattttgttacccaggtaataagcatagtacacaatagacagctttttgatcctcgccctcctcccactctccacactcaagtaggcccaggtgtctattgttcccttctttgtgttcatgtgtacttaatgtttagattccacttataagtgataatgtatggcattttttttctcttttctttttgagatggagtctcactctgctgcccagtctagagtgcagtggtgtaatctcggctcactgcaacctctgcctcccgggttcaagcaattctcctgcctcagcctcccaagtagctgggattacaggcacctgccaccatgcccagctaactttggtatttttagtagagaaagggttttgcatcttagccaggttagtctcaaactcttgacctcaagggatccatctgcctcagcctcccaaagtgctgggattacaggcgtgagcccacacccctggctggtatttggttttctgttcttgcattagtttgcttagcataatggtctccaactctatccttgctgagaaagatatgatcttttttatggctcggtagtattccatggttggtgtatatgtaccacattttctttatgcagtcaactgctgatgggcactaaggttgattctatgtgtcagcaaacatattttgaaccctccaaaatatactaagaattcagaagttcgagtccctgtcctcattgcacgtaacaagtcctcctccttgacaggtactctatagtttaataactgccttcaaagaactagaaagcaattcctcaaggatagagagctccaaccttgctatacaaggacctggcacataccaacagataattcaaatatagtttgaatgaacaaactatatttctgcttatgatctaaaaaaaatcctcagttgacattaacacgataaagaattgataaaaaataacactgtgtggtgattatcaggggaacagagacacttcagggcaacactcagaaacatttggaggtatacatgtactgaaacatcacaatatgtataattattatgtacattatgtctttttttttttttaatagagataaggtctcactttgtcacccaggctggagtgcagcagcaaaatcatagctttgtaaactttgtaacctcaaattcctgggctcaatcgatcctcctgcctcagcctcccaaagtgttggaattacaggcttaagctaccatgcctggccaaaaacaataattttaaaaaagagaaacacttgaaggggaaaaataaaaatgacaccacattggccaggtgcggtggctcacgcctgtaatcccagcacttctggaggctgaggcgggtagatcaggaggtcagaagattgagaccatcctggctaacacagtgaaaccccgtctctactaaaaatacaaaaaaaattagccaggcgtggtagcgggcgcctgtagtcccagctactcgggaggctgaggcaggagaatggcgtgaacccgggaggcggagcttgcagtgagccagaatcgcgccactgactccagcctggccgacagagtgagactacgtctcaaaaaaaaaaaaaaaaatatgacaccacattatcatgccatggcaaagctcagtagtgttctctcatgtaaaatccctccatctggagtgcagtggctcatgcctgtattctaacactttgggagggcaaggtaggaggatcccttgaggcaaggaatttgagaacagcctgggcaacacaacaagaccctctctctattaaaaataaatacataaaaataaattttggctgggcacggtggctcacgactgtaatcccggcactttgggagcctgaggcgggcagatcacgaggtcaggagttcgagaccagcctgaccaacatggtgaaaccccgtctctactaaaaatacaaaaattagctggcgtggtggcacgtgcctgtaatcccagctactcaggagactaaggcaggagaactgcttgaacccgggaggcagaggttgcagtgagccgagattctaccactgcactccagcctgggcgacagaaaaagactccgtctcaaaaaatatataataataataataataataataataataataataataattttttaaaagctaaataaaatccctccacctctgaaaacccctgcaaagggtgtggaaatggctcattttacccctatgatggttatgctataaaacaattggttttagactagagcttttcagtatgagaagtcaattgctgaaatcagtatttggtgacacatattttcataaacactaaatgtgttgagcaaagacctatctttaactttaaagtgaaaacttcaaactgttcctaactacaaaatttttcagagataaaccatggtttctcaactctggcactactgacattttgaccagataattctctgctgtagggagctgtcctatgcattagaggatgtttagcagcattcctgacctctatccactagatgccagtaccacctcccacagtcatgacaactaaagaaatttctagatattgacaaatgttctggggggaggatcatactgatagggaaccagagataaacaatggaatgataattttcttcataaaggctgtttaaataagatatggaagataatacaaactatcattctttgcactcatttgcgaatcatttttaggtcatcagatgaccttttaatattttatctgaaaagcagcagcagaagcagaccaccaccaccagtgcacctaaaggtaatgtgtaacctagaaagaagaaatgaaccaatgaaccaatggatgatgcaaaaagtcttaacagtaaaaaatgagctaaggtagcctcagtactctgctatgtatattactcatgcatggtaactgttagaattcttaggctatcttgaaatcttttatttcaatgctacaaagtcagactcttcatttttcttcctattcttatctgaaaaagaaaagtttcctgtatcacagagatcaagaatacttaccactatttattgagcattttgtaaatacaagggattttacttaattaagcagatctccaaaaaacttaaggaaataagacaaaacagattcaggaacgttaaataaaacaccgagagccacaaaggaagctgagggattcctgagatctaccaaagggtcatcaccatcacatcccaaaaggcctaggttttacttataaatcttctagtttataaaaaggccagatttgcaataatattaaaaactgagatctcagcatttaatagcataatcttaaacgtgtaaagaacacatagtacttttcagaaagtgttatttttcattataaaagaaacgtaagtggcgggacacagtggctcatgcctgtaatcctagcactttgggaggccgaggtgggcagatgacctgaggtcaggagtttgagaccagcttggccaaaatggcaaaaccccatctctactaaaaatttaaaaattagctgggcatggtggcaggcacctgtagtcccagctacttgggaggctgagacagaattgcttgaagccaggaggcggaggttgcagtgagctgagatcgcaccactgcactccagcctgggcgacagagtctcactctgtctcaaaaaaaaaaaaagaaagaaacatatgggctgggcacagtggttcatgcctataatcttagcattttgggaggctgaagcggaaggatagcttgagctcaggaatttcagaccagcctgggcaacatagtgaggtcctatctctattaatgagaaaaaaaaattagctggatgtgatgacacgggcctgtggtcccagctactcaggaggctgaagtgggagcatcgcttgagcctgggaggtcaaggctgcagtcagccataactgtgccaccacattccagcctcggcaacagaaacatatgatcattgtagatcatctaaatagcccattttttttctttttttttttttttcagatgcaatctcactctgtcgcccaggctggagtgcagtggcgtgatctcggctcactgcaacctccacctctcatgttcaagtgattctcctgcctcaacctctggagtagctgcaattacaggcgtacaccaccatgcctggctaatttctttgtatttttagtagagacggggttttgccatgttggccaggctggtcttgaactcctgacctcaggtgatccgactgccttggcctcccaaagtgctgggattacaggcgtgagtcaccgcgcccagccttaaatagcccattttttaaaagattggttgtaataatgatgtatataatgaatatcatcatattatcataatgacgtgtatctgtaataatgattcacatcaaaacaaatgcaaaggtaaagattagctaggtgttcaagcaatgaacaagtaactaatggatgaacatccccaaacacttcagtcctaaagtcacagatgacttttttagaacctgcccagaaattactgtagaaataaattctggcttcagaataattcaataaacttacctgtgctacctacactgaaaaaagtgacaagtactgtgccggtatgttgtggatggatttggtatttcagaggaaactggtacatactacagaaacggcctttcccaaaggaaaaatgaaatgctgccaggcgcggtggctcacgcctgtaatcccagcactttgggaggccgaggtgggtggatcacaaggtcaggagatcaataccgtcctgactaacacggtgaaaccctgtctctattaaaaatacaaaaaattagccgggcgtggtggcaggcgcctgtagtcccagctactcaggagactgaggcaagagaatggcattaacccgggaggtggagcttgcagtgagccgagattgtgccactgcactccagcctgggcgacacagcgagactccgtctcaaaaaaaaaaaaaaagaaaacaaaaactgaaatgcttatctcagaagcataaattaaagagaaaaatcatctctaatctactgtttcggtcttaccattttatagtttggacctaagagatcagcaatccttaataaataaggtttcccatgagttctggagcttctctgcctcctgttcgcaccctccatgtccatgtttaacaacctaatgccagccaggtgcagtggctcatggctgtaatcccagcactttgggaggccgaggctggaggatcacttgagcctaggagtttaagaccagcctgggcaacagaacgagaccctgtctctacaacaaataaaaaataaaaaatctaactgggcatggtggtgtggtggtgcacgcttttagtcccagcttcttgggaggctgaggtaggaggattccttgggccagggaggtcaaggcttcagcaagccatgatcatgccactgcactccagtctgggtgacagagtgagaccttgtctcaaaaaaaaaaaaaaaaacaaaacaaaaaaaaaacaacctaatgctggatggacacagtggctcatgtctgtaatcctagcactttgggaggccgaggctggaagactgcttgaacacaagagttcgggaccagcctaggcaagaaagcaatacccccatctctttagaaaaaaaaaaaaatgtgccaggcatggtggtacatgcttgtagttccagccactatagaggctgaggaaggaggaccacttgggaccaggagtttcaggctgcagcgagctaggatcaagccactgcacttcagcctgggcaacagaacaagaccctgtctcttactaaaaaaattttaaaaagtgaaccaaacgcttaagaagctaactcggttaggttcctaaggggccttttcaaaatcagatataaaagggctgatgccaggccctccagcactgagaagtgtaggctaaactaccttttctaggaacatcttcccttattctagaagaataggaatagaaaacagtggttattttagtggtcaggaagagcaaccaagatctcgcatggaggtgtgcttagggggaaaatgttaaaataattgattaggaaaaagaaagtacgagaattgtctgatataccaaggcaggatggtagacagaagcagtgaaatggctgatattacactagaggttgtatctgaacaaataatcagggttaggttctatgacttctaatcttggcactgcaatggaccagccacactgccgtaaaatggggcttaatatttagaaaataaagtttaagtactccaaaattactatgtcttttccaagacaataaaggcataaaagtcagaaaatgaaactaaaatatactcacaatgagtcttaacttttacctctttaaaacagtttagctcctggccaggcatggtggctcacgcctgtaatcccagcactttgagaggccgaggcgggctgatcacctgaggtcaggagttcaagagcagcctggccaataagctgaaaccccatctctacaaaaaatacaaaaattagctgggcgtggtggcgggcacctgtaatcccagctacttgggaggctgaggctggaaaatcgcttgaacccaggaggcggaggttgcagtgagcggagatagtgacaagagtgaaactccatctcaaaaaaaaaaaaaaaaaaacagttcagctcctttctaaaggagggtcttttcaattcattcataagtactaggttgggttccttagagaaaacctccaggccacttaatattcacaaaactaaagtccaagacccttgtgctcagaattttttttttgagatggattctcgctttgtcaccaggctggagggcagtggcgcgatctcagctcacagcaacccctgcctcccggttcaagcaattctcctgcctcagcctcccgagtagctgggactacaggtgagcgccaccactcccagctaatttttgtatctttactagagacgggatttcatcatgttggccaggatggtcttgatctcttgaccttgtgatccacccgcctcggcctcccaaagtgctgggattacaggcatgagccacaccacacccaaccagaaatttttaatacagcaaaattctcacatccaaatgaggttttacctaattgttacttacagtatcataaactatcagcaataatgaaaataataagagttcttcacctttccttccttctttgtctctgtagaagacctcaatttaacatcataaatcatttggtccttgacgtatggtaacttccagggagacagatgacatttagcacaggacatgtaagactgtgggaaaagggaagttcttggccgcaagaaatgggacaaaacccttgcctttgggaaaaatgccaaagatctctgaagtccacgctaaagcagttaaatttttagctttaaaagattccattacaaaaatccaaaccagactgggcacagtggctcatgcctgtaatcccaacactttgggaggccgaggcaggaggattgcttgagcttaggagttcgtgaccagcctgggcaacatggtaaaacccccctctacaaaaaatataacaaattagtcatgtgtggtagcatgcctgtagtcccaggaacccgggaggcgaggtggaaggatcacttgatcctgggaggctgggaggtcgaggctgcaatgagttatgatcatgccactgcattccagcctgggtgacagagtaagatcctgtctccaaaaaaaaaagcaaaaaccacaccatacaattagaataggcttttaaaaactacactataaaaatgcaagataataattttctggaattcataagaacctgtactaggtgatggtccccagggtggatatgaatattttttccccttgtaattggcttaagctaacatggttctaaaatttttcgctattcaaaaacgatgaggacgggcacggtagctcatgcctgtaatcccagcactctgggagaccaaggcaggttgatcacctgaggtcaggagtttgagaccagcctggccaacatggcgaaaccccgtctctactaaaaatacaaaaattagccaggtatggtggcgggcacctgtaatcccagctactagggaggctgaggcaggagaattgcttgaacccgggaggcggcggttgcagtgagccgagatcatgccactgcactctagtctaggtgacagaacaagactgtctcaaaaagaaaaaaacaaaaaacaatgatgaatatcataataatggctaacttttctgactacttattatataagcattgggctaagtgctctacatgcatctccttattaatcctcacaacattgtaaggtctaaataacataaactttaagaattttcaaaaaaagaaaaaacataaaattaaaataaaaaaagaaacaaaaataataataattttcaggctgggcgtggtggctcacgcctgtactcccagcattttgggaggccaaggtgggtagactgcttgagccctggagttcaagaccagcctgggcaacatagtgacaccttatctctattatttaaaaaatgaaataaaataaattggtggtggctcacgcttgtaatcccagcactttgggaggcagaggcaggtggatcacgaggtcaggatatagagaccatcatggccaacatggtgaaaccccatctctactaaaatataaaaattggccaggcatggtggtgcatgccagcagtcccagctgcttgggaggctgaggtaggagaatcgcttgaacacaggaggtggaggttgtgccattgtgctccagcctggtgacagagcaagactccgtctcaaaaaactaaataaaaaataaaaataaaactattaacagaaacataagtactttcgaaaactactctattatcctatcaatcatcactgggatatccatgcaaaaccaaaataccctgaacagctataattatacagaattttaatctagtgagagttctagttaagagtcttggcagggtgagatggctcacacctgtaatcccagcactttgggctgctgaggcacgtggattacctaaggtcaagagttcaagaccagcatgggcaacatggtgaaatcccatctctactaaaaatacaaaaataagccaggcgtggtggcaggtgcctgtaatcccagctactcgggaggccaaggcatgagaatcgcttgaacccaggaggcaaaggttgcagtgagctgagatcgtgccactgcccacagcctgggcaacaaagcaagactccgtctcaaaacacaataacataatgacaatgaagattaatacttatatgtagaaattgtccttcacactgccaaactgccagcccattaagaaaggcttttacggccaggcatggtggctcatgcctgtaatccgagcacttggggaggccaaggcaggctgatcacttgagatcaggagttggagaccagactagccaacatggtgaaaccccatctctactaaaaagaaaatacaaaaattagtcgggtgtgatggtgcatgcctgtagtcccagctactcgagaggctgagacaggagaatcgcttgaacccagaaggcggaggttgcagtgggctgagactgcgctccagcctgggcgacagagcgagactctgtctcaaaaaaaaagaaaaaaagaaagaaagaaaaagaaaggctttcacaagccttcttgtgcaaaagaacaagaagatataaagaaaataaaattttattgtagttgtgaccacaccttgaaatggagagttgacaactctgttttaaggaacaaatttttttcctatagtaatttcatcataatttcttgcacagagtatacagtatgtttcctctggcaatacacagctgagtaaaggttttctgtatcttttcatctgtacttttcaaactatattttaagaagcattaacaaaaccaaacacatatatcaataccaaaacccacaaaattagctattttatacccacttaggcacctaagtaaattggctaatggcttcatgggaagtaatgtagtgtaaaagaggaaacactggcagtgaaggcagaaaacctagacctgggtggaaatcatggctacatcacttgttaactatgtgaccttgggcaatttccttctctcagtctgagttttcttatttgcaaagtgagggtagtaattccaatcttgggagggacgattaattgcatgtgaaatgcccaccacagagcctgactgaaagcaggagtttagaaaagatactgttacgattgttattcatataagctccttaaaagcaaaaacatcatatttgtcctcgtagcccaattgtaggctttataattattgaggagctgaaaaacaagaaacaccaaagttacaaatgaggatttgtatccgttcaacacatgcctagacagaaaatgagactaagtaatcatgactttcaaaaactatatcaatgcatacacagcatataaatcaaagtatatattgccatttgatggggaaaaaaatcaaaatatgtaatgtgcttatttttaagccactctgaaagaagatgatgctgcctgtatacaaatcaagagtacaactactcttcattcattctgcaagtatttccgtaagtgccagtcattatgtcagtcattatgctaggcaatgtgcatatgatggggagcaaaagcgaaaataatcccaaccctcatagagcttgcttgcagtcatgtaatcacacaaataagtgttaacttgtgataagtgatgtgaatgacaggtaaatggtgctctgagaacctattaggttagaatctaatctaactgaaatcaaggaaggccttccaaggaggtgaaacctgagagctgaaggatgaagaggaggttaacaaaggggggtgtttccagatggaggaaagcagctcctgcaaagaccctgtaagcaggaggaaacaaggaaagaaggcaggactataaggccagtgtgcatggagcagagacaagtgtgagaactagctagggcctaggctgctcaagggcctagatatatagcctacattcaaaagttgcaatttgatctcaagagcaatgacaaggcctgtaatcctaaggctttgggaggctgaggcaggaggacggcttgaacccaggaggttgaggctgtaatgagccgtgattacaccactggactccagcctgggtgacaaagtgagatcctgtctccacaaaaaaaaaaaaaaaaggcaaccagaagccactaaagagttttatgaatgcttctttgcggggcaggcaggctgaggggaagatgaaatcagattttcaacaggactctggcttctggattctggaatatggatggaccaggtgggaaacaaaagtcctgtcaggataggatagtagcttcgaatagggtgatggcagtgatggtggaaggaagccaatgaattcaagagatattcaggaaaatctaacactgtattgtacacaagggcagagggacagcagtgtccaagacttctgggtttctgattcatatgactgtacagaaggagataccactcaggaggtattctgcttcagaaatatttttaaggagccaggcgcggtggctcacgcctgtaatcccagcactttgggaggctgaggtgggtgaattgcctgaggtcaggagttcgagaccagcctagctaatgtagtgaaaccccatctctactaaaaatacaaaaacttagctgggtgtggtggcgggcgcctgtaatcccagctactagggtggctgaagcaagagaattgctcgaacccgggaggcagaggttgcaatgagccaagatcacgccattgcattccagcctgggcaacaagagcaaaactctgtctcaaaaaaaaaaaaaaaaaaagaaagaaagaaaagaaatatctttttttttttttttttttgagacagaggagacggagtctcgctctgtcggcgggatctcggctcactgcaagctccgcctcccgggttcacgccattctcctgcctcagcctcccgagtagctgggactacaggcgcccgccacgacgcccggctaattttttgtatttttagtagaggcggggtttcactgtgttagccaggatggtctcgatctcctgacctcatgatccgcccgcctctgcctcccaaagtgctgggattacaggcgtgagccaccgcgcccggccgaaaagaaatatctttaaggctgttcacacaggccaaaaagggcctaactgcactacacttttgcatgaaaatgtgtaaaccgaatttgatcccctactttaaataaggctctaaaagattttttgctatttacagaaatcaaactgactctcaaaagtacaaggattttcctacactgaagaaatttcaaagattctgccacaagcttctaaatcaactccaaataaatgttaaattggtttgagcaatagggcagcattacggagtgaatgtgtcagttcccatgaggaccactttgataaggctaacacttatgtactgctgtttaattttaatattttaaataaatcttaagagtacccttggctgggcgcggtggttcacgcctgtaatcccagcactttgggaggccaaggcgggtggatcatgaggtcaggagatcgagaccatcctggctaacatggggaaaccccgtctctactaaaaatatgaaaaattagccaggcgtggtggcgggcgcctgtagtcccagctactcgggaggctgagacagaagaatggcatgaacccaggaggtggagcttgcagtgagccgagattgcgccactgcactccagcctgggcaacagagcaagactccatctcaaaaaaaaaaaaaaaaaaaaaaagagtactcttggctgggcacagcggcccaggcctgtaatcccagcattttgggaggccaaggcgggtggatcacgaggtcaagaaatcgagaccatcctccaacatggtgaaaccccgtctctagtaaaaatacaaaacttagctgggcatggtggcacgcacgcctgaagtcacagctacttgggaggctgaggcaggagaatcgcttgaatcagggaggcagagtttgcagtgagccgagatcacaacgctacacttcagcctggcaacagagcaagactcagttaaaaaacaaaagggtacttctggctgtgtgcagtggctcacacctgtgatcccaacactttgggaggccaaggcgggtggatcacctgaggccaggagtatgatgagactagcctggccaacacggtgaaaccccatctctactaaaaatacaaaaattagctgggcatggtgggtacctgtaatcccagatactcaggaggctgaggcaggagaatcgcttgaacccggcagatggaggttgcagtgagccgagatcacgccattgtactccagtctgggcaacaaaacccaaactccggccaggcgcagtaactcacgactgtaatcccagcacttttggaggacgaggcgggcagatcatgaggtcaggagttcaagaccagcctggccaacatggtgaaaccccgcgtctactaaaaatacaaaaattagctgggcatggtggcaggcgcctgtaatcccagctgctcgggaggctgaggcaggagaatcgtttgaaccctggaggcagaggttgcagtgagccaagatcaggccactgcactccagcctagatgacagggcgaggctctgtctcaaaaaaacaaacaaacaaacaaaaaatcaaaactccatctcaaaaaaaaagagagtactcttatgtgatattaaactaaaatatggtaacattaggcattaccataattagaactatactgcttttgtttcaatattttgaaatgcttgtaaaaaaataatattttgtagaaaaaagagataagattttaaaaacacacacacacacaatctcttgactttaataaacattttgccgtttccatcctagtccttgttaatgcccatcacattcaattcagggtaaaagataaggtttttactagttaaacacatctgtatatatgtgtatgcactatgtacaaagtaaagccaataccatgtcaatactatcaatactttaatatttacttttcctggttttagttttcaaatttgcaacggatgctatttgcatagaatactgatggctttaagtcttaaaaacagaaatctgactgacccaaggaaaaggatgaaagaaagagattttgtccctttaaaatcagccaacacatcctatcttagtactgaagtacttcccaattctggcagaatgggctccttggccacctgcttgcactagggtctgactagcattttattaacatccaactgcagttaccaggacattcattaccactgcttgtacaaagcagaattctttttaaatttttttcccatacagatttcatcaccaggtgtcaaaagacaaaaccgtggcctgaggccaaatagaaaaatgtcatctccacaaataaggagaaaagacaaggactttaaaaaatcaggtcaacaagcccattagccaataatagtttgtaaaactggactgtcttcacactagaggctgtgctagcaaatgtggtccttggaaacaagagctgtagagcttgaaatgggttgccagcatggtttgcctttttcttttttcatgtttatttttattttttttatttataacatggaatcagactatgactataatcgagcatagctatggcggggtatgggcagtgccaaggaagagacagcgaaaagcccgtagggttcccagtctaagctagcagaccttcccatcttcctcaggagtggtccctgtctccgcagctggaatgtgcgggagggaaagttacaagggcccccaaaatgagacagcaaaccacttccttctgaaaactaaaggtcataggcttttaaggaacaatagagctcaatgtaagcttcagaaagatggagacagtcagatgagacgagggtagggaagcgcgggtgaggagatgcgccccgtctgggatagctgaataggggggtcaaggccagggactttaggaacacgagaagggctggatcttccataacctgcccaagtgggcctgagaaacctaagaggctcctctgaaaatctagggcatctatgcatccaatactctcagccctctcctcgggaagggagataatccccacaggaagcaccccccaaactggggcttttcctgcccttcaaaagccacaaaccctcacggaaaacatttacaagggagtggaagggccgggggcaagcagcggttctgcaaatctcgggaagaaggcccctggatccaaggaactttgcccctggaatagggggtggggtgcggagggcaccgtctgaggctggtaagcctcggcgaaagaagcggcgggaacgggagtagggtcccgtgggtcccccgacgagggggtggcggcctggggcgcggtcgccggtgagggaggcccgcgagccgggcacgggagcggggggctgcggccccgtggctgcaaagagccggcactcgggaggcagaggccggcgtaggcctcgggggcccggacacacccaacgcggcggcctcgggcccgcttacctgctcctcctccggggtcagctccggcgccatgtcgggccggggcgcggtcgcgggctccatccccccgccaccgccgccgggcggacaaaactcgctcgcgagcgcgggagcccggcgcgctcggcctccgcttccgcgtccccgcgcctcagcagcccggggccggctcgcgcatagtgtggccggcagggcccggcgcctgcagcggccgcaaacgccgcttctgcttccttaagaaaaatctctccgaactgccgctctcttccgggaggaaatccttttttatattattcgctccgttcctcacactcccccttatctcctggggaagaaaaagtgcaggcgaagagctaacagccactcgggatttaaaaggaaataggaaatcaggaacttttagagccgggagcgaagggtcggcggaaatttcccgaaggccgccgaccccctcggcgccccgcttcctcggccgcgctcccgctcctccacagcgccacagagctcggggccgcccagccgggccgtcctcgcggacgctggccctgcgacctgcgcggctgcctcagccaggctcctcgcgggcggccgcagcgaaagggagggagtggagagggagcgagggaaacgcgcccccctcctgactcacggccaacgctgcggccgccccgcggccgcccgagccccccgcggctccattgagaaactgagcgtctcattcacaagctggcggcgaggagggcccggcggagcgaggacgcagtccgggagggggagacagagaggagcccgggcgggggaggggaccgggagggggaggggacccgggcggggaggggaccctagctggacggaaggcaactcgactgcgggagggagaaaaaggaagaaaagagtatttcgtgaggctcagatcctcggaggaggaggagaatacgttcgtttgcaaattatctgctgactggcacctctcctggggttaacttgccgctgccacctacgcgtgagaaacccacaatcctcaactatttgtcgcttgcagcctgaaagaccctggaaaggttgcctgccaggccaggatgcttaggtggaaggaatcgcacctgcctccctctctctccctccttactggctgcaccctgtaattcatctccagtgtcgctaattttaatcccccatagaaacgacatcagactccgaacatcattcaggaatgacgcggcctttgcagacctttgattttcactagggcaagtgcagcaaagggttcaggattaggggtacagtcttggagtcatttggggaggaatggggcatagagaaggcaaggctgggtctggtacgttgttgcattattccaagccaaagataaatattccaaagggacccaaagtccacaactagttccaaggctgaagccctggagccagtcctgagggacccaaaggaggggccttcagacaacaggaaggtgctgtgagttgtgatgctcctatgattttttttttatttttttttttgagacggagtctctgtgtcgcccaggctggagtgcagtggcgcgatctcggctcactgcaacctccacctcccggggtcaagcgattctcctgcctcagcctcctgggtagctgggattacaggtgcgagccaccacgcccggctaatttttgtatttttagtagagacggggtttcaccatgttggtcaggctggtctcgaactcctgaccttgtgatccgcccgcctcggtcttccaaagtgctgggattacaggcaggcgtgagccaccgcgcgcctggcttttttgtttttctttttttgagacggagtctcactctgtcacccaggctggagtgcagtggcgcgatctcggctcactgcaagctccccctcccaggttcacgccattctcctgcctcaggctcccaagtagctgggactacaggcacccgccaccgcgcccggctaatttttatttttattttttttatttttttgtatttttagtagagacgggctttcaccatgttagccaggatggtctcaatctcctgacctcgtgatccgcccacctcggcctcccaaagttgttgttgttgttgttgttgttttaacacagggtctcactttgttgcccaggctggagtgcagtggcgtgatcacagctcactgcagcttcaaagtcctgggctcaagcaatcctcccgcctcagcctcctgagtaggtgggactacaggtgcacaccactgcacctggctaatttttttttttttttttttggtagagataggggtcttactatgttgcccaggctggtctcaaactcctggtaaactgcctttgcaaaattataactgatgattttatgacagtgaaagaaatcagacctaactgactctatcttgtttctaacccttaagctgtccttgttcattcctgggcataggccgaactaactttgggaaggaattcagttcatggtttgactctgaaacaaaattgataatagccctttcccgaaaagacccccttcttccctggggtccagtctgcctttgcaggactaacagattaagctacaagattagaaattacaatttaggggtcatgcagccatgggctccaagagtctaaacctccccaaactgctcctggggataacatcactattgtaaaacctaagatcagtgcttgagatattttgcagaccctgcacccagtgcatcagctgataccatccagactggtaatctggcccaaataggtctgccatcccaaccaggaacagaagacagcaagaaaaactcatttcaactccctatgatccaatctcaaacctgaccaatcagcactctccacttcctaagcccctacccaccaaattatctttaaaaactctgatcccttaatgctccagggagactgatttcagtaataataaagctccaggccgggcatggtgactcacgcctgtaatcccagcactttgggaggctgaggcaggcggatcatgaggttaagagatcgagaccatcctggccaacatggtgaaaccccgtctctagtaaaaatacaaaaattagctgggcatggtggcgcgtacctgtcgtcccagctactcgggagtctgaggcaggagaagcgcttgaacccgggaggtggaggttgcagtgagccaagatcgcatcactgcactccagcctggcgaaacagcgagacgctgaatcaaaataataataataataataataataaaactccactctcctgcacagacggctctgtgtgaattactcttttgccattgcaattcccctgtcttgatatatccgctgtgtaagcagcaggcaaggtgatcccattgggcagttacactgggctcaggcgatcttcctgcctcagcctcccaaagtgctgggattacaggtgtgagccaccgtgcccagccttctaggatttttgtttttgtttgagatggagtttcgctcttgttgcccaggctggagtgcaatggcacgatctcagctcactgcaacctccacttcccaggttcaagcaattctcctgcctcagcctccctagtagctgggattacaggtgtctgccaccatgcctagctaatttttcgtatttttagtagagatggggtttcactgtgttggccaggctggtctcaaactcctgacctcaggcaatccacccgcctcagcctgccaaagtgttggcattacaggcatgagccaccatgcccggctccttctaggattttaaaaacaatccctgacctcaactaatttctgcattaatgcaataggaacttcaggctgcccttggtaagaatcagagacgatatccttggtatttgaatctttatctcagctaggatattttctcctttgcatcaatacagctgactggaggttgacttcatcactcctttagtttcagtattgtaaccagtctggaatacttttttttttttttttttttttttttttttttgagtggaggtcttgctctgtttcccaggctggagtgcaatggcgtgatctcggctcactgtgacctccacctcctgggttcaagcaattctcctgcctcagcctcctgagtaggtgagattacaggcgtccaccagcacaccctgctaatttttgtatttttagtagagacagggtttcaccatgttagccaggctggtctcgaactcctgacctcacgcaatccgcccacctcagcctcccaaagtgctggtattacaggcgtgaactactgcatccagcctgctttctttttattgaagtgtaatatacagaaaaagtacaaatataagtgtactgcttgatgaatttttttattttattttttgagacagggtctcactctgttgcccaggatagagtgcaacagcacaatcctggctcactgcaacctctacttcctggctcaagcgatcctccagcctcagcctcccaaatagctgggactataggtgcgtgccaccaggcctggcccatttttatattttttgtagagatggggttttgccacattgcccaggctggtctcaaactcctgagctcaaagcaatccacccacctcagcgtcccaaagtgctaggattacaggcgtaagccactgcacccggccagatgaattttcataaactgaacacactcgtgtctgtgcccaatgcacagatcaacaaatagaatattctgaacttgccaaagcctcgccttttgcccatcccccaccccacagtcagttactactctgctgaagggtaaccactatcttgcccgttttttttttttttttttttttgagacagggtctctcgctgtgtcacccaggctggagtgtaatggcacgatctgggctcactgccacctctgcctcccgggttcaagtgattctcctgcctcagccttcagagtagctgggattacaggcatgcactaccatgcccatataatttttgtgttttttttagtagagacgggttttcaccatgttggccaggctggtctcgaattcctgacctcaagtgatccacccaccttggcctcccaaagctctaggattatagttgtgagctatcactcccagcctcaggcttgaactcctgggctcaagtgatctgcctgcctcccccttccaaagtgttgggcgtcagccaccgtgccgggccaagtatgctttttctccctaggcaagcaaatggttctaggactaaactggagtaagaaacagcaggacctgagtagtacaaaccattgattggagacaggagaggatggagtctctcaactcactatttacacttcacatttgttttgcccactgatcctcaggacaccaggggtcagtgatttatccaaagtcacacaactaaataattagtattgagctaaaacttgaacccaggcattctaactcctgatctaggaactgggtgaggaggagaattaataaagatatttaactgagtgggctgagagagaactcagcagtgttttcagaggcacagctgtgtgtgtgggcgtgtgggtgtgtaaggaaagagagttctccggaactgttatccatcactgttttaacaggacaatgtttggaaatttctgagcacaaacgtgaataacaaaacaaagtgcaaggcggctggctggccagtttgttttgagaggtaaatccaggagacccagagtagagaggcaactacctggcttgcctgtaactgcaggcttgaaccaatgaactcaagtatggtactgtcatcctgcccaatcaaatcttaaaggctgggctgggcaccggggctcacgcctgtaatcccagcactttgggaggcccaggtgggtggatcacttgaggtcaggagttcgagaccaccctgatcaacatggtaaaaccccgtctctgctaaaaatacaagaaattagccagacgagatgttgcatgcctgtaatcccagctactcgggaggctgaggcagaattgcttgaacctgggaggcagaggttgcaatgagccgaaatcgcaccatggcactctagcctataaaacgagagcaaaactctgttgcaaaacaaacaaacaaaaatcttaaaagactgcagaatggcttgtagtatcaaaagattgaaaacattatgaggccgggcacggtggctcatgcctgtaatcacagcactttgggaggctgaggcaggcggatcacgaggtaaggagaacaagaccatcatggccaacatggtgaaaccttgtctctactaagatacaaaaattagctgggcatggttgtgcgcaccactgtcccaaccactcgagaggctgaggcaggagaatcgcttgaacccgggaggcagaggttgcagtcagccgagatcgcaccaccactgcactccagcctggtgacagagggagactctgtctcaaaaaaaaaaaaaaaaaaaaaaggctgggcgcggtggctcacacctgtaatcccagcactttgggaggctaaggtgggcagatcacgagatcaagagattgagaccaacatggtgaaaccccgtctctactaaaaatacaaaaattagctgagtgtggtggcacatgcctatagtcccgctactcgggaggctgaggcaagagaatcacttgaacctgggaggtggaggttgcagtgagccgagatcgccctactgcacgccagcctggcaacagagtgagactccatcccaaacaaagaaacattatggcccatcaatagaagactcagtaaataaattacagtacacacatacactgaaataataggttgacatttattgtgtccttacatttaccccacacactgttctaaatgactttcattgatttactctcaccataatagtataagaaaggtgaaactatgatccttattttacaaaaagcatatatagtagatccattgatacagcctccttacttttttttttttttgctgagatggagtcttgctgtgttgctcaggccggagtacagtagtgcggtctcagcttactgcaacttccgcctcctgggttcaagcaattctctgcctcagactcccgagtagttgggattacaggcgcctgccactacgcccagctaatttttgtatttttagtagagatgggttttcaccatgttggccagactggtcgtgaactcctgacctcgtcatccatccacctcggcctcccaaagtgctgggactacaggcgtgagccaccacacccagctgtttttcttttgtttgagatggagtctcgctctgttacccaggctggagtgcagtggcacaatctcggctcactgcaacttccacttccctggctcaggtgattcttgtgcctcagcctctcaagtagctgggattacaggcgtgaaccaccgcgcctggcccctccttgctttttattttttttgaggcagagtgtcactctgtcacctcagctggagtgcaatggcacgatctcagcccactgcatcctctgccccctcgtttcaagcaattctcctgcctcagcctctcgagtagctgggattacaggtgtgcaccaccacatctggctaattttttttattattattatactttaagttctagggtacatgtgcacaatgtgcaggtttgttacatatgtatacatgtgtcatattggtgtgctgcacccattaactcgtcatttacattaggtatatctcctaatgctatccctccccatgaccagccccgctgtttgatgttccccaccctgtgtccaagtgttctcattgttcaattcccacctatgagtgagaacattcggtgtttggtttcctatccttgcgatagtttgctgagaatgatggtttccagcttcatccatgtccctacaaaggacatgaactcatccttttttatggctgcatagtattccatggtgtatatgtgccacattttcttaatccagtctatcactaatggacatttgggttggttccaagtctttgctattgtgaatagtgccgcaataaacatatgtgtgcacgtgtctttatagtagcatgattcataatcctttgggtatatacccagtaatgggatcgctgggtcaaatcatatttctagttctagatccttgaggaattgccacactgtcttccacaatggttgaactagtttatactcccaccaacagtgtaaaagagttcctatttctccacatcctctccagcatctgttgtttcctgactttttaatgatcgccattctaactggtgtgagatggtatctcattgtggttttgatttgcatttctctgatggccagtggtgatgagcattttttcatgtgtctgttggctgcataaatgtcttcttttgagaagcgtctgttcatatccttcacccactttttgatggggttgtttgattttttcttgtaaatttgtttaagttctttgtagattccgaatattagccctttgtcagatgggtagattgcaaaaattttctcccattctgtaagttgcctgttcactctgatggtagtttcttttgctgtgcagaagttctttagtttaattaaatcccatttgtctattttgggcttttgttgccactgcttttggtgttttagtcatgaagtccttgcccacgcctatgtcctgaatggtattgcctaggttttcttctagggtttttatggttttaggtctaacatttaagtctttaatccatcttgaattaatttttgtataaggtgtaaggaagggatgcagtttcagctttctacatatatatccggctaatttttgtatttttagtagagacaggctttcgccatgttgaccaggctggtctcgaactcctaacctcaggtgatctgcccgccttggcctcccaaagtgctgggattacaggcgtgagccaccgcgcccggcccaaaacagacgttttgttttgtttttctgagagagagtctcaatctatcacccgggctggagtgcagtgatgcgatctcagctcactgcaacctccgcctcctgggttcaagcaattctcatgcctcagcctcctgagtagctgggattacaggcgcccaccaccatgcccagctaatttttgtatttttagtagagatggggtttcaccatattgtccaggctggtcttgaacacctgacctcagatgatacacccacttcagcctctccaagtgctgggattacatgcgtgagccaccacacccagcccagaacagacattttataaaataagacatttaaatctcaacaggcatataaaaagatgcttaacttcactgatcatcagagaaatgcaaatcgaaactacaatgaggccaggcatggtggctcatgcctttaatctcagcactttgggaggccgaggcaggtggatcacttgaggtcaggagttcaagaccagcctggccaacatggtgaaacctcgtctctactaaaaatacaaatattagcagggcacagtggtgcacacctgtaatcccagctactcaggaggatgaaacaggagaatcgcttgaacccgggaggcggattgcgccactgcactccagcctgggcaacagagtgagactctatctcaaaataaataaataaataaaataaaataaaattacaatgagataccatctcaccccagttaaaatggtttttatccaaaagacaggcaataacaaatgctggcaaggatgtggagaatagggaaccctcatacacttttggtgggaatataaattagtacaaccactatggagaacaatttggaggttcctaaagaaaacctaaaaatatagccaggtgaggtggctcatgcctggaggctaaggcaggaagatcacttgagtccaagattccaggagtttgagtccaggctgggcaacacagtgagacctcatctgtacaaaatataaagaaaatcagctaggagtagtgatgcacacctgtagtcccaggtacttgggaggctgaggtgtgaggatcacttgagcctgggaaataaaggctgcagtgaactgtgattacaccactgcactccagcctgggcaagagagtcagaccttgttgaaaagggaggagaggggaggggaagggaagggagggaaggtgtaggggaaaagaggggtgaggggaggaggggggaaggaaggggaggggaagaaaaggggaagggaggaaaaggggaggggagggaaggaaaggggaggggaggggggagaggaggaaaaggggagggaggaggggaaggaaggggaggggaagagaggggagtgggaggggaggggagagggaggggaggaaagaaaagaaaaagccaaaaataaagctaccaatccccctcctaggtatataccccaaagaaaggaaatcagtatgttgaagagacatctgcactcccatgtttactgctgcactattcacaatagctaaaatttggaagcagcctaagtgttcatcaacatataaatggataaagaaaatgtggcacagatacacaatggagaactattaagtcataaaaaagaatgaggccgggtacagtgactcacgcctgtaatttcagcactttgggaggccgaggggcagatcacttgaggccaggggttgaagaccagcctagccaacatgatgaatccctgtctctgtttaaaaaaatactaaaaatacaaaaattaaccgggtgtggtggcgcatacctgtaatcccagctacttgggaggctgaggcatgagaatcgcttgaacctgggaggcagaggttgcagtgagccaagattgtgccactgcactccagactgggtgacagagtgagactctgtctcaaaaaaaaaaaaaaaaaaaaagagagagagggatcctgtcatttgcaacaacatggatggaactgaaggtcattatgttaagtgaaataagccaggcacagaaagacaaacttcccatgttctcacttattttgtaggagctaaaaattaaaataattgaactcatggagataaagagtagaaggatggtaaccagaggatgggaagggtagtggggggtgagggagaagtggggatggttaatgggtacagaaaaatagaaagaatgaataagagccaggtgcaatggctcatgcctataatccttgcactttgggaggccaaggcaagtggatggcttgagctcaggaatttgagaccagcctaggcaacatggcaagactctgtctctactaaaaatacaaaaaagatcacttgagcctgggaggcaggggttgcagtgagctgagatcacgccactgcactccagcctgggtgacagagtgagaccctgtctcaaattagaaaaaaaaaaaagaatgagtaaggtgtatttgctagcacaacagggtgactatagtacaaaataatttaattgtacatttcaaaataattaagaatataattggattgtttgtaacacaaaggataaatgcctgggatggataccccatttaccttgatgtgattattatgcgttgcatgcctgtatgaaaatatctcatgtgacccataaatatatacatctactatgtgatgtacccacaaaaaagaaaaagagaaagaaaaaaaatagcataagtttcaggtctctgtctagaaagcttatcctcccctcccagcaccttcttcaccagacatatctgattcatccttaaggtctcagctcaaaagtcacttccccagcaagatcttccttgattactctctaaactgaactgcactttctgagactcatagcacccttttattcgtcagagagctgatcacaatttgtaattatgcacttgtttctacattcattggcctagtgtttgtgtgccttactagattgtaagcttcaggatggcaggaaccacatctgtcctgttggcccctgaactcccagcacctagaacctagaacatagtaggcaatcccttgataaatgtgttgaatgactgaatcaaggaagatggccactttatctatgagacatatcttaccattttcccctctcttttgttgtatttatttgggtttaagaatagacatacttccaatgctggagttggaattttataaccttctccaccaaacatttttatttctaaaatccaaagctcctctcaaacattgctccaaaatttctactgcctataaaagagacttgtgttgtgctataaagatgatatgaggctgggcgtggtggctcacgcctgtaatcccagcactttgggaggctgaggcgggtggatcacgaggtcaggagttcgagaccagcctgaccaatgtggtgaaaccccatctctactaaaaatacaaaaattagctgggcgtggtggcgcgtgcctgtaatcccagctactcaggagactgaggcaggagaattgcttgaacccgggaggcggaggttgtagtgagccgagattgcaccattgcaatccagcctgggctacagagcaagactccatctcaaaaaaaaaaaaaagatgatttggctataaaagattcaccccaccctgccaaaagaaagaaaggtgggcacagtggtgcacgtctgtagccccagacactcaggaggccgagatgggaggattgcttgagcccaggtgttcaagaccagcctgggcaatgtagttgagatcccatctctaaaaaatatctatctgtatagagtgcaatggtataattatagctaattgcagctctaactcctggccataggagatcctcctacctcagccttccaagcagctaggactacaggcacctatcaccatgcccaactaatttttaaattttttgtagagacaaggtctcgctctgttggccaggctggtctggaactcctggcctcaagaaatcctcctgccttggcctcccaaagcactgggattataggtgtgaaccaccatgcccagtctcatttctttattagaaaggacagctagggtgattgcctttcccttttccaatgtacaaagttagtttttaagctatccttttaatcacgtacacagaactaaatatagttcttgttcctaaaagtctgcagtatatccaagcacctgttagcagcttgccacacacctccatttagctttctcagcaaggtcactcctctgtgcagcagcagagaggaggggctctcctccagggtgcattctcattccaccttagtatttcttcattcactcaactaaaagttattgacgtaacaagtgccaagcataatgccaggcactggggacctaaagatgaggaagaccaggttcctgacctcatggaacttgctagctaatagaaggagtatgtagtaaagaacttaaccttgcaaagagtgttctggcctttgcccttcgctcctgggaggtaacctctaagcccttggaatgtcttgcctgataaaagtatctttgtttaccaggaggcagaccttaggccacactggacagtctaacaatgtgatttaggcagaagtctttggggcgtaccagatagtttagcaatgtgatgagggaggagggaagactttggatcacactttatcaggtagacttatggaggggctggagactgaggtcagtcacatgggcagacaatcaggtccacatgactgagccccaataaaaattttagacatcattccagccagacgcggtggctcatgcctgtaatcccagcactttgggaggccaaggtgggcagatcacctgaggtcaggagttcaagaccagcctggccaacatgggggaaaccctgtctccacttaaaatacaaaaattagctggacgtggtggcagatgcctgtaattccagctacttgggaggctgaggcaggagaatcacttgaacccaggaggtggaggttgcagtgagccaagattgtgccactgcactccagcctgggccacagagcgagactccatctcaaaacaacaacaaaacaaaaaaaaactttggacatcaaagctcaggtgagactgcctgattggcaatactctgtgagtattgttacacatactgggaaaattaactctgtccatgattccactgggagctctgcatttggaactttcctgctttctgctccgtgcatctcttcccttggccgactttactctgtttcctttcactgtgattaaactgtgattgtgaccataacagctttttttttttttttttttgagacggagtctcgctctgtcacccaggctggagtgcagtggcgcgatctcggctcactgcaacctctgcctcctgggttcacaccattctcctgcctcagcctcccaagtagctgagactacaggcacccgccaccatgtccagctaattttttttaatttttagtagagacagggtttcaccatattggccagctggtctcgaactcctgacctcatgatccacccgcctcgtcctcccaaagcactgggattacaggcatgagccactgcgcccagcccacatcttgatatttttgaatgctagcttgaaggacctatttcagagtgccccttacattttttttttttctttttgagacggagtcttgctatgtcgcccaggctggagtgcagtggcctgatctcagctcaccgcaagctctgcctcccaggttcacgccattctcctgcctcaacctcccgagtagctgggactacaggcgcccgctaccacgcctggccaattttttgtatttttagtagagatgggttttcaccgtgttagccaggatggtctcgatctcctgacctcgtgatccgcccgcctcggcctcccagagtgctgggattacaggcataagccaccgcgcctggcctccacctggtcatatttctttagagattatcaaactacctcttgccacctgttttaaagatggttgtgttggctgggcatggtggctcatgcctgtaatcccagcactttgagaggctaaggtgggcagatcacttgagctcaggagtttgagaccagcctgggcaacacggcgaaaccttgtctctaaaaaaaaaatacgaaaattagccaggcgtggtggctcatgcctgtaatcccagctacttgagaggctgaagcaggaggatcactgggaggtcaaggctgcagtaagctattattgcactactgtactccagcctgagcaacagggtgagcccctgtctcaaaaaaggaaaaaaaaaaaaagatggttgtgttataggttgctatgactgcatatttgttttctagccagccctctaaacagcacccagtttcttttttttgtttgtttcttttcttttcttttctttttttgagacggagtttcactcttatttcccaggcatggagtgcaatggcgcagtctcggctcaccacaacctctgcctcctgggttcaagtgattctcctgccttagcctcccaagtagctgggattataggcatgcaccaccacgccccactaattttgtatttttagtacagacggtcaggctggtctctccatgttggtcaggctggtctcgaactcccgacctcaggtgatccacctgccttgggctcccaaagtgctgggactacaggcgtgagccactgcgcccagcacccagtttctttttattgtagagtcatcttcccatgcaatatatttgagtgatgctatagtctgggataattgccctcccttagtcaagtgtcaggctcataactcaagatgggccaatcacattctcctcccacctcagctcccaagtagctgggactacagccagcacgcctggctatttttgtattttttgtagagacggggtttcgccatgtagcccgggctggtcttgaactcctgggctcaagtgatccacccatcttggcttcctagagtgtgggattacagacgtgagccatcacacggtccctaactgatactattgccatggcctaccttgcttgccttggcaggagggccagcttggcatgagttagcaaagaaccactatttgagatcacctattttatctcaagtactgctggaacccatgcacctagaaaagaccagggttttcaaccagtagatccagaataagcagtcttattgaatcaaaggatatatcagccaaaataatcaacaagcacaacttgatattttttaatggtagcttgaaggacctatctcagagtgccccttacatttttaactaagaagccagtattatctattgatcactgaatagcagtgtgtcccctggtcgtatttctctcactctctctgtctttttttgttgttacaaaaactgccagctctcacagtgattttaccacacctatgtatttacaatctttttttttttttattttttatttttattttttttagactgagtctcactctgtcgcccaggctggagtgcaatggcgtgatctcggctcactgcaacctctgtctcctgggttcaagcgattctcctgccttagcctcctgagtagctgggactacaggcgtgtgccaccacactcagctaattttttgtatttttagtagagacggggtttcaccatgttaaccaagatgctcttgatctcctgaccttgtgctcctcccgccttggtctcccaaagtgctgggattacaggcgtgagccaccgcgcccggcctacagtctgagaaaagtcatgctgagttccagtggctgcactggaagagtttgtgtcaccctaatccacttgtgtttggcagtgatttatccacatttgctatttctccacttggtcatttctcattaatgtctaaacctactgaaacctgacttctgttcctgccacttcaagtcctctcaaaggactactggtctcctgttttccaaatctgagggacatttccccagctttttcttacctgacttcagctgccatctatgtgctgatacctccagacctgtatctatctacttgccattcatctccagtcaccttaatactcagcatgtcccaaactgaactcaatacctttcctcctcaatccccctcaactgtgcttttcctgggatccttgtccttgttagtggcactcagtcacccatattaggaatctaggaatcatcacaatgatgattccatttcttatatttcacagctagtgagtcaccatgtcctttaattcccacctctctcttcatttcctctacaaccttaattcaggccttcatcatctctctcatagggtactgccagatcctcctacctagtttccctgccactagtcttttcccctttgaatccatccctgccatagcagagtgatcctttctaaaaatataggtttgatcatgttacttcaaggatgtaccattgactgcaagatacatgtgaagcttctcatcctgccatgcaagttcattcatgacctgaccttagtatatctctccagcctcataaattaccttgcctcctttgctgcctacttttcagtgatgctgttttacagttctgtgtataaatgcatctgtttcatacttttcccctacaccatccccgctcactctgacttcattcacctggtggatatacctattcgtctttgaaggactccattcaaaagacacctgtttgaacattttcctctgcaggtagagtagccattctttgtgccctccccatccatacagccagctctcacagtgattataatattttatcacacttatgtatttacatatatatttcccaaactcagggaatagtccacagactaccgttactttggataccagttgcaagtttggggaaccctaagactaccctctggttatataattcgccacaaggactcacagacctcattgaaagctgttatagtctctgggcgcagtggctcacccctgtaatcccagctactcaggagggtgaggcaggagaatcgtctgaactggggaggcggaggttgcagtgagccgagactgtgccactgcactccagcctgggcaacacagcaagactctatcccaaaataaaaaaaaaaaaatcaagttgtgattgttgataattttggctgatatatcctttgattcatgcagctgtccccagagtgtgtgtgcctgtagtgcctgtgtgcgccctttggggaagtagtccttccagacctgattatttctgaacagagtatggccaagtcactattgacactagcatgcatagcttctgaactgatatggttggctgctgatagcacagactagagcactcagaaaattatcaaacagagactaaatgtttaggcacttaaaacatgctccttggcaagaggaacacaatgttcctattacagaattgacctaaattcaggaaagagcttattgatgtaggcaaatgcttgaatctgcagccagcaggatcatcaatggatgagggtgggagcggggagtcttccaattttacaaggtcagcttgagcaactctctaagagccgacactaagactagttccactggatgtactgaagttgtataatcaggctccaaataactactacctctgcccaaatctgttcccagaactaatcaacatgcagggaccactgcatgtcagacaagagctgacctggatccctgtgaaaatctgtccacaggacactagtgctgctggagggaatggtgaagtacttgtatccatgacagagtcctagaaagatgggaagcaatatgggagctgactgaagccacaggaagtgggatccatttcctgaatacaaagcagaaactaattagtcagtttccaacacaatcttccattctcacagctgccaaagacctccagttcacaaatctcaagagaccttgcctgctcaaagttctttcttagctcctttcatccatgacacaaaatctaaaacctgctatctctctccagcctcttctcccaaactgtcctggtgggcttcttttctcacaggagtgtgagctcctcaagggcagggactaagtactgtccacctccataacccctctacttggcaggggcctaggacaagcttatctcctggtaggcacaaatgtttgctgaaggagtgaatgaactacatttgcattttatctctggcaatgtctaaaccaaagaaaatcacacttgtcttctcagaagagggaacatattcaaatacccagaattgcagttcctggtaaaacctttcggcggcagcagcaactggaaactcagcagaatctttgagtactaaaaagagtgaaatgggccaagacttgaacagccatggttgaagtagcccaggggactgagatgggaaggggagattcatggctatctaaagcttaagaaccacaaaccagttctttcttacaaatcacatatatttacattgtggatctgggatacacttatcacagtaggagctgctcaaatcaatctgaatgctacgcaatctgggaacctccccataactgtttgagccagcatttcagattatagataagctgtttccagctggactgggtttggaaagttcactctaaagaatgaagtcacctgttgtcactgtcctcctctccaggattccttttggggccaggtaccatcctgtggctccttaaggaggcttctctctttaattctccatgaggcatccagggtggtctgggctatgggaagaacccttcaacttgggagtagacaggtgctccaattcatagtgcccattctcagaggccttgtgtgtgagtttctccttcatgccttccttctggctcttcttgtgctccataatctgctggagctggtgcccagcatagtctggcttggtggtcagcgggccagccggcacagctacaccaaggacatctgacaccatgtaggggcgcagccagcccaccaagggagtgcttccggggctgtagtgggtctgtttgtggtagaagagaagtccatctacctataagacaaggggaaattgaggatcaaatgacttctggggccacatgtttccaggagagcctatacacacaagggcagctcttgtggtccgactcctttttctgggtcactgacagaggaaagagtcccagcttctcacacatgccgtttctctaaataaagaaatggcctagaaaactaaatttgagaaaataaaaacattggctgggcgtggtggctcatgcttataattccagcactttggaggctgaggcaggcagattgcttgagctcaggagtttgagaccagcctgggcaacatggtaagactccatttctactaaaaattcaaaaaaatagccaggcatgtgtggcacatgcctgtaatcccagctactcgggtgtctgagacacgacaaccgcttgaacccagtaggcagaggatgcagtgagctgagactgcaccactgcactccagcctggcgacagagtgagactctgtctcaaaaaaagaaaaaaaaaaaggaaaggataaacataaatagcactttcctgtttacagagtgctttcctgcccactattttactatcttacccatgacggtgtctgagagatggggctgctcatactcagggagttctgaggacctccttaaaacacacagtgagtaggaagcaggacttcaacttgaactctggtcttctgtccccagattccacggactttccaccacttaggggtctgtgttgtggtggatgagctctgtgcatggaatgaaaagcagaggaactggacaggcccctccggggcagcagattgctgcacacagtggaaacaggctgtccagatgccctgcttccctggctactgttggttgcctaaacctccccctaaattgtttgtgagccatgttctgggaaacagtttttctcaacgggaagacctcctacagtcccacattttattttctatgattcagtgactcatctctaaaaagcatttattgtcactggggcataagggttataaataaagatggtattcttaccaccttcttaattgactcccagaaatgctggcaactcagcctttgccatttccttatttgggaagctgtgatccttatataaaattacatccagttcaagcaaatgcttgcagtgactgggcagatttttttttttttttttctttctgagatggagtttcgctcgttgcccaggctgcagtggagtgcggtggtgcgatctcagctcagtgcaacctccgcctcccgggttcaagagattctcctgcctcaacttcccaagtagctgggactacaggcgtgtgccaccatgcctggctaatttttgtattgttagtagagccggggtttcaccatgttggcgaggctggtcttgaactcctgacctcaggtgatccaactgcctcgacctcccaaagtgctgggattacaggtgtgagccactgtgcccggccaaggcagaatttttaagggaatgatgggcaaaggaaaatgtgcttgttgagcctagagaaggtagctgcaggttctgaggctgacaagactgttgaggactggggagcctctggggctgtgaggtttgttttttgttttttttttttgagacagagtcttgtgctgttgcccaggctggagtgcagtggctcaatctcggctcactgcaacctctgcctcccaagttcaagtgattctcctgcctcagcctcccgagtagctgggattacaggcatctgccaatacgcccagctaatttttgtatttttagtagaaacgaggttttgccatgttggccaggctggtcttgaactcctgacctcaagtgatccaccggcctcggccttcccaagtgctgggattataggcgtgagccaccatgcccagccgctgtgagactttcagtgctaaaacagggcgagtcctgagcaaactggaatgaggtggtcacctgactcatgctcctgctcagcaagtgctgctgtccccaagggccatcttctttggtgaggaaaggattagggatttggacatttgttggagtcattcagtcacagaagcaccttcactttacaagcagccacgacagccaaaccagggacctgggtctcagcttgcagtaggaagaggcacacaagaaggatctaggcatgcaagtcttgctcctatctgggcctcagtttctccggacctcagtttctccatctgtaagatgagggagttggacgagctgtccattaagggcccttccagtgccagcattctgacttatccagcatgggtggagctcaggctctgaagggcagcaagtacatcctttctccagaatcagctttgtcccattctgatgctttgacacagcacaatcaaggaatattttaagactttgtgtaactaagtctctctgcagcctatcatcatgtcaaggcaataaagacaatggtttcgttacctcaaaagggaaatccatagatagcacatcacacaggctttcgggagtgcaagggaagttctttagccccacaaatttaaactgaaatagaaattagaacaaggaattagtacgttataaatgatactggcccaagcaattgaaaatctctgtcaggccaggcatagtggctcacacctgtaatcccagcactttgggaggcaaagtcaggaggatcacctgaggtcaagaaatcaagacaagcctggccaacatggtgaaaccccgtctgtactaaaaatacaaaaattagccaggcatagtggcatgtgcctgtagtccaagctacttgggaggttgagggaggaaaatagcttgaacccaggaaggggaggttgcagtgagccatgatcatgccactgcactccagactgggtgacagagcaagactccctctcaaaaaaagcaaaaagaaaagaaaatctctgtcaaagaagaaaaacttgtagtcccagctacttgggaggctgctgaggtagaaggatcgcttgagcctgaggtcaaggctgcagtaagctcagattgtgccactgcaccccagcctgagtgacagagccagaccctgtctcaaaaaccaaaccaaaccaaactaaaccaagccaaaacaaaaaaacaaagaagaaaagttttcagtctcatccttctctactaattcccctctacttactctcttaactactaggtcgtggttcccaatctttcctcccccttttttttaagagatgagatctcattctgtcacccatgctagagagcagtggcacaatcacagctcactgcatcctcaaattcctgggctcaagggattctcccacctcagtttcccagtatgctgggattataggcatgagccactgtacccagccccaaccttcttttatccacaagaatcatctagggagcttttaaaaattactgatactcaggaggctgaagcaggaaaatgacatgaacccgggaggcggagcttgcagtgggccgagattgtgccactgcactccaacctgggtgacagagcgagactccgtctctaaaaataaaaaataaataaaaataaattactgatgctggccaggtgtggtggctcacgcctgtaatcccagcactttgggaggccgagaagggcggatcacgaggtcaggagttcgagaccagtctgaccaatatggcgaaaccccgtctctactaaaaatacaaaaattagccaggcatggtggtacatgccagtagtcccagctacttgggaggctgaggcagaagaatcgcttgaacctgggaggcggaggttgcagtgagctgagattgtgccactgcactctagcctgagcaacagagcaagactcggtctcaaaaaaaaaaaaaaaaatattactgatgcacaggccctactctgagattctgactgaactggtctggggtgggatccaggttttttgttgttttttttgagacagagttgcgctctttcacccaggctggagtgcagtggcacaatcacagctcactgcagcctcaacctcttgggctcaagtgatcctcccacctcagcctctcaagtagctggaactataggtgcacgccaccatgcctaatctgtttttgtatttttttgtagagatggggttctgctgtgttgcccaggctggtctcaaactcctgggctcaaacaatccacctacctcagcctcccaaagtgatgggattataggcacacatcaccatacctggctaatttttttgtttgtatttcttttgtagagatggggttttgccatgttgcccaggctgctccgaactactgagctcaggcagtccacctgccttggccacccaaagtgctgggattacagatgtgagtcactgtgcctggcccaggtattttttttttttgagacaaagtctcgctccctcacccaggctggagtgcagtggcacgatctcggctaactgcaagctcggcctcctgggttcacagcattctcctgctcagcctctcaagtagctgggactataggcgcccaccaccacgaccggctaattttttgtatttttagtagagacggggtttcactgtgttagccaggatggtctcgatctcctgacctcgtgattcgcctgtctcggcctcccaaagtgctgggattacaggcgtgagctaccgcactcggcctggcccaggtattttttttaaagctcttcactgggccgggtgcagtggatcacgcctgtaatcccagcactttgggaggctgaggcaggcagatcacaaggtcaggagatcgacaccatccttgctaacacagtgaaaccccgtctctactaaaaatacaaaaaattagccggtcgtggtggtgggcgcctatagtcccagctactcaggaggctgaggcaggagaatgctgtgaacctgggaggcggagcttgcagtgagccgagatcacgccactgcactccagcctgggtgacggagcgagactctgtctcaaaaaaaaaaaaaaaaaaaaagctctccagctgattttaacatacagtcaggagtgggaaccactgtattgtactaggttgagtggttgtgtgttattctcttggccccatgacagctaccactaataaagggctagtgaaatccttttcacacctgcaaggatttttagactgaagcagcataactaagtgattagaactacaaactctaaagtcagattgcttgggtttgaatcccattctgccaatcatttaacctccatatactttcatcttcccatctgtaaaatgggataacaacagcacatatctacttcgtagggttactgtgtggattcagtgagataatatacatagagcacttaaaccagtgtcttagagagagcagtcttccccttcctcaatgcatgttcctccaggacctacatgataataacatcactgaaagtactgatcatatttattctcctataactggttgtccaattccctttaactttttttttttttttttttttgtgacagagtctcgctctgttgcccaggctggagtacagtggcacaatcttggctcactgcaacctccgcctcccaggttcaagtggttctcctgcctcagcctcccaagtagctgggattacaggcgtgcaccactacacttggctaattgtttttgtatttagtagagacagggttttgccatgttggtcaggctggtctcgaattcctgacctcaaatgatccacctgcctcggcctcccaaagtgctgggattacaggcgtgagccacggcgcctggcccttggctttaacattttttgtgagcaatccaagcaaatgccaatctgcagggctaataaaatgccctgaaaatagctgtcacatatttaaatcactgattattattgagtgcctaccatgagtattatgttaggaggacttgcatatttatataatttggttcttataacaaccctgtaaattagatgttattaccctatttttcagatggaaaatctaagggtaagtgagattattaacttaacttagtaataaattttttttagtctttttttagttattattacttcaataggtttttggggaagaggtagtgtttggttacatgaataagttcttttgtggtgatttctgagatttggtgcacccaccacccaagcagcgtacactgcacccaattatccctcatcccccttacccttccccagagttcccaaagtccattgtgtcattcttatgcctttatatcctcatagcttagctcccaattatgagtgagaacataggatgttaaattagtaataataaaagccaaaaatggaattcagatctacatgattgatactcttccctttataccatgctgcctcaaaaaagatcatttcatacataatgattatatttagataacagaccaatccacactactccccataaggaactcagtgatcctaacaccaggccttacaggattaagcttggttttctctcccagtccttcttcttctggtaactttgaatgcatccagtagaatcggaaatcagtctgccacagagaagggaaacagaaagatgaaatactttccatttcaaactctaatataaacaaaaacaccccatgctatttttttttttttttttttgagatggagtgttgctctgtcacccaggctggagtgcaatggtacagtctcggctcactgtaacctccgcctcccaagttcaagcgattctcctgcctcccaagtagctgggactacaggcgcccactgccacaccaggctaatttttgtatttttggtagagacagggtttcaccatgttggccagagtggtctccatctcctgacctcttgatctctccacctcgagcctcccaaagtgctgggattacaggtgtgagccactgcgcccaccgggcctcttcattcttttaaattattttgcttttggaaatttaaaaagatacatacagtcttttgtttacgttataaaaatatatttggttttagttaccaaatttgtaggttgtgaatacatgtaataaaatatccttcagcagaattaaaggaaaatatgttctagattgaatttatgttctgagttgtaggcttggttctacacgtgggcaaggtacttaagacctgtgcttcttagcatctcagcttccatatctatatgtcaaggacaggccaggtgcagtcgttcatgcccagcacttcggtaggccaaagtgggtggatcacttgaggtcaggagttcaagacagcctggccaacatggtgaaacgccgtctctactaaaaatacaaaaattagctgggtgtggtggcaagcgcctgtaatcccagctactcagaaggcggaggcaggagaagtgcttgaacccaggatgcggaggttgcagtgagcccagatcgcagcactgcactccaacctgggcaacagagcgagactccgtctcaaagaaaaaaaaggatgataatagtacttaccttacaataaggacgtgttgtaagggatttaatgagctaatgcagaaagtgcttagcaatgcacatcttgattgttattgtttgaatgagatgcaccttagaattctgagtaccaatacctagtgtgttttggaaacctagtatgcgggaatggcttagaaagaagcagcctatggtgacagcctgcatgaagatcactggaggcctgttcacacatcagcctcaggcccatttctacaacgttctgatatgcctggtctggagactacacaccgagaaccactatgataaactaattgacagggagcaaaaggaagtaccaaaacccccaaacccaccattatacaactgggacaatgacggggagagtgttcttaacagggatggaggccggtggggctcactcagcctcacctgatgactgctgctgttacctgttaagaatcaccaatagtaaaatgttgggggtatggtgaaacagaaggggagaatattggggcctctcctcctttgaaaagtctcctcctagagctaacctttgagatttgaggttctgggtcataccaaggaggccctgccattttcagggtcaggatgtggttggtgaaggagtggaggttgcaggagtctagtagatggtgacttacattcaattccaccttctcttcctggggctgctgcacaaggtggcatccccacccccttgccccacaatcttcactgccagaaatcctcccatactctggagagagataagggggtgggtgcagctgctatcaagtcccagcctacacccctgccatttctttctttcttcctctcaagaactgcatgtttctcttagttcctcctatttctcttttaaaactaagctaatttaaacacactcaaagatgcagggagcattagataatgttcttgatataccacatcctgtgcacaccaagaagttggtcacataccaaacccacatgctgagccgctttcccaggaggagaggagaagacaggaagagccacgagaggaggatccatccctacctggcaatcataaaaagggtgtccccgccagcacatcacatccagaacgtagtaggtctggtttacctcattgtaaatgcaatctagaatggtgtagtctgaggacacaaagcagaaagtcagcacagagttcttcttccaaccaggttccctccaccacaacctagggagccccatcccagaggcttgagtccaacaatcctcagtgcttgcagcagtcactggcactaaggactaaggattcactggggagagaaccctgcctggctaccagctacagcttcatggtgactcagggtaagacagcacaagacgcatcaaggcaaaccttaagcaaagtgagaattctgaagttttagataaactggcacatttactcacctcaacgaggtttaaaagcaagtcatcttccattttagtttacaactgctttttgagttcctatcataggcactgtgttatgtggggaatattaactataaatattccctgcctttaaggaagttaccatttggttaaggggataagatgatcacagaagaactaagagctaaattacagagctcatactaagagcaacaggagttcccgaaagagaaggctggagcagcaggaaatgcttcaagggagagatgccatacaaatagtcttctgggaccagccgggtttaaacaacagggcagaggggagaagagagggcatttcagacccaagtactgatgtggcatgagcaaagccccagaggcagaatgaactgggcacatgtggggagataagtcagctgaacagaaggtgggtataaggagtaggggaaagacatgggatgggtgggacaaagcctgcatgtgaaaggtactaaacgccaacagagaagtcagagcaaggccaggtgcagtggctcacacctatactcccagcactttgggaggccaaggcaggcagatggctttgagcccaggagtttcagaccagcctgggcaacatggcaaaaccccatctctaccaaaaatacaaaaaattagctgggcatggtggcacactcctgtagtctcagttactcaggaaattgaggtgggaggatcacttgagcctgagaaataaaggctgcagtgagctgtgatcatgcccttgaacccgagcctgggccacagagtgagaccgtgtcaaaaaataaaaaagagaagtctgggctcagtacagaggacatgaggaaccaccaaaggagcctgagcaggtagagaagaaagcaagcccagctctgccaattccttactgaataactgtgggtaagttatttctcccccacgaccttagtctactcagctaggcccagtggggaggaagaacctaaggttacaacaatgagaaaggagaaaagggagtttggcagggaagccccagcatcagctggctgtaccattatgcttagtattctctcagagacgtttccccccaaatctgtatctgttgtcccgtaatagaagtccaaagatatgttgaccttaattcaggaatttacggaccatcaggcctcatggggctgcatttattctgcaactggggacgcttgaccttgaaggggaggtccttggtccaggggccaggatggtgtctacatgcagtttcaaagataagctttcaggccgggtgcagtggcttatgcctgtaatcccagcaatttgggaggccaaggtgggtggatcactttgaggccaggagttcaagaccagcctggccaaaatggtgaaatccagtctctactaaaagtacaaaaattagccgggtgcagcctataatcccagctactcaggaggctgaggcaggagaatcacttgaacccaggaggcggaagttgcagtgagccaatatggtgccactgcactccagcttgggtgacaaagtgagactctgtctcaaaaaacaaaaaaaaaaaacaaagataagctatcaaagtgggtcttttttttttttttttttttttttttgagacggagtctcgctctgtcgcccaggccggactgcggactgcagtggtgcaatctcggctcactgcaagctccgcttcctgggttcacgccattctcctgcctcagcctcccgagtagctgggactacaggtgcccaccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcccaaagtgggtctttaaagcaaattacactgtcttttactgatcaataagtagacactctatgtaggtaccttttgctgttgagtttcgcctgttgcctcctggcagaagtgaagaaaacctgttgacacagtagccactcttggtgtaggcactggtagaaccctgcatggagagaaagttaccattcttattagacctcaaggtctcctcgccctcttgcctcctcattctgcaggaatgttactcgaccaaagatggctctcaacaaaccttcctgcaggaaagtgtttcaagctccactccaggcacagctgttgtggcgtatgaggaaaatggagcacaaagaatccctcccactacagaccaggcctactggcatagggggcaggcagctactcaccctggaggccacgataagggctctttttccaacagggcacacgaccacaatccattcctgccccaaatctgaaggaacgtcaattaaccactcagaaagcatcaactggaaatgcaaaaaatagtgttaaagatcagcaggggtgtgctactcgaaagtctgcaatgacaaggcattaatatcctgtgtgtatattaaaaacctgagtgaaagaatgagggcagagagccgggcacgggggctcatgcttgtaatcccagcactttgggaggctgtggcaggtggatcacctgaggtcaggagttcaagaccagcctggccaacatagtgaaatctcgtctctactaaaaaatataaaaaattagctgggtgtggtggcaggcacctgtaatcccagctactaggaaggctgagccacgagaattgcttgaacctgggaggcagaggttgcagtgagccgagatggtgccattgcactccagcctgggcaccaagagcgaaactctgtctcaaaaaaaaaaaaaaaaaagaatgagggcagaaaaggctgacagtggcacctccaccccatgtgctctagggagttggctgtgtctcctgcacagctgacaggatgatgggggccactgactatgaactttggcttctctcctccatctccacctgcaaccacaccatgcttactgcctcacctcccgggtcagggtgatgaaccctcttcctttccttactttgtccatctgctcctatcatcattactattatgtttgccacaactcagagatgaataagatccctgaccttgagatgctcttagactagaccagcatttctcaaaccgatgccccaaatactatactacaggatgttaggaaatctgtcttaaaaaacgaaacaacgccaaaccaaaccaacaaaaacagtgatgtggtgaaattaatttgggaagacaaactcttccactcagtctcttccatctgtaaagactttgtcccatgggctgggcgaggtggctcacgcctgtagtcccagcactttgggagaccaaggcgggcggatcacgaggtcaagagattgagaccatcctggccaacatggtgaaaccccgtctctaccaaaaatacaaaaattagctgggcgtgttggcgggcacctataatcccagctactcaggaggctgaggcaggaaaatcgtttgaacccaggaggcgcaggttgcaataagccaagatcacgccactgcactccagcctggtgacagagtgagacttcgtctcaaaaagaaaaaaaaaaaaagactttgtcccatcaattaatctctctcattgaatctttcatttctccttccctttaggcactcactcccaatctttttttttttgagatggagtctcgctctgtcgcccaggctggagtgcagtggcgctatctcagctcactgcaagctgcgcctcccgggttcacgccattctcctgcctcagcctcccgagtagctgggactacagtcacccgccactgtgcccagctaattttttgtatttttagtagagacggggtttcaccgtgttagccaggatggtctcgatctcctgacctcgtgatccgcccgcctcggccccccaaagtgctgggattacaggcatgagccaccacgcccggctcactttaaaaaaaaactttttgtggccaggaacggtggctcacgcctataatcccagcactttgagaggctgtggcgggcagatcatgaggccaagaaatcgagaccatcctggccaacatggtgacaagccgtctctactaaaaatacaaaaattagccaggcgtggtggcatgcacccgtagtcccagctactcgggaggttgaggcgggagaatcacttgaagctgggagatggaggttgcagtgagccgagatagcaccactgcactccagcctggcgacagagcgagaccccgtctcaaaaaaaaactttttgtcactcagcatttctgttgagctactccactttctcctagtttaaaaactacttaatacttcttgatgctgccttcttgctcaatctgacagccacagtccagatttcctaccccacagtcctactgaaggccctctgacctcttctcataactcttcctttttttcctttttttttttttgaactggagtcttactctgtcacccaagctgaagtgcagtggcacaatctcggttcactgcaacctccacctcccgggttcaagcgatcctcccattttagcctccctagtagccgggactacaggcacacgccactacgcccggctcatttttgtatttttagtagagacagggtttcaccattttggccaggctggtctcgaactcctgacctcaggtgatccacccacctcggcctcccaaagtgctgggattacaggtatgagccactgtgcctggcctcccatacctctttcttatcctccccactctactcctcgccttacgtaatgctaccagccacatctcccttcctgacatccgttcccttggcaccatgacatagcactactctgtttttccctctaaacattcctccacacactcccccaaaatatgtaatcttcagggggctgttttaggtcccccttttctcttagatgctgttcccattaggggtggatctcatctatttctatagcttcacttgtgcctcctaatgctccttcatctccagacttctttcctccacactcatctatattgcgagatgtctgcttggtatctctttctgtttgtctcctctgcaccgaaaactcagtatatccagagtggaattaactgccttctgttgcctaagtacttcccacccctgaaacacctacccttcccttctgcgtctcataaccttgttaatggcatcaccactccgttactgaatcttagagtttaagcataatctaggcaaattagactacatcaaaatttaaaaattctgtgctgccaacaatatcaccaagaagacaaaaagacaacccacagaatgaaagaaaatatgtgcaaatcatgtatctgataagaaacttgtatctagaatatattaaaaactcttataattcaataataaaaagataaataactcaattaaaaaacaaggagggcagatcatgaggtcaggagatcgagaccatcctggctaacacagtgaaacctcgtctctactgaaaatacaaaaaaaattagccgggcgcggtggcgggcacctgtagtcccagctgttcgggaggctgaggcaggagaatggcgtgaacccgggaggcggagcttgtagtgagccaagatcgcgtcactgcactccagcctgggcgacagagcaagactccatctcaaaaaaaaaaaaaaaaaaaaaaaagagcaaaggatttgaatagacatttctccaaagaagatatacaaatgaccaatacgcacaagaaaagatgtttaacatcaggccaggtgcagtggctcacacctgtaatcccagcactttgggaggccgaggtgggcggatcacaaaatcaggagttcgagaccagcctggtcaatacgctgaaaccccgtctctactaaaaatacaaaaattagccggaagtggtggcgggtgcctgtagtcccagctactcgggaggctaaggcaggagaatcgcttgaacctgggaggcagaggttgtagtgagctaagatcgtgctattgcactccagcctgggcaagagagggagactccaactcaaaaaaaaaaaaaaagaaaagaaaagaaaagatgtttaacatcattagtcactagggaaatagggaaatacaaatcaaaaccacaagaaaccacttcacacccactaggatggctatatttaaaaggatggacaataacaagtgttggcaaagctgtggagaaattggaacacttatatgttgctggtgggaatgtaaagtagtggagtcactttggagaacagtctagcacttcctcaaaaggttaaacagagttatcatatatagacccagcaattccacttctaggtatatacacaagagaaatgaaaacatatgctcacacaaaaacttgtagtacaagaatattaataatggcattatttggctgggtgcagtggctcacacctgtaatcccagcacattgggaggccaaggcaggtggatcagctcaggtcacaagttcgagaccagcctggccaacatggtgaaactcccgtctctactaaaaatataaaaattagctgggtgtgatggcacacacctgtagtcccagctactagggaggctgaggcaggaagatcacttaaactcaggagatggaggttgcagtaagccaagaacatgccactgtactccagcctgggtgagagagtgagacttcatctcgaaaaaagtaaataaataaaattaattaaaaaacaaataaaaatggcattattcataatagccaaaaagtaggagcaactcaaatagccataaactgaagaataaataaacaaaatgtagtctatccatacagtggaatattatttggcaataaaaaggagtgaagtactgatacatggtacaatatgatgaacgttggaaacctcatgctaagtaaaagaagccagtcacaaaagtccacatattatatgattccctttctatgaaatgtgcaaaataggaacagaaagtagattaatgattaggggctacagggaagaatggagagtgacactaattagtatggggtttcttttggggataaggaaaatgttctagaattaaatagtcgtgatggttgcacagtcttgtgactacactaaaaaaaaagaaaccattaaactatacaataaaaataggcaaattgtatggtatgtgaattatatctcaatataactgtctaaaaaatagtagtagcagctaatacttgtggggcacttccagactctgggctaggtatttaaggcatattatttcatttaatccttctaccaatcctatgagataagtactattactatccccattttacagataagaaaccaaagacttagagtggctaaaataccttgcttaaggtcaacacagagcctagctttgagatcagatctgtgtgacctcaaagcttacatcctttcccacttcttatactgcctctcatatccagtccactgctaagttcttccattctatctggcaacatttcttttttatttgttttatttattttttattttttatagaaatgggatcttcctatgctgtccagctgggattacagacacccatcacacctggctaatttttgtatttttaatagatggggtttcaccatgttggccaggctggtcttgaactcctggccttagcctcccaaagtgctgggattacaggcatgagccactgtgcccagcctctgcacatatttttgaggccctttacatctcttctgccatactccttctcccaactctatgccactctaccctaactggcctgcaaactgctcccgggcacaccatatactcctttctggcttctgggcctcgtgctcagcctgtttgttcccactgcctggaatgccctaaaatgcactgcacttctatctattaatgtcctacttacccttcaaggctgcctcttccttcattaacccttctctgatttcacaccccctccttcctccttggttggaaggaatctcatttttttttttttttttttttttttgagacggagtctcgctctgtcgcccaggctggagtgcagtggtgtgatctcggctcactgcaagctccgcctcccaggttcacaccattctcctgcctcagcctcccaagtagctgggactacaggcgcctgccaccaccacgcctggctaattttttttttgtatttttagtagagacggggtttcaccatgttagccaggatggtctcgatctcctgacctcgtgatccacccgccttggcctcccaaagtgctgggattacaggcgtgagccactgcacctggccagcatctcacttttttatagcacaaaacatcttctacacctattctaggagcacaggggctatttctgctccacatctatcttcccatgtcatagcctagtttaacacagagcaggtctttcaataatgcttactgaacaaaattgaattgtactttgtcacagaggatgttatctgtactgtatttggggtaaagaaaggggctgtgggagtgcatccaataaccatattctattgtgtttttttttttctttagagatggggtctctccgggtgcagtggctcactcttgtaatcccagcactttgggaggccgaggggggtggatcacctgaggtcgggagttcgagaccaacctgtccaccatggtgaaaccctgtctctactaaaaatacaaaaacttagccgggtgtggtggcaggcatctgtaatcccagctactcgggaggctgaaacaggagaactgcttgaacccgggaggcagaggttgcagtgagccacgatcgtaccactgcactccagcctgggcaacaagagcaaaactctgtctcaaaaaagaaaaaaaaagagatggggtctcactatgttagccaggttggtcttgaactcctggcttcaagtaatcctcccaccttggcctcccaaattgctgggattacaggtatgagccaccacactcaggcccaggaaccatattctaaaggcaggggagaattctgagatgacaagatacttgggttctagacacaagtatatgatagcagggtagacctccatcccaacttggacccataccctgctttctgaaatacctgagctgcctggaacacaagaacagtctctctccatacctctttccctatggtaccacagccatgttggtttcctctctggatctaaaagggcactgagtcaggtttattatagtgatctgctgcttcatggcctgaacctcaccttggccagctggctggtctggggtggctgggcaggctcactttattcaagggcagctgtacttcccacttgccaccacctgagtgtgaaatttcaagactggcctcatagtacactgcctgggaaagactctaccacccagggaagtggaaggagtcagtggtaggctgggcaggcccaatccagaacagctgtgcagtgacaactaaaaaaaatgacaaggatatggagtgtgttactatatcaatagctcaggggctttctgcagtgggctggcagcctttggtaacagcacaggctaatagttcccaaaccccactacccacagattccatcagtgattcctagtcagtccatagcacagtaagccatctctacttatcatcccatatgatctacgtacactggcatgttctttgcagttcctattcctttttcctgcctcattctcctctctttatgacagcatttatttcagtgggctttgactgcatagtaaagggagtgagattagctgggtctcatcttctctggaccacttacttgattagcatagtgttttggtaacttcttgacagtgtcaatgtccatttcttcatcatctttcttattttcttcctcactctccatccctgtccagtcatcttcagccagtcttctggcatggttcacataatccagccgcttgctggaaggaaaaaaaaggcataaggacatatcttttcttctttttttttttttagacagggtctcgctctgttgcccaggctggaatggtgcaatctcagctcactgcagcctcaacctcctgggctcaagtgatcttcccacctcagcttccacagtaggtgggactacaggcacacaccaccacccctggctaatttttgtattttttgtagagatggggtttcaccatgttgcccaggctggtctcaaactcctggcctcaagtgatctgcctgcctcagcctcccaaagtgctgggattattaggcatgaaccaccgcatctggccagggcaggtctttatgtcttttaggaagatgccctataatgcgacacatttaattcaaaagctccaaatttgggagcaacttggggattctggtggaagtaagaaatgatggaatctcctttgcaaggctaaaacagtgaccgccccctcaaaatcctaaatagcgaaaccccctctgaatacactcagccttcctcagagtttcctaagaatgcaaaataaaatatctaaagaaatttccaaggttcactagatggaaaggctagcttcacccctaccccatcccaccccagatgagagctgacaccttcctgcctagcagacatctcatccaaagaccccaggggtggaagagaagagccactgagatgcagtgagaagtctaaagcaaggacagcttctggagatttctgccttatacaccttttttgtttttaaagagaacttttttttttacggaccgtaggtgtatgccactgtgcccagcttatacagctttctcagaagccaggcctttctccagttcctgtctaactttcaaaaaaggtcacttagtttacaatttaatatattttatttatttgtttccctttatcgttatcttgttttaaaacaacacatgctagaaagtttgggaaactgaaaagaaaaaaaaagaatcttttggaacctaattgtttcaaagtgatttggaaataccacataacctcccacatttgatttcttcaatgctaaggcaggaattcaaccactgaggcagtgaaaccaacacagctggtttctcttaaacacatacatgttcatgctcattataaaaaggcacacaccagagagaacatatgaaagcacaatggtcttttatctcgagaataaaagagctggtatatttgtacatgtgtgaaagaaagtctgtctgtggttatttcctgaacattgtttgtaatcacaagagaagaaaactgcccagatgcccatcaggagggactggcttgatggcattatgaagtatccattccacggaatacctagcaccacgaaaaaggaatgatgtggtactttatgaactgatatagaatttctcccccaaaacaccactaaataaatgtgcagaacagtatatagtatactgctacttgtgttaaaaaaaaaaaaaaaaaaaaaaaaaaaagccaggtgcagtggctcctgcctgtaatcccagccctctgggagggtgaattggccagatcacttgagctcaggagttcaagaccagcttgggcaacatggtgaaattgtgtttctaccaaaaataaaaaaattagctgggtgtggtggcctgcaccagtggtcccagctacttgaggggctgaggttgcagtgagccaagatcatgccacagtactcagcctgggagatagagtcaaaaaaaaaaaaagcttttgtacacatactaccacacacacttgctcatatatgtatagaatatcttcggaagggccaggcgtagtggctgacgtctgaaatcccagcactttgggaggtcaaggtgggaggatcagttgagcctaggagttcaagatcagcctgagcaatatagggagaccctgttcctacaaaatataaaaaaattagccaggtgctatggagtgtgcctgtagtcccacctacttcagaggctgaggtgggaggatcacctgagcctgagaggttgaggctgcagtgagccgggatctgcacactccagcccgaacaacacagtgacaccctgtctaaaatatatatatatttggaaggatacaccagaaactaataatataggagaggaactggatagctaggggacagaaatgggaagacctcaccatatactcttctatttattttatttatttatttatttattggagagagtctagctgtgttgcccaggctggagtgcaatggcgcgatttcggctcactgcaacctccacctcccgggttcaagtgattctcctgtctcagcctcccgagtagctgggactacaggcacgcaccaccatgtcgggctaatttttgtatttttagtagagacaagttttcgccatgttggtcaggccagtctcgaactcctgacctcaggtgatccacccacctcggccacccaaagtgctgggattacaggcgtcagccaccatgcccggcctcttatgtatattttaaattttcaaccatacaaatgtattacctattcaaagataactacatttttaaaaatggggagaggaatgatctgggaatgtattctgcaagccacccagagccacagggaaccatctctgccaaacacaaccagtgatgcaacactgggcaaaatgcagactgtatggaaactatgcagctgttagtagtttcttctgatccctaattccttaatttatgacccagaagaggcccatgctgcattgagaatacaaggatcggccctgccttcagagtagctcagcctcaaacactcttatcctgccctctttccctgtttgcacatcttggcacttagaattaagtatatggaagacatttcctcagattcccttaggaattatttgtcttgaactcccaagagtgccacagaaacatttgggctgaaggcagatgggaagaccacaccaataccagcattcagagtgcagaagccaaacacaagcatcccaggaaatgtggggagtgaaagtctgggcgtggctttcgcaagttcctaaaccacagagctcagtacagctgccaggaaaaaaagaaaaacttaaccaaataattgagcttttggtttcaaacttcggtgtctccctaattcctcatcttctcctaagctctgggtataaaagaaacctacctctgccaggatttacccctcccaacctgtgggcaagaagatcagcctacaaagagtctactttgaagggagagtctgtagagacaagcctagagccttcggaatggttcatagctcctagcccagagaaagaagacaaggagttaaagcttccttacgatttctgcagttccagtaacctccggcggcgctcactctgctccaaggaactgtacttggacttgtactgggataggcgggggtgtggggcagctgtgctgttcagatcttgagacacagaaaagctactagccagggcctgactcaactcttccatcttccctacaaaggaaaacgtaagaaaatggttcattcatttcatatcatctcctgtatacagacagttatgcagttatgatatgatggccacattcctgaaaaaaaattaacttaatgcaaaatcacaagtgtttccatgagacaaaaggaagttaaagggtaaatgagtcatatattagcaataacattattttcctacagatatttccttttttttttttttttgagacagggtctctctctatcacccaggtcggagtgtagtggtgcaatcacagctcactgttgcctcaatctactggacccaagcaatcctcccacctcagcttccccagtaactgagactacaggtatacaccaccacacccagccaattttaaaatttattggtacagacgggatctccctatgttgcctaggctagtcttgaactcttgggctcaagcaatcttccctcctcagcctctcaaagtgctggcattataggtgtgagccactgcgcccggccttttctgagcagttcctctacagtttcctgaatagccatcactcattaaccaatataactctccatgcagtttattcaattggttatttaattctcaactaagtgccaactcatattatgaaaatttaattccagaggaaacactggttctagggtccctggaggaagacaaaagcaatcaaaaaccccaaactcgccaggcacgatggctcatgcctgtaatcccagcactttgggaggccgaggtgggtggatcacaaggtcaggagttcgaaaccagcctgaccaacatggtgaaaccccgtctctactaaaaatacaaaaactagctggatgtggtggcaggcgcctgtaatcccagctactcgggaggctgaggcagaagaatcgcttgaacctgggaggcggaggttgcagtgagccgagatcgtgccactgcactccagcctgggcgacacagcaagacttcatctcaaaaaacaaacaaacaaacaaacaaaaaaacaaactctagcgacctgggattacaggtggctcatgcctgtaatcccagcactttgggaggccaaggcaggaggatcacttgaggccagtagttcaagaccaacctggacaatgtagtgagactatgtctctactttttaaataaaaaagtaaaaaattattttaaattataatttattttttaaaaaatctgattgttacttcctcatattctagttgtgttttgtttttgggtgggcagaaagaaggtttcagggctacttatgtgggactcacttggaaaagagctaggatgtggaaggctgcttaacaagtaacgtcaatgctccagtagtgtgaagaacttccataaagtacattagggaaacaagacaggcatggagtagatgtcattttgaaaacagacttcccactttaggtggaccctaaagaatgggagtggggagaaaggtgaattcacacttcattcaagcgcctgtgagccttagattataagaaaacaggaacatttgggagaaatctgacttgcactgctgggctggcccagccctttggttctagtgtaaaccagagggcacctccagtgcttaacctccatcccaggccaggtccagtgctctgagcatcaaaatcaacaggttcattccagagcctctacagtgaaaaatacaactccataggcctctacttggccagtgagttactttccattgcacaagtgaagtcagatatttttcttgatttgaaacattagattttgtttaatttaaaaggaacttaaaaatcgtggtttgccaggtgcagttgtgcttgcctttagtcccagctactctggaggctgaggcaggaggtatgcttgagcccaggagttcgaagccagcctgggcaatatagcaagaccttgtctgtaaaaagaaaaaaaaattgtggctaaatacacatatcatgaaattcatcatcttaaccatttgtaggtgtacagttctgtaaagttaagtatgttcaacactgctgtgcagaactctccagaactccttttatcttgaataactgaacctctgtaacctttaaacataaaagaaacttttttttttttgagacagagtttcactcttgttgcccaggctggagcacaatggcacgatcttggctcaccacaacctccgcctcccaggttcaagtgattctcctgcctcagcctcccgcgtagctgggattacaggcgcccgccaccacgcccggctaattttgtttttgtattttttagtagagacggggtttcaccgtgttagccaggatggtctcgatctcccgacctcctgatctgcccaccttggcctcccaaagtgctgggattacaggtgtgagccaccacgcccggccttttttttttttttgagacagggtctcactttgtctcccaggctggactacagtggtgtgatctcggctcactgcagcctccacctcctgggttcaagtaactctcctgcctcagcctcctgagtagctgggattatagacatgcaccaccatgctcggctaatttttgtatttttagtagagaagaggtttcattatgttggcgtggctggtctgaaactcctgacctgaagtgatctgcctgcctcagcctcccaaagtgctggaattacaagcatgagccactgcacccggcttgaggtgtgccttaatatctttgcaatgcaaccaagggttgccattcctgagtgactgaggcctcatgatgagtgcttgggatccatatggtatgttattcaaatcatccataatggtatgtatgctattgtctctacttttctgtacttttgtgtaagtttgaaagctttcatgataaaattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttcagtagagacggggtttcaccgttttagccgggatggtctcgatctcctgacctcgtgatccgcccgcctcggcctcccaaagtgctgggattacaggcgtgagccaccgcgcccggccgataaaaatttttaaaaagtcattatgttttcagttcatcaccaaagtaatgaccaaatccaaagcacctttattaggcctatcatgcactatcttggtgtgggctcccgctctgccaagaaccacacaacctttgaaactgatgtcctgggcctggcgcggtggctcacgcctgtaatcccagcactttgggaggttgaagcgggcagatcacctgaggttaggagatcgagaccatcctggctaacacagtgaaaccccgtctctactaaaaaaaaaaaaaaaaatacaaaaaaattagccaggcatggtgacgggcgcctgtagtcccagatgctcgggaggctgaggcaggagaatggcttgaacccgtaaggcggagcttgcagtgagtcgagatcgtgccactgcactccagcctggacttcgtctcaaaaagaaaaaaaaaagaaaaactgatgtcctggatactggggcggttcctttaccttccttcaaggctgttcttggcgggttcctgctgtttcgttttgttttttctttgttgttgttgttttttttttgagacagagtttcgctcttgttgcccaggctggagtgcagtggcatgatctcggctcactgcaacctccatctcccggattcaagcgattctcctgcctcagcctcccgagtagctgggattacaggcacgcgccacaacgcccggctaattttttttgtatttttagtacagatggggtttcaccatgttggtcaggctggtctcaaactcctgacctcaggtgatccgcccacctcggcctcccaaagtgctgggattacaggcgtgagccactgcgccccgccgggctcctgctgtttcaacccattccttggatggtgctgcctccaagtgttcggaccttagccccaggtggtcttagcaccagtaacccccgctccaactccctaaagtccgacccgccccaggccccgcccacgctccaccctccctccctgtctagccccctcccccatccccttccccctccttcgcgtctccccatccggcgcccccgcctcgcgtcccctgggtccgcatcctggcagcctccgcgtttccctacccctgctaccgggctccagccccggggacgctatctgcttcactcggccgtgcgcgccgccaccgccccgcactgcctttttctaggcatggggtcatctaggccatgcatgattcgcccctgccccacagaagtccctgaggggtcctggccggacagcacggaatagaagaacggaaactctcccaaaaggagtcccaggcctggctctatccctccagatgacgtcccaggaggccagagtgcagggccggccagagggagtcacagtccggcaccgagaggcaactcggcagctggcggggcccgggctcgaacccagggactcacccaaaccgaggtgaccgtcgcacgcgccgccgccaccggggccgacgaatcacctgccctgggaagctaggtccgccctccccccgcccccagctgctgcctcaccgctgggcccacaggcctcgcgccctgagtttccggctcctccctcctttgcgaacgctgggagttccgttgcctacaggccgttatttccgccttcaacggctggggcatttcccatcggctagggagggggtcttcttgcatttgctttgcactgtccgggactcttcctgctagatgacttgaccaggccgaggcctccctcctgaacacaagctcttcggggctcctttcgccaatgggaggaggctgatcttgtggccgggcattcaacgccctgggccctgccgcctcccgcagatcttcccgggccttagggcttcacctggagtccccttcccctcttgggcccgtgctcttaaacgggcagtgccaattgcctggattactccaactaacccctcacacccaagtttcagacacagaccttcgctcccccacttgcccttaacaaaagcagatacatacctcgattactgcctgtttgctgcttttgcgagcttctttcccactcggctgcgggctgagcaatggtagggacctggcttgattcctatttaagtagccagagtccagcacaagggatggcgctcagtagaccctgcgtgaaggaatgattaaattggtgcaaaagactagggtaagcggcagagatttaggagattaagtcctgccagggtgtagcctctgcagggcgggaaggctgagattacaattttaaaactgaatatttattgaatgcttacattcagccaatccctgcttcacacccatcatctcatttaatttttttccttttttttcttttttaagccagtagatattaactcttaatcatgacatgaggaagtagacacactgaagctcagagaggttaagtaatttggccaaagtaacacagctttcaaggaaaatgtttgaatttgctgaaagtttgatgtatagggaagttgactaccgatgtatgacagaagcaaagtatccacctttggcacattttgcgtccacggaatgctaaaatttggacttgtgtattttatgcacattacaccatacattcagactaaaaagaataggaaattaggctgatgaaaggctattactagactggtaaaaagggttctggggccctggaaggccaatttttctggacgtgagatttttttttatttttttgagatggagtctcgctctgtcgcccaggctctggagtgcagtggcgcaatctccgctcactgcaagctccgcctcccgggttcacgccattctcctgcctcagcctactgagtagctgggactacaggcgcctgccaccatgcccggctaatttttttgtatttttagtagagacggggtttcactgtgttagccaggatggtctcgatctcctgacctcatgatctgcccgcctcggcctcccaaagtgctgggattaaaggcgtgagccaccgcacccggcctggacctgagattttatttaggtggctctttcagtggccaggctgagcaaagctgtccactagggtatttatttggtgcatccacaaataaaagctcatgtctgcctgatttatgagactgacaaaaaagagaagtccagggcctgacttcactagggaattttgacacccaggatattaggtattttgtgtccaaacaaccatcccttacaaccacggaggtcacatctaatggtcgggctgcatagaaaagaataaagaccttaaacattttaggaaaatagactgagactgagaaagaagttcccaaattcatgcctggaggtccaggagaaatgttctagttcctcactcacacctagctgaataacttcccatatcactgaaaaaacaaaacaaaaccaggtcaggcactgtggctcatgcctgtaatcccaccactttgagaggccaaggtggaagtagcccatgagtttgagaccagcctgggcaacatgacaaaaacccatctccacaaaaaaaaaattagctaggtgtagtggtatgagtcatgatcccaactacttggaaggctgaggtgggaggatcacttgagcccaggaagtcatggctgcagtgagctgtgatcctgccactgcactcagcctggagactctgtctcaaaacaaacaaaaaccagagcacctggcccaggggttcatttagagccagtgggtgtttcagaaggggctacctctggaatctcagcttcagaatgttggccacatgcacacactgtgctttatgtctttaaatcaattaatttaagaaaaaagcctgactacatttatttaaaagggcaacattggccaggtgtggtggctcatgcctgtaatcctagcactttgggaggccaaggcgggcagatcacaaggtcaagagatccagaccatcctggccaacatggtgaaaccccatctctactaaaaatacaaaaattatctgggcatggtggcgcatgcctgtagtcccagctgctcgggaggctgaggcaggagaatcacttgaacctgggaggcggaggttgcagtgagccgagatcgcgctactgcactccagcctggtgtcagagcaagactctgtctcaaaaaaaaaaaaaaaaagggcaacatcatagcattaccttacatcaatcacttcccactttattagaaggtatctataaaataaatacattgctcatgcctataatcctagcactttgggaggctgaggcagacagatcacctgaggtcaggagttcgagaccagcctgaccaacatggagaaaccctgtctctactaaaaatacaaaattagctgggcatggtggtgcatgcctgtaatcccagctactcgggaggctgaggcaagagaattgcttgaacccaggaagcggtggttgcagtgagccgagatcgcgccattgcactccagcctgggcaacaagagcgaaactccatctcaaaaataagtaaataaataaatacgtgaaaataatgttataggctggtgcaaaagtaattgcagtttttggccgggcgcagtgactcacgcctgtaatcccagcactttgggaggccgaggcgggcaaatcacctgaggtcgggagtttgagaccagcctgaccaacatggagaaaccccgtctctactaaaaatataaaattagccgggcgtggtggcacatgcctgtaatctcaggtactcaggaggctgaggcaggagaatcgcttgaacccaggaggcagaggttgtggtgagccaagatggcgccattgcactctagcctgggcaacaagagtgaaactacttctcaaaaaaaaaaaaaaagtaattgcagtttttgccattaaaattaatggcaccaacctaatataatcttgctagatagatatggatgtctgcagaaagctgtaagtctggggactttgtaaaaatcagagattagcaagtgttgaagtgataaggagtcacactaacagaatttttctttgacgtaatcagaaaaattcaaagaggacagaagagggaagaaccactttctcactctattattcaatgtcattaaagtggaatctgtgtaccccttaaaatcttctggttgcccatgggcaggagaatccttacttagaaaagagaaggttgagagcaggaaggtgtccagcccagaggggaaatggagggaggtaagatcacagaggctgctgggacacaggggcaggtaagggcctcaggccacggtggggagtttggattttacctccactgctgaagagggtttatttttttggggggtgcgtgggggttgtttttgtttttgagacatatcttgctctgtcgcccaggccggagtgcagtggtgcgatctctgctcactccaacctccgtctcccaggttcaagcaatcctgcctcagcctcccaagtagctgggattacaggcatgcgccaccatgcctggctaatttttatatttttagtagacacggggtttcaccatgttggccaggctggtctcgaattcctgacctcaggtgatccgcccaccttggcctcccaaagtgctgggattacaggtgtgagccaccatgcctgtctgcagatgagggtttttaaacagttatgagatagcagattccagctttagtgagctcccgctggctacttggtagacaactgaatgtaggcaaccaagtgtggaggcgtggaagccagtgagcagaccttgcatgaaagtatgtcgggggatgtgataggattaagatataatctaaaaataaaacctggacagtttgttactctttttattgagatggagtcttactctgttgctcaggctagagtgcaatggtttgatcacaactcactgcagcctcaatcacctgggctcaagtgatccttccacctcagcctctcaagtagctggaactacaggtgcatgccaccacacccagctaatttatttatttatcttatttatttatttatttgagatggagtttcgcccttgttgcccaggctggagtgcaatggtgctatctcggctcaccgcaacctccacctcccgggttcaagcaattctcctgccgccgggcgcagtggctcacgcctgtaatcccagcactttgggaggccgaggcgagtggatcacaaggtcaggagatcgagaccatcccggctaacacggtgaaaccccatctctactagaaatacaaaaaattagctgggcgtggtggcacgcgcctgtagtcccagctactcgggaggctgaggcaggagaatggcgtgaacctgggaggcggagcttgcagtgagccgagatcgcaccactgcactccagcttgggcgacagagcgagacgactctgtctcaaaaaaaaaaaaaagcaattctcctgccttagcctcccaagtagctgggattacaggcatgagccaccatgcctggctaattttgtatttttcagtagagacgggatttctccacattggtcaggctggtcttgaactcctgacctcaggtgatccgcctacctctgcctcccaaagtgctgggattacaggcctgagccaccacgcctggcctaatttatttttttagagacgaggtttagctatattgcccaagctggttttgaaaaactgggctcaagagatcttcctgccttggcttctcaaagtgctgggattacaggtgtaagccaccatgcctggccagtttattactcataaaataggggaaattagcacgaattatacatgcgtcctagtctagtccccagccaaaactttccccctgaggtttattagatctgagagaaaataggaaagggaacaacttcctccctaaatcgatgttgttaaaggccaaggccatgcaccatctaagccattttgaggaccagtgcttctcattggccacctggagacaccttgtaggacagtaaagaagtcagttatgggccgggtgcagtggctcacgcctgtaatcccagcactttgggaggccgaggcgggggaatcacgaggtcaggagattgagaccatcctggctaacacggtgaaacaccgtctctactaaaaaatataaaaatttagccgggtatggtggcaggcgcctgtagtcccagctactcgggaggctgaggcaggagaatggcgtgaatccgggaggcagtgcttgcagtgagccaagattgtgccactgcactccagcctgggcgacagagcgagactcagtctaaaaaaaaaaaagtcagttatggctggtcgcagtggctcacacctgtaatcccagcactttgggaggccaaggcaggtggattacgaggtcaggagtttgagaccagcctggccaatatggtgaaaccccgtctctactaaaaatacaaaaattagccaggcatggtggcacgcacctgtaatcgcaggtactggggaggctggggcagaagaatcgcttgaacccaggaggcagagtttgcagtgagccaagattatgcccctgcactccagcctgggcaacagaatgagactccatctcaaaaaaaaaaaaaaaaaaaaagaagccagttatgctaggagggagaagcagacgtgaaagggtggcaaagtcaggcatcaaagggggtcacaggagccagggtacagaaactgcagccacaggggaccctaaagctccagggagccaaacctcttccctactcccaccccaccccaacccacccccatcccaaggtccctgagccccagtcctgggtgagagaaatcatgaaagtggttaaggattaaggtcttgggccctggagctagatggcctagatccaaatccagactcaggtacctgttggcacagtggcctgggtttgttatttcaccttctgtgctcaattaccctctctgtaaaatgtggttaacaacagcacctagctcataaggttgttatacagtttcattgagctaatctaggtgaggtgattagaatagtacctggcacagagtaagtctttaaaagtgctgttttgttagtctttaacttgttataaaataacccctccatgactgatttacttatatctacaataaataaattgacacctacttaggtgagcccaagagaatctcttctctgcagacaaaagtgcttgcccagacttgaggtgacatagtttgcccaggttaggtacaggcagagggtgactgggtgagaattttaatccagactttcagcccttacggactccaaaattcctgactttttttttttttttttttagacagagttttgctcgttgccaaggctggagtgcagtagcatgatctcagctcactgcaacctctgcctccagggttcaagtgattcttttgccctagcctcctgagtagctgtgattacaggcgcgcaccaccatgcctggctaattttttttatttttagtagaaatggggtttcaccatgttggccaggctggtcttgaactcctgacctcacgtgatccatctgcctcggcctcccaaagtgctgggattacaggcgtgagccaccgggcctggcttttttttttttttttttttgagacagggtctcactctgtcacccaggctggagtgcggtactgtgatcttggctcactgtaacctccacctcccgggctcaagcaatcccctgatctcagcctcccaagtagctgagactacaggtgcttgcccccacacccagttgattttttttttttttttagagacagagtcttgctctgttgcccaggctggagtgcagtggcgcgatctcggctcactgcaacctccacctcccgggttctagcaattctcctgcctcaggctcccaagtagctgggattacaggtgcacaccgtcacacccggccaattttttgtagagacagggtttcactgtgttgcccaggctggtctcgaactcctgagctcaggcaatccaccagcctcagcctcccaaagtgctaggattacagcactttgggcgtttacagcactttcagccaccgcgccaggcctgatttttatatttttagtagagatggggttttgccatgttgactaggctggtcttgaactcttgactcaagcaatccacccaccttggcttcccaaagtgttgggattataggcataaacctggccaaaacccctgatttttatcccatggacccatggaatgttgcctgccctgtattttttttttttttttgagacagggtcttgctgtgttccccaggctggagtgtagtggtgtgatcacagctcatagcagcttctacctcttaggctcaagtgatcctcccacctcagcctccctgagtagctgggaccataggtgaatgccaccatgcccagctactttttttttttttttttttttcctgtaaagacaaggtctggttatgttgcccaggctggtctcaaactcctgggctcaatcctcccacctcagcttcccaaagtgctgggattacaggcataaaccactgcacctgggccctgcctcatattttaaggggtctactttcactcctgagtttcagctcatgagctgaatgaatgagtgatttggttcatctctgctgagattctgcccttccatgcagggaaccagcctggccccaggtaggggggaaatgtcctttacaaactgcccaggggcttcaaagttgggacccattcttggattttttttggtttttctttgagatgaagtttcgctcttgttgcccaggctggagtgcaatggcctgatctggattcactgcaacctccacctcctgggtttgagcgattctcctgtctcagcctcctgagtagctgggattataggggcctgccacgacaccaggctaattttttgtatgtttagtagagataaggtttctccatgttgtccaggctggtcttgaactcctgacctcaggtgatccacccgcctcggcttcccaaagtgctgggaatatagacatgagccaccgcacccggcctttcttggatgttaaaaccaaggtttgtcctaaagattgcacagctttctggagccagggctggggattgttggggcagtgaagcacgtctaaattcttctctactttgcaagtgttgacagcactcttttatatccttttctctaaatcagaaacagagcagaaactagagccatctcgtcctgcctcttcctatcatagaaaggagatggagggaggcctagagagagaaggagaagcttatgcccccagtcccgcagcaagtcagaggcggacaagacccctcttccctgaagcccctgcagcctctctgcccctctgctgctggaataggatgcagcatctgcatgatgtttgctctgtgccaagcactgggctaggaacaaggcctgtgcttttccaagtgtggtcccctgactagcagcaccaaaatcacctgggaacctgttagaaatgcaaattctcaggcccgccccagacctcctgaatcagaaacatgaagggggctgggcgcgttggctcacgcctgtagtcctaacactttgggaggccgaggtgggcgcatcacggggtcaggagattgagaccatcctggctaacacggtgaaactccgtctctactaaaaatacaaaaaagtagctgggcgtggtggcgggcgcctgtagtcccagctactcggaaggctgaggcaggagaatggtgtgaacccgggaggcggaacttgtagtgagccaagatcgcgccactgcactccagcctgggcaacagagcaagactccatctcaaaaaaaaaaaaaaaaaaaaaaaaaaaagaaacatgaatggagtggagacagcatctgttttcacaatccttccccaaggttcaaatgtggcatggtcaagtttgagaaccactgctccaagccatagtaggctcagtcccggtgtatctgagtggctaaaattgtggaacctggagtcagagagaactaggtgcaaacctgcctccattgctaactctgtgactcaggtaagctattgtctttgagctttagttctgtcagtgataaaatggccataataatagtgcccataaggttgttgtgaggactacatgagacagcacaaagcctggggcgtggtaagcactgctggggtagccattattagctagctgagtgattattttttatttttttgagacagtcttgctctgttgcccaggctggagtgcagtggcacgatcttggctcactgcaacctctgcctcctgggttcaagcaattttcctgcctcagcctcccgagcagctgggattacaagcgtgcagcaccacgcccgtatttttagtagagatgaggtttcaccatgttggccaggctagtctcgaactcctgacctcatgtgatccacctgccttggtctcccaaagtgctgggaatgcaggcgtgagccaccgcgccgacctcctctctacaatttttaatgtcagtactattttttacccccaccttttcacattaaaaaatgtggtaaaatatacataacatagaatttaccattgtagccacttttaagtgttaattcagtggtattaattacactcgcaatgtagtacaacagtcaccactattgtactataccacattgtactacattgtgaatgtgaaatgtgttgttctacattgtgaaagtttttccaaaactttttttttctttttgagactgggtctcactctgttctgtcacccaggctggagcgtgatcatggctcactgcaccctcaacctccctgggctcaggtgaccctcccacctcagcctcccaagtagctgggactacacgcacacatcaccacacccaactaatttctgtggtttttttttttttttttttttccacgctgcccaggtcttgaactcctgggctcaagcaatccacctgcatcggcctcccaaagtgctaggattacaagagtgagccaccacgcccagccttcaaaacattatcatcacccaaaacagaaactctgtaccattaaacagtaattccacacccccctccaatattaccacatttttatgatgaggaaaacggaggcacagagaggctcggtaaaacaatcaatgttacacagctagctaagcataggggtcaggactcagactaggctatttggctccagagcttgctttctgaatcactgtcttacattttttttcttttcttttttttttttcagacagagtctcactctgtcccctaggctggagtgcagtggtgcgatcttggctcactgcaacctccgcctcctgggttcaagagattcttgtgcctcagcctcctgagtagctgggattacaggtggctactaccatgcccgcctaatttttgtatttttagtacagacggggtttcgccacatgggccaggctgatctccaactcctgaactcaggtgatctgcccacctcagcctcccaaggtgctgggattacaggcatgagccgccatgcctagcagattttttttcttaaatctaaagcttttattcttgtttatttatttatttacttatttatttactctgtcgcccaggctggagtgcagtggcatgatctcggctcactgcaacctctgcctcccaggttcaagctattcttctgcctcagcctcagctttgcaaacctagcccaagtagctgggtttacaaacatgtgccatcacgcccgactaatttttatatttttgctagagatggggtttcaccatgttggacaggctggtcttgaactcctggcctcaagtgatctgcccacctcagcctcccagagtgctgggattacaggcatgagccaccgcgcctggcctgaattttgaggtttttatctgcttgggccatgggtgcaggctccaattactccaaaggggctgatctatctgccatgccttgtggggtctggtgggagctggagggccacaggggtcctgccctgtagagccactttgtttttcctccatgagatccacaatcttgggagccctgaggatgttcctccaaatgggcagactatgcccagccaccagagctggagagcaggattctctctccttccacttataaagggacagcactgaaacaaacatggcctctggagtcacatgagactggactcgaaacctagccttggacaggttgctattccaattgtttcccaaactgaagttacagataccaccacctaccttgcagagttgttggtaagagtaaatggcagcctagaactagcagggcctagatgagagttagttcccttcctaacttgaatatcaccttttccttaatgccttcccagttcaatgtttgctccctcctcacacctttatacagcatcctgtggagaccgatcgaattgcctagtgctgctgcttttccctgctggtttgtaaattcaagttcagagactctttctaaactctgacacacatcaagggctgggtgtgctgacactgacacagtcccagtccattgcttactggctacgtaatctttggtaatttgacccatctctgcctccatttcctcatctgaaaagtagagaattggattctccacttcataggattgctgggaggttgaaatgggctaatataggtggtgcacttaaaaatggagctgacatatagtagaagtacttggtattatatgatcccatgatataataagtccccttctctaaatcatttcttcacctaatgctgcctcacacctggggaagcgaacaaggcaccactaaaagccaatccactgatctcggcatcctatttattctccttttagaaggcttggccaggcacggtggctcacacctgtaatcccagcactttgggaggctgaggcaggattgcttgaacttaggagtttgagatcagcctaggtaacatgccaaaaccctgtgtctacaaaaattaaaaactagccaggggtggtggtacatgcctataatcccagctactggggaggctgaggtgggaggactgcttgagcccaggagatcgaggctgcagtgagctgtgacagctccactgcactccagcttgggccttgtgtgaaaaaaaaaacaaaaagaaaaaagaataaagaaatcttgagtaaaacttggtagtctcccttcttattctctatcactgctatcatctaaatttccaggaacctcctgggccacttctaaccgctagatggccaagctacagagtgattatttccttaggcaagcaaacatcccagccctctaatacggtatttcctggggctggaatatcaacaggaagttatgtgaggaagagctctgccaaaacactcattccaaggaagggactggtaaagtgacaaatttgcccaatcctgtacaacatcctgcatcctccacatgtggccctgttgcacatctaatccacaggcaggtcactcgctgctgactctattcttctctgggctcctgggacgtataaatatgactctatgtaagaaaaccagaggctgggcgcagtttgctcatgcctgtaatcccagcactttgggaggccgaggcgggcggatcacgagttcaggagttccagaccagcctggccaacatggtgaaaccctgactctactaaaaccacaaaaattagccgggcgcggtggcgggcgcctatactcctagctactcgggaggctgaggcaggaaaattgcttgaacccgggaggcggaggttgcagtgagccgagatcgcgccactgcactccagcctgggtgacagagcaagactccgtctctagagaaaaaaagaaaaccagacagattaaaaagttgcacttacaaagcagttggggcatttattgacatttaaacaagggaggagatcctgaacactagtctcgctcagtttataaaaacttgaggccaaactctccatcatctgtacacagcttaaccacggccaggagcaagaattcgagttaaacgaattgaaccagtccaaccacaagacgataaagggaaacagggcgtggggatttccagtttttccttttacattacaaagtttccaacacaagaagccaacaataccccagtgctgcaccaagttacttcccactgtttcccaaggcacagtcaattaataatcagtagtccaagttctaagaacattccctggaaaacaaggacgcacctcccgtggctctatgcatggcctgccactgatgaatcaaattcttaagaacctacgaccgtctgatacccttgaggagagcaccctcatagaatctccagcatcaggcctcagttttcccatctgtaaaagacagccatgcaaagtgggagatccgctaggcttccagatcgaagtcatcgcgctcctcattgtactctagcacgtgccgcttgatcttggacgagtccacccaagtgacaaagtcctccatgctgcgcgtgacaaggaaggcggggtcggtaaccacgtcagggcccacgcgtacgtgcccttgctccacaaaggccacggcagcctgaaggtgctgcgccatgcgcagcttgaggagcacggtggggaggcggcggcggcagaaggacgaggccgtgacgaagtcgcagagctccagcgaaccgcgcgtgggcaccaagccgagagcatacagcttgtccagcagcgcggccgaagcgcgcacgcggaactggtcgcgttcgggcaggtcgcgcaggcgccgcgccagctcacgcacggcacggctcagctggttgtagcgcgtgtagtcctcccgccgctgcagccggtaacgccgcagcacgcgcagctcgtgcaggttgtggtcggtgacctcccagttcaggaagtccacctgcttcagcagcttctgctcgtggaacttaagcttccgcaccatgatggcggcagccgcagccgcaggacccgaagctgagagcgcgttctggcatccgcgcgatttccgccgcggcgccccaagacctggacggcctgggaccctgggccaatgaaagaaagacttaaagtcacgccctcacttcccattggccagggtgggaccacgcctctgcactgggatctcgcgtttcttcttttcttcgcgtttgcgagggagggggtagaagcaccggaggtgggtggttgggagcgggtccctaggcggttccgcgcggtttttagtagccaagactgtatccctttctgcggcaatcatttcctcctagacttctgtcctttggggactttcagagtctcccccgcaagagctgaagaggccatttctggggaagaggggtgactgcggcttgttgattgggtttactgtgctaacttgcactgggctcctgccatgccttgggggagcttgccggagccggctctcctggggctgacctggtagtccccgccgcccgccagcgtcaggtccttcacctggcatgcagagcgatctctcattgtcaagttgggataggtggcaccgaacccatgaaatactgattggctgcttcctaggcccacagaaaagggatctataagggagtcgcctggaaatctgtattattaactaaagtgtcagatgattcataaaacccagcaagtttgagaaacttggactataactacaagtccaaaccctttagtctgtgctcaaatgaattatcctgacatgaatttctggccaccaagcattgagttaacaaatttaatgctgtttccgctagttgcatctgtaagttacatctgagtatagcgctgcagacctaacccctttttgcccgggcatttgacgccacctagcttctcactgatcatttttgttttgtatgcttttcattgtcttttacaatacaatatttgagggttgggcgcggtggcacatgcctgtaatcccagcactttgggaggctgaggtgggaggatcatttgaggccaggagttcaagaccaacctaggcaaaaaaaaaaagaaaaaagaagcgagatcccacctctgtaaaaaatcttaaagaattagccaagcatggtggtgcgcacctgtagtcctgactacctgggaggctgagggggaaggatcatttgagcccaggacttgtaggctgcattgagctacaatggtgccaccgcaccccagcttgcacaacagagccagaccctgtctcaaaaagatatatatatatatataaaatattcgatatctggaaaataatataatatgtaaattataaagtataataaatactcataaacttagccagtttaagaaaacatcaccaggctaggcatggtggctcatgcctgtaatcccaacactgggaggccaaggtgggaggatcactggaagccaggagttcaagaccagcctgggcaacatagtaagactcagtccctatggacaaaaaaaaaaaaaaaaaattagccaggcatggtggcagcacctatagtcccagctactggtgagggtttcggggtaagaggggggaggatcccttgaagccggaagttcaaggatgcagtgagccatgatcacactactgcactccagcttgggcaacagaacaacatcctgtctctaaaacaaacagaaagctaatacagattgtttgcttttttaatctaattgattttttctttttttttttttggagatcgagtcttgctctctcgcccaggctggagtgcagtggtgtgatcttggctcactgcaacctccgcctcctgggttcaagctattctcctgcctcagcctcctgagtagctgggactgcaggcacctgccaccacacctggctaattttttgtatttttagtagagacgaggtttcaccgtgttagccaggatggtctccatctcctgaccttgtgatccacccactttggcctcccaaagtgctgggattacaggcatgagccactgcacccagccccagagtaggtcttattgagaaggtgatattttataggggttaagccatgtgtggatatctagggggagaacatttcaggaagaggaaacagtggaaatgccttaaggcaggaatgtgcctggcatgtcagaagagtaagaaagctatcttggctggagcagagtgggcaaggaggagaggaagaggttaaagagcttgtagtcccttgaaaagactttggcttttatgttgagaggcatatacttcggggttttgagcaaaggattgacacttatgttttttgtttgtttttgtttttgagatagggtctcacactgttgcccaggctggagtgcagtggtacgaccaaggctcactgcagcctcaaccttccagcctcaagcaatcctcttgagtagctaggactacaggcacatgccaccatgcccagctaatttttattttttattttattattattattatttgagacagagtcttgcccaggctggagtgcaatggcacgatgtcagctcactgcaacctccgcctctcaggttcaagcaattatccctgcctcagcctctcaagtagctgggattacaggcgcctgccaccacacccagctaatttttgtatttttagtagagacggggttttgccatgttggctaggctggtctcgaacttctgacctcaggtgatccgcccaccctcggcctcccaaagtgctgggattatagacgtgagccactgcacctggctactaatttttaaattttttgtagagatggggtctcactatgttgtcatggctggtgttgaactcctgggctcaagcgatcctgctacctcaggctcccaaagtgctgggattacaagcataagccaccatgcccggctcagaaattcaattttggacatttttggttggaggcatccattagacttctgaggggagatgtcaaggagaaatagatatatgagttaagagtttttttaaaaagggctggagatttaaaaaattgggcattactagaatgagtggtatttgaagtcattcggctggatgagatcatcaaaggagtgcctatggatacaaaagacaagaggacaactctactgtggttactctaacgttaagaattattggaggcttgctgggcgctgtggctcatgcctgtaatcccagcactttgggaggctgaggcaggtggatcatgaggtcaggagatcgagaccagcctggttaacacggtgaaatcccatctctactaaaaatacaaaaagttagccaggcgtggtggcgggcgcctgtaatcccagctacttgggaggctgaggcaggagaattgcttgaacctgggaggcggaggttgcagtgagccgagatcgcaccactgtactccagcctgggtgacagagcaagactgtctcaaaaaagaaaaaaaaaaaagaattattggagagaagaggatgaaccagtgaggtggaagaaataccaggagagtatgttctctccaatgcaaatgaagaaaatgtatccaggaggaaggagtgatcaaccaggtcaaatgctaccaaaaggctaaataagagaaggactgagaataaccattagggtccagcaacaccaaggctattgatgaccttgacaagaatagttcagtggagtgtgggagtaaaagattggccagagggatttaaagagagaacaggagaaaaaaaattggacgcacttagtatagacagctatttcaaggaattttgctgcaaaggtgagcagaggaatggggcaatagctggtggggaaagtggagtcaaaaaaaattttgagatggagtcttgctctgtcgctaggctggagcgcagtggcgggtgcaatctcggctcactgcaacctttgcctcccaggttcaagcgattctcctgcctcagcctcctgagtagctgggactacaggcacacgccaccatgcctagctaatttttgtatttttagtagagacggggtttcaccatgttgcccaggatggtctcgacctcttgacctcgtgatccgcccacctcagcctcccaaagtgctgggattacaggcagtagccaccatgcccggcctcaaaaaaaatcttttttaacatgtgggttgatacttcactcaatagctgcagcttattggttgctttcccagtctattctacctccaaaagctctcccagatttttgtctctccagcctgttacccctgccctatgtcaggccctcatcatcttttgtctgcattcctacagtaatagtccagtgtgtcctgcaggctgccaccagcagagtcagcctgaaaaccactgggcacagttctcccttgctgtttcctttcctaaaggatggaaattggatgcctggatgagggatggatgctgtttcctgtgtatgaatcagggtcccagcaggaaagacagaacacaccccagtgagaataacgtgagaggctgggggtggtggctcatgcttgtaatcccagcactttgagagaccgaggcagaaggattgcttgagcccaggagtttgagatcagcctgggcaacatagtgaaaagccccctatacaaaaatacaaaagttggctggatgtggtggcgggtgcctgtagttccagctacttgggaggctgaggtggggaggatcacctgagcccagggaggttgaagctgcagtgagctgtgattgtgccactgtattccagcctgggcaacagagtgagaccctgtctcaaaaaaaaaaaaaaaaaaaacagaaaagaaaaaaagaataatgtgagacttgactaaagggactgtttccataggaatgggcagggtatagggagatcacaagggttagtgcagtttcctgagactgctaacatggcctgtttcccctaggactgaagaaggtccctggaggggagggaatgggaagatacaggttctggaaatctcagtgaggctgaggagtgagttcctcccaagaacctggaaataagggtggctcctgagagttacaaaaaaacccgtctagaacacatgtgggagtaaatccaaaatggctggtctgtaaatgtgtgactgagtgtttgggaaccaactaaagtctgtcaagggtggtggctgaggacgcctcggggaggttgggctggagggggaccctattgggtgaacagaaatcccaattgtattaagtaaactaataaaggtaaagcgtttactgtagtgtccatcactcagcaagcactaaggaagtagatgcttttttttgctttttttttttttttgtgagacagcgtctcgatctgtcccccaggctggagtataatgacatatacaatggcaccatcttggctcactgcagcctctcactcctggccacctcacctggctgatgctatctttttttttttttttttgagattggagtcttgctctatcaccaggctagagtgcagtggcacaatctcggctcactgcaacctctgcctcctgggttcaagcaattcttctacctcagcctcctgagtagctgggattacaggcatgcgccatcacgcccagctaattttttgtatttttagtagagatggggtttcgccatgttggccaagctggtctcgaactcctgagctcaagtaatccacctgccttggcctcccaaagtgctgggattacaggtgtgagccactgcacccagccctgatgctattgttaaactcagtttggagaaaggctatgtggacagaagatagatcacagggaaggggggggtcctaaaagcacgtggggaaaacgtatattctgtcttagagatgctaggacgaactgtctttagaatgaaggctgccccatgacaggaagcaaggttttaaggttacttgactgagagactcctcataccctttcccctcttgggggttccagactcactgagctaactttctggtaactgggcttcccaaggggtagcccaaactgccttgatctattgatgcagaaattcagttctgcttgacagttttatttctctgtgcaaattgatacctagccttctggggtttgtacataggcctttattctggtcaaatgccagacctgcgaagggagtcggatccactcactgaaccagtgaaactgggttttggagccagaggtctgggaaccatgtccctcaaaacagccaaaggtatccatctttagcagaactaccttgtaccagttaatctgcaataagtgactagggagagaatgaagggaagatctagctagacagggtagacaagactccagggtatagccaggaaagggagtcctcctgaagcctttgcctcatcttaggcacttcctccttcaggaagctttccttgatccttgctctacccaggctggggtaggtaccctcatgtgcacttttcatggcactaactagtcacactgggcagggagcatttgtctacttgtcacaacatatctgagcttttggaaaataaggataatgtcttatttgtctttgtagctcaggggcctggtgcagagtaggtactcagttaatgtttcttgagtgcatgacttggctgaatgaatgactgagacagaatggattgattaaagacaagagagggtggactgtaagccccccaggatagaaaccccgactgccttgtggtgtactactccccagtgcccagcacagtgcctagcagaatcaatgcccaaagtgttcccgatatgctgaccgagggtcagatcccacttgcctcttctcgaagattctctacctgaccacttctctccttgctgccgctggctagcacagaacatccagtccccgctgctgtactaagcaacacggaaccgggtggcacctagacttgttccctgtcgctgcagatgtagagtagtgtctttccctccttccaagctagtcgcccagggcagggtcgccctgtctggctagggtgctgcacccgcagctctcggtatcttaggtcagacgcctggaacgcgcaggccgtttctgttcctccggaaaacaatctctgagctgcgccacgacccgtccctgcggagcaggagtggggaatgggaaggtgggaaggcgagtccgcgactctgctccccaaccccagctggcgcggcggctttccacgcacccccctccccccaccccgatctcccgatcctggctctggcgcggtgctccttgcagccccacgctttgcaaactttcggagttttactccatttgcgtcacggaaaaggcaggaggatgacggagtccaggaagcgaggcagcggcagctggcaagctcccccgccgggcgctccaaccacgggggcgtgaggtgtctcccggcgagggcggacaggcggagggagaggaggggaggtggcggtcccagggaccagccccggaggctctcgggccccctcgttcccgggtcgtttcctccctctcgcctcccggactgagcgccagcgagcgagggcgctggccagctgggaagccgcgcggaggagtaggcgggggctcggctgcagcgccccgggcccgcgggagggcggagctggccgtccctgccccgccgggacgcacggaagtgcagcggagtttgcccgattctccagcctgcttccccctccctcctccctctccccacccctcacctcccctttggcgatcccctccttcctcaggacgccacctcccggaatcgcctttttgttttggagctgccttctcgctggcggagcggagggtctgcgagcgccggggaaggcaggctgggggcgcagcccgccccccactggccgggccccgcagggcggagaggaggacggacggacagacggctggccgcgccatctgctcgccggagctcactctccaaactccaaactgttgagtgtgtgcgtgcacgcgagggtggtgatcgggggtcgtaagtcccgggtgaggaaccggtttctgctggggttacctttggacggggttcctgggattcagagcagggtcagcgtcaggctcagaaactgctgaggaattaggcaaacaaaagagaccactcagcgagtggctagaagtcgcccgacagcctcgtcgcgccccctccttcctccggggttggggctggccacttctggggcggggagagggcgcccgagccggcgggggctccggctgcgcagccggggtcgaagagttggcggcctgttgtgtaagcctcagtccttgttttcccggcctggctcgttgtgaagccggacacatccacccttggactcgattcaggcggctgctgcttttctccttgcccctcttggattttccggatttttgaaaacccagtggcccaggagcaagaggaggaaggaggaaggggcagatctgcagaggaatgtgagagcctcccaaagcgagagccgccaaaagaatctgggagccagagggacagccgagccctgcccgggtttctggaatggtggtttcagagtgagtctcttctattttagaacgttgttccagtggaaagtgtcgaatttttcccctcgcagggcagatttctccaggtcacttgacttttcttctgggagtaggagttaggagagattcccctctaaccccccagaggctgctaagggaggaggagactgtggacatgagccctccctgctcacaagcatatgcccggagacctgatagggcagtttctgggccatggacattgctttgaagagggggagactggacagcatctgtgggtgctgagaccccaccttaggacctgagagattgaactgtgtaagcgccattcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctaggagtggtgggggcagtggcttcctctcaaaccagggtagctttgaggaggatgatgatgatgactgggatgactgggacgacggatgcacagtggtggaggagccacgggctggtgggctgggcaccaacgggcaccctcccctcaacctctcctaccctggtgcctaccccagccagcacatggccttccggcccaagccaccactggagcggcaggacagcctggcatctgccaagcgaggcagtgtggtgggccgtaacctcaaccgtttctcatgctttgtgcgttctggagtggaggccttcatcctgggtgatgtgcccatgatggccaagatcgctgagacatactccattgaaatgggccctcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggtaaggcccagtgcaggcaggaaactcgtcctgagtctggctctctgctgggccctggggagatggggatggcctggatagaatggagcaacttgtctttatttctctgtctcaatcattcatttaacaaatgtgttgggctgggcacggtggcttacgcttgtaatctcagcactttgggaggttgaagtaggaggatcacttgggcccaggaggttgagactacagtgagcccgattgtgccactgcactccagcctgggtgacagagtgagaccctgtctctaaaacaaacaaacaaacaaacaaacaaacaaatgtgttgaatatcaactctgtgtctgtggcaaatgtgcttctaggtgcagggatattgttgtgcacaggcccggtctctgtcctcatggagcttgatatttaccttcttgtcagttcattcattttctctgtttgcatctcgtttacccatcatgcatggtgtcatgctgggttctgagaacacatagatgaccaggccccaggccttgcccttgaggagccggtaggcccttgggagacacagacccaacccagataacaagagctcagagtgggggcctgtcttgtgctccttgcaagttaacctccccacctttgcagctttggaagctactctcaccactgtgtattctctttatgagcgtcttgtctgtgtgcaggaagatccctgtccccattttgcagatgaaggagctagtgtccacagaagagtggttgcacagcctgtggcccggctgggactgtcccttcctcctgccacctccccaaggacacgtccatgttggccacttcccaagcctagccatgttttcagttctcatgaccccctctgtgggggagggacaggatgggcctctgcctgttactgctggggctgtccatgaactgccggggaaatgactcatcctgggtcacacaggggcactctggctgggccaggggtgcagaatcaggggtccagggcactgtccacatggcctatccaactcctgcttcccaagcctggcttctcttcttgcctgaggagagagccagtggctgccccagcaggtgcctgagtcctgggcacagctgggagggcagatgtcaggagagaggtgtgatcctccctggggctgcttggtaactcgtctgcagggcgtggagctggctccctggcccttgggccctgaggttagacctggcttggtggggagtttgactctgggtggggccagggggcagacctctgcactgagcctggggaacaggaaacatgtcacccaccaccaccagggagggcctggggtaagctggccttgctttcctttaccaagaggttgacttctataacttctccagctcccagcctcctttctccccttgctatatcctcttcctcttcctttctttctgtttttttttttttttctctcatctctacctttcttcctcctcctctgaactccaggaaacacaaacctgagtgctagtcttggctctgcccctagattgctgtgcgtccccggggagtgcctttgcccctctgggccttagtttcctgatctgtaaaacaagggaatggggtcccagtgagccatcaggccttcaagggagtgggtgggaagggactcctggggagggtatggctcagaaacagaatgacaccttagctctggctctgagcactggggcaggagtagggcaggggaggtggccaggcctgctgggggcccactggggcaggtgtctccctgagcacaagtgggaaggctggttcaaccagctccttagatggcttgttcctgtgcaggcagcaggagggggaatgcaatgattaaacagatgctcccatgcagtggctggggaccccccacccagagcagagctgaggacattagggcagccccacacctaggaaggacaccagggcctcccaggctggggggaagccagaccagcctttctgaccctgggcagagagacagagctgagataggccatttctgagtttctacttgaggtgtttctaagagtcagaggccactgtcctctgtgctggtgcatttgacctgaaacagaggccagcccactgccttccctccccgggaggacccctcccaatgggccaagccctctctggcttactctaagttctgggctctgcactgctcctcccaggcctgtggtgtggggcaagttagggagggggtactgagacagaactggacaggctttggggaccacagcccaatgggagtgataaggagggggtcctaatgctggccttaggggtggagcccttctcaaagaaaagagaagaacagttgggtcctgggcccccaggattctgtccagcctgtctggacatctgaatgggtggtgagtgtgtgggaggaaggacagtggaggcctaggtgggagtcaggagaccaggatttggacaaactttgcatctgacatgactttgggagagatttctcccctcagtctctaggtgagtaaaatgggacccgagggtcttcatttccttaggagggctccatgtcatgtgaaacttacattaaacaaatttgtatgcttttcagaaaaataataaaatgaaataaaatgggacataaaccctggctggagctgagaggagcctggtcctcccacgggcctagtccctgtagcccaatccaggggtctcctaagagaagggtaaccatataattaaccagggcagtttggggcataaaagggggccctagcaatagtgatcccgggacaacaggggaaagtaactgtccagggcaagctgggacgtatggacccccaacttgacagccagcaagagcggggctggtcctaaggctcacgacaggtcaggagggcgatgtggtcacttccgttttacagacgaggtgcagcgatgcagatgagcctcagagcaggagctggagtccagtgtgtctggctccgcagcccaggctgtttccactgtgccctcccagatgggggaggggatccccagggatggagagctgagccagaaggcgaaagaggagggaggaaggcttgggtgctccttcactggtcctgtgggctagagagaggcccaggaccacagagcttccatggaggggccatagggacagcgtggccaaggcaaagtggcgactgtagggacaagttcttgcctgggggatgggtgggttcagcctctgggttctgagccatcatctagccttccctctaccgctcatcctgtaatctcagcactttgggaggccgaagtgggcggatcacaggagttcgacaccagcctggctaacatagtgaaaccctgtctctactaaaaatacaaaaaaatagccaggcatggtggcaggtgcctgtaatcccagctacttggaaggctgaggcagaagaattgcttgaacccagcaggcggaggttgcagtgagccgagatcaagccactgcactccagcttgggcagcagaacaagactccatctcaaattaaaaaaaaaaaaaaaaaagaaaagaaaagcagttttcaagccataacatgtagcatctggagcttctattgtatctcaggtgcgctcctttgaactgtgtacatattagttcagttaagcctcaactatactatagggcaggtactattattatcccattttacagatgtggaaactccttaaagcactataccgtgtgagaggttgtcaacagcatcacatctagtgcaacctgtcccactgggcagtggggagacctggagcccaggcaagagcagtggcttgctggagaggatacagctaggactaggactcagacctcctgctccctcctgcccccaacctggggtggatgttaactgtctccaagaggcaggggcaagatggattgaggtgggagcttagggaatatccctgggacttgcagctggtgggctccaaccctcctttctgcatttttgggacccagcctgtaagaggagtgctgaggcaggaggtccccctgggtcctcagctctcaggttaagtcttaagtagaatgtcggggggatgctggacaggcctgagccctgactcccagcctgtggggtggggtgcattagcattagctggtcctggccccagagctgagtcacagggtggaggggtaacggagaacagggtggggcctctgtttccccccgacctctgcagcctttgctccccatccctggcctcctgcctgtctgtggatacctaaccattgcaatgggttcattcttactctttgggctcctcatcagcaaaagaggcctttccttcctctaaggccatggacaggaaaagtctatagatgcacttccactgtgccaactttctcggcaggtggaatccaggctagttcagtatctcctctttagctaggttccttctgcggaagtttaactccagtttcttcaccctgctgttttctacctttcttcttacggttcttcctactccttgggaccttcttgaatccctgtgtccaacgtctgggggccccacacatatgcctgaaggacctggcatgggctccctgcagcagaagtggtgtccgacccccagctgtggaggaccaggcaggaaagaggctgggagtcctgggcaagttcctgcccctcagggccttggcctcctctgtacagtagtaggatggaggtggaatcgagggttggacacctgatcttttgggcctttctagctctgaagtctcttactgggtcctatcctgggccttggggtgatcccccttctgctgcccagggctgggctgttgagatggtgcaggaggtggtccagggaaggtggcagaaggactgagtgggctgggagctggggaatgcagatttcttttgggcgctgtgtgagcagccctggagactctctgaacttgagtctgtttgcctgaaatgctactattagccgattagccatgcacttatcaactaacatggatgttgccccttctaaaggcatccagagttattcccagcatgtagagccctgggcctgatatacagtaagtgctcaatgaatgcatttagaatgcactggacaatttgagccagggagtgaagagaatattatctagacagccctcaagagccctccttaaaggagaagtgggaaagcatgggtattgagcatgctatctgtgtgtagtgggtgcgtttgcagtgctcaggggtgtgctgtcctctatgccaacccttccctgctcctaatcttctttgtatggtggattctctgcagccctcggcgactgagtgccaggcacaggcaaacttccttctcttcccagcaactgtccccactggcttaaaggcagaattcgtcaagtcccttttaattcagaactgaaattcattcaccagctgcttgttcattcattcagattcttctaaattgggtcctctgcccaggttcatctccaccccccatctgtcacctggttattacacaacctcctcgagttccctgggggctgggatgaggagggaacagggcgtgcatgtctgggagatacaccaggtggcctttgaagagttgttttagaatcagcagtgtgatgggggtgggggtggggagccagggcacaggtgacatgggagagacattctgtcaggggaactgggagaggctccagtgtagaagtggcacctgatcggggccatgaattatgaataggaatccagggggcagaggtaggaaggtaggaaagagccaggtgagtttgacgaacatgggggtcagtgtggaatgcgtgcaggggccaactcccagaggtgagggccccccaggccaggcagattggtgtggaccttgatctgtaggtagtggagagctaggaaaggtgcccagcttgggatacctctttagatgctgcagagaacctgtcagaggctggggcggagggcagggagacgtggcggggctgttgtagcagtccagtgagggacagggttgaatcagttcagcaggcctatatcaggatctgctgtgggccaggccttgttctgggtaccagagacacagagaggttgaggacaggctctatcctcattgaattcatagtccatcaagcagggctgtgactggtcacatgtgggctactggtggcactgcacatttggagagaagatgatgtgcttggtttaggaggtgctgagggtgatggcttgggtaacatcctggcagagacacccaggtggctggaatgtgggtctggggctcaggaatgacgtccgagttgagctgatgagggtgctgtctgccctcaagggtacagggagcacatggagatcagagccctcacacgctgtcctctgctctgcctatgccaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagataacacaagcatgactttttctgtttggatcccagaaaggcggagggcaggagaaggatagagccctaattgctcctgagagccattggatgagattctgaggtcgtggtgggcacaaattttccacagaacctcaaaagttcaggggagggctatgctggtggaaggtgccagcaggcaggaggagctagaggcggctgtggacccctgggtggatccatccctccctagaacgcactcttgtctctaaaacaggtggagtgctgcccaggggactggctgtactgccttgtgatctggggctgagggttgtatgaggaagggacaggacgctgtgccctaggacaattaatagatggtggctcctctccccaaggagccatgccctggccttgcccttgaaaagccctagtccaggggagggaagtgggggactcagaagctgtgtctcttccccaaaccgtcctgggtacccagccctgcggaggctcccacattggaaactgaagaggacgctggctgttgggggtgccctgatcaggatgagcggaccttgctcttggatctgttcatccacagatgagaggagggtactggttgagacttggctctcctttggaggcaatggggacttggtggagggagggcttccagggtcaaggccgtcagggaaggttggctagaccagggaccagggagcttgtgcaggaagatggagaagggccagcaggtgcggtgggggaaggggcgggcaggactccctgttcagggcatagcgtcctcagaggaacttctggaatgggtccccctggcccttggtcaacattaggtcagatttgggactttctgaggaattttcccctctctccaccctgccccattttctaacccatccgaggaacttcccgcccttaacctcttctcagctctgccatccatgtagccatctgcagaaggggctctgagcagtgggggctgggccaggccgaggcagggctggtgggaatgctcctcctaacccatggtgcctggaaagtcccctgctcatgcttcctgctctgggaacagtgttgtcctctgtgtgccttccttgagaggggaccacctcccaggccttccatcctcagggtgaggccatcagtctgatacttttctcaggagggacttggatccaggagaagcatcaggaagtggagtcttgggataatgccaggcctgctcctggtatcctgaggtctctgggctggggcaggtgtgtgtgtggcagggagggaggctgtcctggccctcctctctcttttctttctgcctctatgggggtgggggtattgggggaacttggggccgttctggggtagctaagcccctttcagcaggagattgggggaccagtgttgggggcatcctggtgatggccgattcctgcctcgtcacatgccaggcagatgttcccgactcggctggacccagctgcctcgtttcctcccttactttgctctgagggggtggaaaacaaggcttctctttctgccctggacagctaccagcacccggggtaggggatcccctggtcaccagtcttggcccagtacaggaaaaggaatccgctttgtggccacagatgggggctggggatggaagcagacctcagatcctgcatctcttcacccgctggacacaggagggctatgaaccactgtgccgtggctgcaccactggctggagcagagccaggcctgggagaggcaggtggccccatcggcccctgctctgcaccacccctcccagatgacagagccatatgtcttccacgtgtctacacactcacagactcacgaatgtaatcgctcagtctcacaacaagcacacgcagtcacacacctgcccacaggcacatacgccacataagcatgcctgtatgctcacacagtcatactgccacacgctattacacattcacagccacagccacacatgccttgccatccattcaaagcaccagtggctactttgtcagacacagccacaccacagtcctatgcacatggtcatagcctcacacagtgacacatactcgggcacacaccgccacaaagccatgcttgcacagagcaaaggtgtcataagcatctctgtgcctggactgcacctgcatgacctcccagggtccccacctcatcagagattaaggagagctttgcttggagacaccacccctggagggggtgtctccaagggggagtagagccagtcacaagcaccacatacaggcacacagcctgaggtctagggatgcaattgggatgactggataccaccaagttcagctccttattgaacagatgggcgcctgaggcccagggagcagtggtggctggccttatcacccagcagggcaggggatactctggggccagagcctggctctgggcagactctgtttcctggccctgccctcccctgggccaatcctctgggccaggctgcctctgaaggcccctggctgaaccgatccagcagagctccaggcagctcccttctcaagctagagctgagctgcagtggccacgggagccggagccaggatgcggtgggcagggcctaggcctgggcgggaggaacattcctgcaccatctcctccccaagcatgtgaggacccagcccgccctgcccgcctgcccgctgactcaggcctccaggagccaagcctgctcagctcccccacccaccctaacctgcttccccactagttcggctctggttcccctctccactggctggggcaggagaagacggtgagccctggtaggaagaccatggggaaaaatcaaacctcaccaccccccgacatagctcagaagggctgattgtgaaacccagctctgttcaacatagttgaacacaaactttttttttcttttggtttggttttgttttgttggtcaaaccccagtgcagtgcagtctgtttaagaagtagtgtcgcatagctgtggcctggatctgctcagcagccccagtaggcagcatttattccctttcgcaacaaagagactgagacttggccagagggaagatgggacctgcctaggttcacacagggaatctctggcggggctggactcaaacccagctccctgccatcactccttagagtcacactgatgaactcatttagggccaaaggaagaaggggaggcagatttcccctctagatgagtgaagggataggaggctggtgaacccaacggctgaaatgtgaagggtgagagggtagggtgagtccccccagccctgagggatgaagggtctgaagatggcactgcacggtgacagctgcagtgactcaggagctccgtttacaaaggaacatgagtgaggaacataacttaatttttttttatatctgacctgaatttctgttttcctcccccattccccacatggtagaagtgtaatctcacatcaatttggggaccctttctttccccagggatgtgtagaacttttggggatggcacatttgaagaccttagggagctttgcattttaaaggctgaatcccacactctatcatacatattaatatttacctgcattccacattaaagggttcagtttatgacttgtgtcctgtcttgtagatacttaattaaacggtattaattttgattttgcccctttctgttggtgctctgctctcttccctcctccccgccctgcccacccagcagcacacattgttacgggttgcttcttgcagaactcctggacctggatgctgccattgggcctgcgatgcccgccatggtcctggtcagcattgggccctccgatcatcttgccctgcctcctgcctttcccctgcatgctcccttgatgcccatcctgagtctctgtgtgtctggctcttctctgctcttgggcactcagggctccttccatttgccctgtactaaggggctgatagaggtcctttctgtggcctgtggccccctctggggcctgtggtcatcattccacagctcccacttcgcagtcaagcacagggagctctggggtgccgcttagacaccccatgccaccctgtttcttctgggatctggctcctttcttggggttctacctgggatgggggtatgagtcccactgcttcggaatctcccagcctctggggattctactatctcccagtgcaggcagcactgtgatgggcactggatggtcgttattttacaaccaccccatgtgcaagagattattactgtcattttacacaccaggaaatggggtccagcgaggggggtgctggagtagccaaggctggtgcgaaacagtacccaggcctgggctacctgtgctgagaggcagatggccagtgccagggccgggtgttacaggctggcggaagcctggaggcacctggagcctcttctgggctgacccgcaccccttgctgccatttggcaggagtgctctggggttggagcaagggagtatgaggctcctccatatagccctgctgcccccagatagcagcagcccccaccccaaccccattcctttccctctaccgcccagaggcaagtgcagatcctgaccagtgtggccttgctgtagggatgtttcttaactgcttcatgcttctgtttctccactgagaggggagttccagatggctgttaggagggtgacgtgagcagaacacatcatctgggcagtgcctgcacagccagcgccactgaggagcaggtggggtcatcagcctgagtagagctggagcagccctggggagagagagtgctaagaatattggtacccccacttcataggttggaaaactgactgggcaagccctttaaagccacacagtgggtagatggcagagctgggcctggaaccaggcccccaaccacccccagacctttagccttgccccgtgttgccacactgcctccgtggggagcagattccttggggtccttggctgtcattgtacttgtcatccagggcaggaggggtccgctgggccactaacagttacatataccaacatatacaggatagcacagcccaaggttaagagccccagtctcatacccaatgcctcccataaacagattcactgggtgacctcatgtaaggtcatcattcagtctcagtttcctccagcatcactcaagcgatggttaccacgattatacatggccacgagttcacgagtgtggatgctgtcactgcctcaggccggctgcatcctcaaagccacacaggtcagccaggttgggtgggcctgagtgcacaagagctaccattttttcagtcctctgtgctggtaccacgactgtttggaaggtaggaactcctattgtcaacattttccagcagacggtggctcagaggcattgagtcactgcgagattgcgcacctgccccatggcaggcctgggctgaggtctgcctgcacttggagccgtgcccttcccaccgcaccaggctgccttttgaaggctggggggctaggcgtggcgggggccactgtcctgctgcagtgtgaacacaagggtgctgggaatcgaagggaatggggagggagaggggcaggtggccgtgaggggcaggtggtgggtattgggtggaggtggctgtgttccttcaagtcagtgggtgaaaggtcagagggcttggcccacagagagtgctgagcaaatatttgtggagagataattttctggaaggcccgaggctggggcatggggtcaggttctggctgtggaggagggggctagacaggtgaggccatgggcagcgagctgggggcaggagcaggactctggtctctgagaagaactcaggagcctccttactccaggagacaatatgggggcagtgagagctggcaggaaaatgtcgagactcggggaagggggcttgtgagtgctgagccaaaaagggctctggccctggggctgggctggggtgtcaggtggggcaggcagaggtggggtgatggagtctctgcctgcatctggtacctggagtgtgtggacccacctgtgtggttgcaggtgcctgtcagtgtgtgcacctgtacctacctgcgtgtatgtccctgtggtggcgctggcgcttggtatctatagtcattcagccacacgagcttttccctgtgtttctcagcctggaaaagacaattcctctccccctgaacctcaggcccaccttgggctcatgcctggctcctctctttctctcattccacatcccatccacaagcacagccttgttagtccatcaaatgagaccccaaatgtaatgctctcaccacctgggtccaaaccactaggcttacctggactattgcagcagcctccaagctgcccttctgctgcctctcctgctccttaatggtctaacaggggccagagtgatcttttacaaaaacatgtgaatgtatatatatatatttatacatatacacacacgtgcatatacacatatataaaaatatgtatttttttttagagacagggtcttgctatattgtccagtctggtctcaaactcctggcctcaagtgattctcctgcctcaggttcctgcatagctgggattataggcataagccactgtgcacagctcagagtgaacttttaaaaccatattctttttttttttttaaagacgatgtctcactgtgttgcccaggctggagtgcaatggtttgatcttggctcactgcaacctccgcctcctgggttcaagcgattcttctgcctcagcctcccgagtagctgggattacaggcattcaccaccttgcctggctaatttttttttgtatttttagtagagatggggtttcaccatgttggccaggctagttttgaactcctgacctcaagtaattcacccgcctcggcctcccaaagtgctgggattacaggtgtgagtaccacacccagccttaaaaccatattctaaatcaaatcatgtctctcccctgctttcaacctcagggcttcctgccatacttaggaaagtttccaaactcctagcacaacccacaaggctccttcctggtcttgcgtcagacccctctgcacttcggtcatggaactccagactcattggtcggctggtttcctcttctgcgtttgctcagacctcagggcctttgcatttgctctcttctctgtcttgcatgttcttcctcccagataaacatgtggttctcacctcaattaattcagatctctacataaatgtcacctccttggagaaggcttccctgaccctgaaatctaatgaaacttcctcgtccctctgtttccttaccctgccttattttttcttcattttacttattaccagctgccaattataaatgtgtatgtatttagctcttatttatttatttttgtcacccaggctggagtgcattggcgtgatctcggctcactgcaacctctgcctcctgggctcaagcgattctcctgcctcagtctcccaagcaaatacaggcctggcacggaggctcatacccaccactttgggaggctgaagtgggcggatcacctgaggtcaggagtttgagaccagtctagccaacattacaaaaccccatctctactaaaaatacaaaaattagctgagcgtggtggtgcatacctgtaatcccacttactcaagaggctgaggcaggagaatcgcttgagcctgggaggcggaagttacagtgagccaagattgcacaacttcactccagcctgggcaaaggagtgggactatgtctcagaaaaaaagaaaagtttcaaacatacacaaaagtagagaaacgaatataacagaaccccacatgcccacctcttggctccaacaattctcaacactgggtccctattttactcccccacaccctttgccttccggtggactccagcatcacacagtctcatgtgtggatacttcagttcaaaggttatattttaaatgtagctgtttctggtctgtctccctcagtagaaagcagctttctggggagttggtgtctgtctgtcttgctcactgctgtatctccagctccggcacagtgcctggctcccagtaggtgactgaggaggtctgcatggctgtgtctgcaggtctctggggagggcatgtgtgtaggtgctggtttgcacatgtccaccaccgtgtcagcgagtgtctgcacatgcctttatgcgcagctgcatgtggcagtcctgtggatacgtgtgcatgtgtacgttgccacagcagctgatggctaaatgcgtgcctactccctgatgtcatttcccacacccctggggacccaatgactcgttctgggaagtatttccctctttctcagcaagggatggggtgtgaaggggtggaagaggggtgtgcaccagtctgctcagccctctggaggacccagagagccccttcttgaccttccttactagcagggcgccgtgctgtccccaccagtagagcaggcagcctctttcttccctggcattgaaacccagccagttgggccggcatcagctgggtggggtgtggagtgtgtgtgtatgaggcgtggtggtggcccatcctggccagctccaaaggctcctagggtgactgctgtgtaattgggcaactgaggccatttaagctggggacaattgggtgtagacatctggtccagtgccccagcagtgccccctctcccccctgcaagttctgcatcttaaagggctggccctggaaggcgggcagtggcgtaagacctcgctctcagcccagcaccgggttcattccaggggctccttgctgtcgggccaggagctccacagtggcttctcagcctgctctccagggccccttcttaccctggaggccagggtccgcgtcctctggctctgcattgtccttcccacctcccaccctgccttaggctcagctctcctccttcttcagggcccagcccagacagcccctgtgttccaggaggggcctgccccttccacctgggcagtcaggttctttggggctcctccctcttggatccctgaggccaagacctccccaccatgtaggccagatggtccccactcactccacccccaacctcagggagagccttccgaatcagtgaggtgggtgtgcagcaaggaagggcagagtggcactgccagctgctcctacccagaactggatcccttgctgcacacctcacttcactccctgccacagcccagtgaagaatggccctgcgtctctctttgccagatggggaacacatgcattcggccatccaaaagaaggactgagcatttgttcggcacctactatgtgtcgggcactgagatagctgccataaattatgataataacaataacatcagcttctaccatttgtcaagcacctacaacatgccagacccatatgctgggccattcaataggaggaaccatcataacaccaataataagaatggtcggcctggcatggtggcttttgcctgtgatcccagcactttggaaagcagatgcgggcatatcacttgaggtcaggagttcgagaccagcctggccaacatggtgaaaccgtgcctctactaaaaatacaaaaattagccgggcatggtggtatgcgcctgtagtcccagctactcgggaggctgaggcaggagaatcgcttgaacctgggaagcggaggttgcagtgagccgagatcacgccactgcactccagcctgggcggcagagcgagactccgtattttaaaaaaaaaagccggtcacggtgtctcacgcctgtaatcccagccctttgggaggccgaggtgggtggatcacgaggtcaggagatcgagaccatcctggctaacacggcgaaaacccgtctctaccaaaaaacagaaaaaaaaattagccaggcgtggtggcggacgcctgaagtcccagctactcgggaggctgaggcaggagaacggcgtgaatctcggaggcggagcttgcagcgagccgagatcgtgccactgcacatctgcctgggcgacagagtgagactctgtctcaaaacaaaacaaaacgaacaaaaaaaaaacaaaaaaacgaacaacaacaaaaaaaaggccaacatttattgagcatttactgtgtgtgaggggctgttctaagagctttgccttaacactgaccctttggaaagaaaccttggtcagttatactgttttggtagatcttcattcagagagagggcagaagctgggctggggccctctggccagacacatagcatgaatgctggaagggacaggaggagggcttctaggcagaaagcaggcactgagctcccaggcctggctcaatactctctcgaaccagtggtcccttcttgagttagaacaggtgggtggacttgtacaagctcaccaagtggacagtcactgcctctgccctccttccttcagttcatgtgttctgcccccagactctgagcttctcagggcagattagggagcagaggtcctggggccttgaaccttcatggagtccctgggccttgccccagttgcttgtccaggtgcagtactcacaaggcaaccttttagcagggctgactcagaaggggcctttctacctgagtcactgacttccaggagcgctcaggctctgccagcctcgcccacctgcccagcagctctttaggtcaccccagcacaggcgccaccttccccaacaagactcaacaaggctcccctgccgcagtctggttcttgaaggtctctgccctggccagcatgtctggcatccctggcccattgcctggccccgatgcctctccaggtgttgggcatcccactgctgagagacatatctttggcatctggaagtgtttcaagcctctaggaggcctagctctgccggtgaattgctttgtgactatggttgagtcacacctcttctctgggccccctgattgaatgcacggtcgtctgggtgggggagaggtgagggcatccgtggctctgctctgccccttgcccccgaaggttgtgatcaagtgagccctgtgagtggttagcccggctggcacagcgccccatgagcctggatgttctcaggagggctgttgggcagggggaggctgagtgtaagggggtttggggtcatctcctcctcctgccccacttaactttgcttctttctgtggtgagcccccacgtgtgatttggtgaacgtgttctgcccatagcgttctgagatagaccctataggcagaacacgttcaggcagaatgacctcaggtgtctgggtgggagggagccacgggcgagtctgaaggaggtgtgcagtgagctctgaagcatctgggagggaaagattaaatccacccgacagaaactcagggcctggggtcaggtcagcctgggccctagcagagatctggggccagagcagccatcgagagcccagccagcaaccctgggggtgagaggagcaggggagccagagtgggaacccaggagaggtctgggtaggatgggtggtcagaggcctcttggcttgagggcatgtctgagggaagggggtgctgtgttctggcagtagatgtttgctggacatctactgtgtacccagcatgggcacagcagtggctaggccaggctacacactgccttagtggagtgtatagaattgaacgatgcctactgcagggtgtgggggtctggggccttcacctgggctttggctcaacaacccaggaggggagtggagttggtgggggtcccaaaggcactcccagcaccaggatagcccacaggctgggggccatagaccagcattccttctgtggacaggagagacagtggggcacctctgcgggacagagagctctgggtgtcccatgccctccttctgaccaggcctggctggcagtgtgacaggtggcttctttcccctctcctgctggctgccctgctcctccatgggggaggccctgtgcatgacacaggcactgactggtgacattggccggacacttcccttcatctcttcccctgacaggtgagaccagatgggcagggaagggacaggaagggaaggagcagccagattacagaaggtggggtggtggggctactgtacttcccagggccccatctttgggaggtaaggatgggagtaggctgtttcctgcagagcctccccattggatcagatctggctgctggtcttaccctcctctgcttccctctcttgtcctcactggagtcccctggggaaggaacccatgtcagaacccatccctccaaacctgcagcggatgtgggggtctttgcaagagtgagagctgaagtggaatagaaaaccctgggacagggctcgaggtctgacccctcttccagctcagccaccagctcactgtatgatcttggtctgggccctgcctctcccattttagtgtcccctaattaaagggtgaggggaagacttcagtcaggacttacactgtgtcatgtgtcttctaatcaccagggaccttgttaaaacacagtctgattcagctactctggggtagggcctgagagtcttcatttccaacaagctcccaggtaatgccggtgctgccagttcatggactccactttgagcagcaaagacttaggcaactcattgcatttgagtctgcaagacccagagactgtgtctcttgggtcctttgcaatctcacgaggcatcagaaggaagccttgggattagctccaggctctggactaacagagcacggatctcaggttggcaggcaggggaactatcctagtcccctgctgaggctgtgtttgggtaaaaaagtccttcttggcaactgggcgatttaatccagggttgcttctgtctctaggggctcacaggacatctggaacatgaaggaacacaacacaacccaccaattatcttggtggccacagagggccctccaaggagctgatgccctttgtgaggctagtagccatcagttaaatactgtaatccattacactgagaatagaaatgtaaccaggatgtagctgaacatgcccagctttagctgccatgtggctgggccttccatggaaaggaccagccttctctaaggagaggaggaagcagacagaggcagtgagccctcccactctgcgcttcccctcactggcctgctcacaccgctgggtgaaggcacatgtcagggttaggtagttattcaatggtatgcctgcggctcttcaggaagggctgattggattcctatctacatcttccactgcatttttggcacaaaatgctctggctattgcctgaccaatcttagcggtaactccacagggatggcgttacctatgagaggccctagggtcggagtggagctgtgtagaggagcccagcgggtctggttctctaccttggtcccaactatttaccagggcttcccgacatcttacggccaggaatgggagatccaaccagagaggtctggagttctgcccaggaagaacctccacctctttgagatctggaatcttcagggcctggaggaagatgccagcagccctggcagttctcattggtcaggggaggtcggtgtggggtggcagaagcacttctctggcttcctattgggggatgagtgtgcaagctcagtgggctccctggctgccagagcaatctgcttaaaggactggcttctaggatgcagggaagggctcagagggagccccttctctagcacctgagagactaagccacttagggtggtgggcagggtttctaagctggggtcctggggatctgggcccctctggcaactcctaccctgtccccttcccccaccagtgggctcactttgcaattctgctgatgtcagcttgagtgccttaatgggcagaaaatcctgactcctttgcccgactaggctagctgggactgcagggggccccaggtaaggagcatatacttctgaaatttgtgtgtgcccccgcgtatgcgtttgtgtcttaggtaggtaggtatttatctctgtgttgtgtgtctgaaggtcatgcatgagcctgtgttcatatacacaatggcgtgcacaaaggcacattatggatttgtgtatgtttgtttgtgtggagagggtcaggagctcccagacattcctgaacacttgcacatgggttggctgttatctccagcgcctgggaggaactggctccttaaaggagggggatggtgagttactttgtaaagtggagacaagccccttaagccctggggaaagggatttacataaaccaaggtcccacgtttaggttgggttctcagctctggtgtgcccatgaaagaccctctcccaggtcctagcagagctgctggcacagtgccctgggtgccagcccactgtcctgcatgggctcagaggagctggaacggtgtcagctggtgccagctccctgggggcagggcaggccgggccaggctatgtgaacagagtgtgtcctcagtcctctgggggaaatcggagaccaggccagatcctgcctgctgggtctctcaccctcttctcagcttacacttccagggaaactggtcaccctgggtagagacttgctccagatatcagggccctgaggctccagcctgagctcctgggaggggatgtggtgtagagacacccttggccaggcccctgcctcaggctggcctggggcgccagagagaccaggcttgtagaaggaacggagcaggctcacgcggagccctgtgcacggtgagctcagggtgcagagggatctctggggccctggtcaccctccctggggagtcctgcttttcagtgtggcaagaagcgccttgctgtgtgacagccctcttcccctccctgactcttagtctcccctgggtcctctgggggccctaacagcaggatgtacctggcctcctgcccgaagcctctcagagtggaggaggacctaggaggctggacactgagatgcgagaggcgtcataggaggggcggtccaggggcagggtggggaggagacttctcttgctcattcctggttcaaatgtttcagatgttgggatgcagggaagaggtgactctggtccccagatgcaggtcagctgccagaggctggccagggcttcccacccactgaccctggctgcactcagaggcctctcacatttctcttcctctcttcagtctactgtcagggccaggcatatcccctgggacccagaatctgtctccattgcccccaaccctgcgacaccctcaagagaggtctagagggtggtgactcagtaactcagagagggccttctggagatgccgcggcctcagaacccctctgtaacccaatgctggcctctcaggccacgtgcggggatgcctggcttttctgaatccttgctgcttcctctggctttgagaagcagcacacttggtcctcctgttgggagggtggacaccagcagaagccttccttgtaaaagtttctaggaggcacctgtggtggttctcctccccctcccccttggtaccatgtcccagccttgggatccccaagtccccccactcccttcactttgctgctgcaaccccttgagaggtggctggggaaggacaggggtatggaggtcgaaactcaggctaataaatctagggtggggagcatttattttaatttttgtcttgcagctctttgtagaggacctagcctttctctactgaactgaaggggtttggtcccatcacccgaagactggcccacctgcccacacaggtgggggcacaggaggtctgggaggccccaggaggtggaagttcagaggcctgcctggccctgtccatcccactggctgaggccaggccggagggccgaccccaggggccctctgtatgcaagccgacgcagacaagggcccagtgcatagttaagacacaaacaccacacagctgtccagagcctccaaagcactgtttatccaggctccatggaaccaagtgcccccagctgcctgccctagtcctcaggggggcactggcaccgcagtggcctcggcctgagaccctcgatgagccccagcctaacctgctccaaagccactgacacatgcatgtttagcccttggcccatcaagatggggccctgggaatgaactggctgcagaccctcctccatcccacacccccaggggctccatcagtcctggctagctcagcaccatgttaaatagcttccttgcaatctcccttaaataaacccatccccagagcaacctacccaccctgcaccctgaatatattatcctattggcttatgccttctagactggaggcgctctctcctcttgccctctactccaggggataccatctccctaaaaaaccaggggaggaagtttttttctcaactctggggcagagacaaagggtggcctgggttggagtggaaaagccaggaatagcttcctctgtcccttccctccccagggtacttccttctccttgccctcttagcagcctgggtcaggcgcgacttacccaaggtcacagacccaggacccagagtcatgacccatgtaggaggttaccctggttttgacagcccaaaccagctccagggcaggaggactgaacttaagcctgcctccaccttggcccctgcagttctccaggctcggagtgagctgagggaggttccagctcttgactccactctgtcccggacccctgggactatctcccaggaccctccacccctggtgtctccaggtctctcttgctctggggatactcagacagcaccaggcatggaagcaatggggcccgggacatgggcaagcctgtccctggcccgatcagcatctgggcccaggccaggcctcacacccagtactggccattcttaagggcagggttgggtgtccggcagaactgcagcagctctgggtcaggctggcctcctggagggggcccctggccaggcacagctgtgagcgggatggcctggcctggctccaccttgcgaaaggtctcggtgtcaccagccaggccgttgcggggcttggcagtcaggacctggacgtcatgcttgcccgtcttgttgcgttttcggaggtagaagagcaggggcaggatgagcgccaggagcagaagtaccaggcacatggggatgatgacgctgaacatgttggcctcaaggaagctcaggaagcctcccttggccacagcgggctcagggctggatgccatggggcctggctcgcctgtgggggtgctgctctctggcttccctgcttccgtccgggcggcctcggggacactgagcagggccacgctgtagggccgggcagcattgtaaggctcagtggcaaagtccagggaggccacagcaggcgggacgccctgtgcccacagctccagagtgagactgtcacctgcggggccgggggccctcccctctggcctgcccacctccagccccagcctcccgtcctcaaggtcctgctgagtgaactgctccaccagctggctgcccccgggctccgtcctggctcggggcacgcggaccacgcggccatgccggggtccctccaggaggcggaagcgcggcacactgcctgtgcggttggccagctcgccagcatctaggacggtggggtccaggcgcagggtggcaccctggggccatggcccacctgcccacacatgcagcagagccctcacagtgacgttcactacggctgatgcattgacacccctagccagtgccaggactctgaagtggtcatgagaggaggagaagttggtgaaggcaaagaccacctcgccctggtctatctggaattggctgaaggccgaggtgggccgcccgcccaccaggagatgcccatactggggtccctggatgaggcggtatgctgcctctggctcctcccgatctgaaaccacccggagctgctgctggctcagtgaggagcgccccaaagcttggggcacctccaggggtgcccgcagctgcacctcgatggcggatggtaggatgtccacagccagggacatgggcaggggtgggctggccccatcagacatgctcagctggaagatgcctgccacgctgctcccgttggccacgaaggccagccgccctgaatccacatcggcttgcgtgaagcgggtcacgggccccaggccaccacccaccaggctgaggaagccgttgtggggtgcccgctggacctcgtactcaatctccccaggagctgagtctgggtccaccacactcagctgggcccgggagatgggggcacgagagcctcgggtgagccggagtgggacagaggcctgtggctgagggggccgctcatttacatccctcaccgtgatggcaaaggcctctgaggtttggggtccagccacggaggcccctgctggcccctggaggtgggcacgaaagtggaagccatcctgctgggtgcccccaccgccgtgggcatacactagctgccctgcagccagctgggactgcaggaagtggggctgcccagcatggaggggctcctcggacaccaacagctggccccggctggggaactgtgtgacctggaagagcacatcatgctctgagcgctggggtgatggaacgctggccaagagattggaggcatccagagcagccacggtgatcctggcccgctggccctcggggacccagagacctgggggtgggacataggctatgagggtccagcccactgaggggagagtgatggaccctcagctgggggtgcctcagggcaaggatgtgcctccccccaaccatcaagccaggtcctccagggtggggctcagggttcccaggaggataaggactatgtccccgctgtgatgtcaaagcttccccactcaccctccctgtgacttcccaggtcctgggggctgagacaggagctgctgaccctggcctcgtgtcccctcctcctgggcctctcccattgtccctccccacaatcttgccagcttatcatgctgttcacctttgttcttccagaggtggctggggcgctggggacaggcagcctcaaaagacacagccacagcaagggtggcggccacgtcccgggcaggcggcgaggacagctggagctctagggtatcatgggcctcccaaaagggctcggggggcatctcatgctcatacagaatattcccagcgtagacctaggggagacaccatcgtggggtgagaggcaggtccagcctgtgttgtccagacactgagcacttttgtctcctcaggccccactctgggctctcctgggtgtgcccaggtctgtgcgtgtgacccgctgtctccctcactaactcactgggtcacatcaggcaatgcagtgcagagctgggctctggagccggagcctgggctcaaaccccaactctgccaccctggggaaatcgcctaatttctctgacctctggggaatgcaatgatctgtctgtgctgctctctaaagcgagtacttcctcttgtgcacaggatcctatcccctcttgccttctgaagacaccacttctactgtctcttggctttctcctatggtgtcagttccccccagatgcatcattcccttcattatgcaactatgctattcttttgtctcacttacattaaagctatttaattaattattattattattattttgagacagggtcttgctctgttgcccagactggactgcagtggcgtgatcatggctcactgcagcctcgacctccagggctcaagcgatcctcccacctcagcttcccaagtagcggggactgcaggcacatgccaccacacccagctatttttttttattgtttgttgagacagggtctcactatgttgcccaggctggtcttgaacttctgggctcaagcggtccacttgcctcggcctcccagagtgctaggattacaggcaggaggcactgcacctggccagaaaaaactattcttgacttcacattttccaccagcttcacccctgcccctttgcttctctttgcagcaaaacttcaaaaagcatagtccacgctctcccccaggcattcttgggtctctctacccaggattttgctcccccatcgccacatctccttttgccaagggcaccagaggcctccgtgttgttggatccagcggtcggctctcagcctcctcttaactgctcagtggcactggtgccgccaagcaacccttcctccaagagagccacaggctctgggatacttcactctggggttcctcctacctcacagactctcctggctggtcctcctcttctccccaacatcttatggccaggtctccaggctcttttctgtctacaggcactctccatgagtccttattcagtctcctggcctcaaatgccagctgtgctgagacccccttatttgtagctccagcctagcctgctctcccctgaaccccagactcatgtttccagctacctctgccgatatctaatagacacctcaaactcaacctgccccggctgcactcccgatcggcccccacctcctacagtcatcctgcttcagagactatagctccgttttcaagggctcaggccacacccttggaaccacccttgcatcctctctttccctcaaaccaccgcatctctcacctggattatcgtaacagcttcctgtgtcccagctgcagtcccccgcccattacattttgttcctaacacagcagccagagtgagccttttgaaagggaagattatggggctctttggctcacatagtgcagtgtctccccatctgaccactaaggcctggctgtgaccatatcacccctgcgacctcaactcccctcacctccactccagacacacctgctgttctatggtgctgcctgcagttcaacaccaaagaatattcttcgctccaggaagaaaaacggttttctccacctccaatcacaatgtgttcttttggcctatcttttgctccccacccacccttttttttgagacggagtcttgctctgtcgcccaggctggaatgcagtggcacgatcttggctcactgcaacctccacctccacctcccgggttcaagcgattcccctgcctcagcctcctgagtagctgggactataaatgcgtgccaccacgcccagctcattttttgtattttagtagagatggggtttcaccatgttagccaggatagtttcgatctcttgacctcgtgatccacccgccttggcctcccaaagtgctgggattacagctgtgagccaccgcgcccggccttattttccccttttaggaaacactgggaactattttcttctcagagaaaaacaggacttgcccaatagtaacatggaaacttaacagggtcttaacctgtgaagactctaggagcagaacccggagtaagggggagcaggggccggagtaaggggagcagggccccgtctaagatggggcagggcctgggctaagggagagcagggccgggctaaggggaggcagggcccagtctgaggtgggggcagggcctggtctaaggggagcagagcctgggctaaagggcagctgagcccagtctgaaggagagccgagctatctgaataggggctagcacctgttctaaaggaagtggctgctcccctgctttcgctgtaagagggaacacaggccttttaagaaaatgggaatcaagttttttgtttaatttcccaaaggttatatgttgacaattaacttcaaagtattagctgctttttgtaggccaaataaacacgtctgtgggccagatctggcccaggactagagttgccagtggcaacttctggcccaggctgaatggtgggcaggaaggaaatggagcccccaggagtgggagtgggagctgatgcctgggtacgggagctctgtgggtgggagtgagacaaaaaacagggtcttgagctctggggagcaagcagtgtcctccagtgaaggaaatcctggactcgcaggcagaagttttgcctcttactcgccatgtgctctgaataaagttacctgccctccacgagcctgtttccttatctgaaaaatggggacacctgaccccttccctgcccagtttagtgttgtgggacagggctgctgtcaagacaatacccagtcctgccctcctcccagagtgggccagggtagcccacgtagcctcttccctgctttcctgggtggcactgccagcctgaccccctggtgtccattcagtctagtccttcatatttctggggcacggggaagctctgagtaacgtgggactataaagtgcaagagggttgctgatggcctggtcccgtgccctctccattcctgggcattcttgacaaaggctcccagcaactgagggtacgcagcagctgcagacaccagcctgacaaatatctcattgtggggagggggccatagcaggagtggggagccagggaaatacagaacctgggactgggaggtgttgatgtgagaagcccaagaaacttcattccacctgtcaaagccacctccttccagatgcccaaatctgagccacttgctgggcagggactttgcctttgcacttgctgaataccatctgcacctctcaggagggagagtgccaggctcaggagtccctgccgagctaggaaagggggctggggtgggctctgccattttttgaaggctggcagggggacccctcaggaggtacttggggcagtaccatatgctgtggctcctgagtgagagtcagctctgcgccccacaagaccactccctacccagaattcactgtcatcatgtgctgggtccagatgcccatgcagcctcctggcgggagcatcacatgtgccgcctgcctgggatggcccatggaagagtctgccccgctctgccctgctatggaacaactcctgttctgtcttcagcgagtggtgttcatttaagtgatgactgggctggcccccatggcacagttatcacagagagtctgctgctacccatggctgagagctctaattcttcctggtggtctctgaagccaccaggacggatgaacagcagcttcaccctcttggctgactcagctgcctttcatcagctcatctgcccctaggatccactctgcctctggctggcacttgacctgagccccaggctcacacctctgcccacaggcccagccgctgcttcacgtccaactccatcccccaccaagcactgcccctcatcagctactggggtaccactagtgcccccacatggtgccccctctccagaccctcgggtccggctgtagcttccttctggaagctataccccaagaccccagccctgctctagggccctgtatccccgactttctgcatccttctccctccttctgggaacatgaacttgccctgccagcctggcggctcctggaggacaggacactagcgcctggacaatggcaggcccgggaacgtctgctgccagtgatgctggagctggcatccatgtccacatgatgtccatggcacagcggccacctgaggctgggggcatctgagtggtggctgcaaagttgggcccttacctctgcctgagtgaagttcaccagggcctcccctgtgctgtcctgctgggcgtggaacagccggcctagctgggggccccgcaccacacggtagagcaggagctgggggtcagtgcctgcgctggagctggccctgagggtctgactgctgagtggctggacggaccctgccagaggcaaaaggggatatcagattttgactgggagccaggtccaggcctgtgtttgcaaagaggcagcgtgaccctggcatgccaccctcagctccgccccagctcctggcacccaggaatgcccatgatcagcacacccacctgggcagacagtcagtgtctggctgcccttcagcgagaggagcacttgcttctgggccgtcactcggaagaagtgtccgggggaagtgtgctcgccgtcagagaggcggaagcggaagcctccatccagggttcctggggacaggggcattgggtccagctggcccgagccggctccccatctcagggcacccccgtgggcagcaggaacccgaggcccggccctcagcacccacctctgtgtgagaacagcacgagcccgccgtccagctgggcctgcgtgaagctgcgcacctcagtgcccggcgccccccgcagcactacccgcccgttgctgggctgctcgatggtgtagaccagatcctcagacccagagtcgccgtccgtgctcctcagagcctccgcagggatgggcgcagtggccccctcccacatctgggaacacaggcctgtgaaggttctgccttgccgcactcacccaccccttcctccccggccctgggctgccaccagggctccagtcctgctgcggctcagcccctcgggtggcatcgaggctggcgccactctggctcccctgcacaaagggcctcccgcattcaccttccctgtcaccccagggaaggccccagggaaggtcaccctccaggcccagcctccctgctctccatctgccctagtcctgtgtgtccctcaaggccagcttatgtcccctacccaggaaggccccagctcttaccctcaccaagttctcactcccagaaacccccagcgctgaccaacagtgctccctaatctgtctcactggtgggacaggggtctcctttcagagcctccgtgtgtgcctggccggggccgggcacaggtgggaatggtgattttagaaatgggccctccttccagctgagggaggggtgcgtggcgcagagagtggggggctgatggttggcactgttctgcagcacagaatcagcgtgggatgggcccaggtgcttccagagcagttaggggccctccttatgttgggcaaaggggacccctttttcaggcctcccacttgcaagcagagcaggtgcctgttcctgaggtcctggtaccagtcttgctgggtcaattacttgcgggcagagctgcagtgggactcacatgcccggaaaacagagccttctggcattcctgggcttcctcccccggccccagggagccctcaggcccagccctggcaggaggggccataatgttgcggggcaggaccccagcactaggcttctggagcaaacacaggtagatggcaccacctggtggctgtgctgccacacagccgtcctggcctgtggttccagagcactgtgtcccactctttggcggcttccgcaccaccaggccacccgctacgggcacatcctagaccaccaaggccccgcccccacccccgccccaggcaccccatgccagagacagcccaagtcagccctttatggaaacttcagtggctcctgctgaccggggaggatgcaccccagaagctggggttcaaagccctgccatgtgggctttgtaaagccatgccctttctgttccaccagaactacttttgcaaccatggagaagttccatcccacgtctgggcctcaacttccacctgcagagtggggcccttacctctgcctgagcgaagttcaccagggccttccctgcactgtcctgctgggcgtggaacagccttgtgcaggagtttggggagccaagccatggccttcacttgctgggtgaaggtgggaaacttaacagcttccgccctgatgcctgcccttaagggcttgtaagtgattctgtcagatgttctggtccttagccacagaagaaggaacagcagagccacccgtggccgctcagaagtctgcctaccatacttgcaaacatccaataaaaaaacttcccacctgtgttctatttcagcacaatctcacttctctccttccaacaaccccgtgaggcatgtggcagcgtccccattttgcagaggaggaaactgaggatcagagctgggggagctctgagccgcgaagtaggggacgctggcctctttctcgaagcagacatgggggtgttcccagggatgctctcacctgcaggcctgtgtttgtagtgaggatggggggttggtcattgacaggcaggacagtgacagtgaaggccacaggatggctctggcgatccatctcggaggcattagccatcaggacaaaactgtctgtcagtgtctcgctcccgtcatgcacgtagcggatcagctgctcttccacctaggggcaggcccagggctggcagtcaggccccagcagcacccttcatgccctgcctttgggtgcaggaggagactgactcttttagggcttcattttccattggtagaaaatggggaccataagttctggctccgaggagttgtgaggaagaaaagatatatggtatttaaagcataggtgcttctgaaatgtgactccccgtctcctctctgtgtataacccccagactgggagtccccagggctccctccactctgcccccagagctgggctgcagcccctgggcctctctcacagccataccattctccaggagaaggcgctgagggtcctggcttgaggtccgtcctccttctgcagggctccatgctggggtggctccagcacctgcaggctgaggcccaggagagtggggaagtagggcccggagacacggagcagtggaggggccagggtgaggctgccaccctcagggacgctgaagttttgcgcctctagtgggatggcagcgggcagcacctccagctccacaaggacgccctcgaggggagcacccaggcctgaggccacatccagcgagaaggcatcgctccaggcctcagggcgggagtgcaggtacaggaccctgcctgtgtccactgcctcctgggagaagctctgcacagggtccaggctgggtggctcatctgccaaggcgccacgcgacaccatcaccaggtagccggcactcggtgggctcttcactgagaatacgatgtctgcaggtggcactgcctcctgggctgcctggttaacagaggtcacaaggactcacagggggccacagagggggtctcagaggggtccactgtggccctaagaagccggaacaggcttgatcttgccccacttattcctctagataccactgctcatttagacacacaaacacacacgtgggttcacacacacagcagccagacatgcagctggtcacattttttgttttttgagacagggtctcactctgtcacccaggctggagtgcagtggtacaatcacagttccttgaagcctcaacttcccaggctcaagggatcctcctacctcagcctcccaagtagctgggaccacaggcatgtgccaccaggcccggctaatttttaaattttttgtgtagagatggggtttcactgggttgccccggctgctggtcacatgttaatgcccaccccacacacggttgcagggggtcggtcacacagcttgagatgcactccctcagggaggtgcataatcacatgtccccagactcagtgacacagacacacgagttcatcatatgctgacgcagtcacacatgtacacatgcgtgtgtgcacacacacacacacaggcccccctgctcaggatccgttcaggcctgtggctggtttgcaggcagcacctccccagcccctgctattaccacccaggaccatcagagggcgccccgccccacccctcctggaggcacagccgccttcagctcaggccctacagagctcacgccccaaaggccacacgggctccctcacctgatgggccagccacaagaggccaaaccaccccccaaactcacattcctgttctatgcatttgcccggaatgttccttctgcctggaataccactccccattctctgctcctgatggcctgtgctcttcagagcccggcccaaacgctgcctcctcccgcgaggccttcctgactccagatctgctggcttgctgtcggccccaagctccagacatgcagaccagaagggtctccgaaatgagcagtgtaggagagtaaggccaagagcgggcaaggactggcctgaggtcacagggcaagtcagtgagcctgctggagggcccgtggttgctctgtggggttcctgggtgggcagaagccacccaggtctgggctctgagaaaagagtgggggacatgagggtctgaggagtagcggcctgtctccacggtcagcaatccccaaagctcaggacccgtgatgtcctcccagggaactgactgcaatggagattctcgggctccacgtcagagattctgtagggctgggtggggtccaggaatctgcatgctcagccatgtcatacacatgagtggacacaacctctggaggcgcacacaactcccaggaggatgggtgtatagcaagctccccagaaactcctgggagcacaacatatacgggagcacatctgaggcacgtgcacacatgtaacctggagccaccacagccacagcccaagtcacgtgtgttcctggcatggaggctgggagaaggccctctacctggcccacacccctgctcaccacctccaactcctcacctccagctggtcccttctgatctcagctgcctctccctggaagacgtagatcttcttgtgccggaccagcttcagtggggccagtgggccctctagggcaatggtcacttgtagggtggcatccgtgtgcactggccctgcttccacggagaaggccatggtgtcgcgggggctgaggctgccattgtggctatagagaacggccccatccagcaggtcctgctgggagaaggctgtggctggctgaccagcccggactagctgtccccagcgagggccagctgtgacgtggtagtggacctcatccccactgcggatgtcgaggttggtgtccaggtggagcacggccgtgtcgatggtgccctggcctccttgagggaccacaaggctggagccgttggccacacggaggtagggttccgaggcctgcacctccagcagcgcagtggcctggtgttgcccgtcggacacctgcagctggatccagccacggtcagcccctgagtgcacgaacagtactcgcctcttcctgaggtcctcctgggtgaagcggtagatgggccgcgtgggctcatctacggccacgatactgccaaagaggaggtccttgcgggtaagcaccagctgggcgtcagcaaagcccgagtcagcatcgctgaaggccacgtcgtctgtagtcagcagccgccgcccaccccgggccacatggaagatccggctgatggtctgcacaggggcgtggtcattcacgggctggatggccactcggaagacaccccgtacctcctcccaggccatgtcaccactgctctcgccctggcgggtagcaacaaatgggatatcatcttctgtggtctcggagtcatcatgctggtagaccagccggccacgcaacaggtcttcattggtgaaggatgtcaccatagtggtcttgtcctgtgtcccacgccaagccaacctcccatggcggggccgctccatgacctcatagaggtagctggcactgttgagactcttgacaaagaggtggtcagcagagaggacaccctcaccaccctcaggcaccacgaggaggacattggtgaggacaggcgcatctgggtcaccaccaatgtggatggggaaggtatagagtggggagaaatatggtggagctgtgacacggaaacggaaggtgtcctcgactgcctctgaggcacgtgctgtggccccataggtcacccggccagcctgtatgtcatcctgggtgaagccctggccatctgacagccttgtgccctgtagttgaaggttgcctttcctgggagcctgaaccacctcataatggaaggttggggggcttgggcctgcctcctccagggtggcctccaggtgggctgtggtgagggtctcctgctgggtgttctgagtgtgcagtggctccagccgcagcatccacacagtggctctctggatggtcactgggaaggacagattgctcaggatctcctggcccacctgcacctccagggccaggttctccacggtgtcgtaagcgtggtgctgtgggtcagtgctcaggtacctcacgcggccctgctccacatcccgctggtggaacgcctgtgtggcccaccactcagcaccctccaccccacctgccccctgcttctgcagctccccaaactgcagggccccagtgacgcggaacagcacgctcacatcctgccccacggcattggtctccaccgacaggttggcgggcaagatgggcatggcagagccttgggccagtcgcaaccctgtgctgcggtggatctgtatggccggccggatggccaccaccttcagcgtggccggggggctggcctgcagtccatcgctgacccggaacgtcaagtcctgtgcaggaccaccgcggtggacatagactaggctgccggcctccaactcccggcaggagaactcggtcgccggctccccaggctggtctcggcgctccacggggaggccagaggaggtgccaaggacctggaaggtgaggccctcacaggcagagtccgggtcataggcctggaaaacctcaggccccagcggcttctgcgtgtgttccaggatcaccatgaggctgccatgtgggaagatgatgtggggtgggtcattgacagggttgacctggatgggcaggaggtatgtttggcccctccgaaggcatgagggcatgggcacccgagccgtcaccgacacctccagcaccagctggtcggaggtgtcctcagagccatcgtggatgaagcgggccttgcggttcaccacgtccaggagggtgaacatttttcgtgcctgggctcccgggatgtccagctcgagctcgccatggcgtgcccctcgggtcacgctgaacagcacctgggatttgcgcagctcagcctccatcaggtccagcgtgggctgcacatgcctccactcaagccaggctgtgcccccctcggccaccaccagtgggctgatagtcagcagctgggtgaaattggcaaagacaggaggcagccctggctcaggcacgcatggctcaggcagctccatggctggccaagcctcaggggccagggtggagaaagcttcataatgtccataggcatcgtcctcatactcctcctcctccagcctgcagccggctgccatgttgcgcgtcagcaaagcttcccgcagcccccgcctctggccattgacactgaggtcttccatgcagcccagcagggaggcattggtggcctctggtgtcaggcccaggcggtgttcctggaggtgacgagaggcctctgcatccagccccccgagaaggagactgccccgtggctccaggtagctgaggactcctcggttcgaagtatgcgtagggtactggtccacggagatttccagccggtgagcattgatgtggacactgacctcatggggctgcccatcggccacaggcacactgttgtggagcaatacggtaccctggcccttctccaccacggcccgcaggtggccctcaaatatgtccacatagatgaagtccccacgccggccccctgcctggaaggccaagggtgcctgccggctctgtgtggtgagtgtaaactctagggttccttcgtcctgagtgccccaggcagggaaggcagccagagagtggggcccagagaagcccagggccacatcatcactggcagaaaactcttcagcacagccctcatgcacatcgggggtcagaggccggaggaggctgcggccattgagggtggctgcatggaggcaacccctcaggggtcggctggttcccctcaggtagggcaggccaagggtcccagtgcccccaacaaagagcccataggggacctctaggggggctcctgggactgctgaggaggcgttcagaaacccatcgactgacaacgtggcccagccctctacgacagtcagcaccacagtgtgggggatggagtcactcagcagcgtctctgctggagtctgcagcctcagctcctcctggcccagaacaagtctgacctgaagagagatggggagtgggagatagtggacagcactttggatccatcatttcccttataaaagcatagagccgggcgtgattgcagtggtggctcatgcctgtaatcctagcactttgggaggccaaggcaggcggatcacctgaggttaggagtttgagaccagcctggccaacatggagaaaccctgtctctactaaaaacacaaaattagctgggcatggtggcgcatgcctgtaatcccagctactttggaggctgtggcaggagaattgcttgaactcgggaggtggaggttgcagtgagctgagatcatgccattgcactccagcctgggcagcaagagcgaaactctgtctcaaaaaacaaacaaaaaaaaagcatagtgagttccccacacttggggccccagagtggaaaacctaggacaagagcctctggtgccactcctcttgccgtcctgccatctctttattcatcctccaaacactcaccaaaggaaactctgggccagggctggatgggctctggggaccctgatatgaatcagatgtggtcctcgcccacaaggaactgacatacagcaagatgctctcctagaaatccaacctgtgtttttaaattcttcccctctttccttgagtgagaggtgccagaaatattgtcttggaatctggatttcaactttggaataatgggtaactgggaatcccttgatcagtccccttcaacagagcaaagtttcttggggtcattgaaggcagccaggctcactgttcaggaataggctaatttttaaattaaaatttaaatactctgtgttctgaaaaaaagctccctgacctggggtggaaggagatcttggggagagatgaaggacatagttctgtctccatgacattgacagcagaaatggctctggtacggtgctcccagatggtagaatgggaggtggcagagtatggtaactgcagaaccagggcactaagaactataattttggagtcctggtatggagcatctctgtaggggtgtggcatcattgtacctacagaactggacagccatcagcaccagcctgcaccacgctggtgtttaacagtgaaagcagcagactgaccaagccctagtcctctccccatggggtgtggaaggagatggctgccccaaatttgtttttttttgagacggagtttggttcttgttgcccaggctgaagtgcaatggtgcggtctcggctcactgcaacctccttctcctgggttcaagtgattctcttgcctcagcctcctgagtagctgggattacaggcatgtgtcaccatgcccggctaatttttttgtatttttattagagacacggtttcaccatgttggccaggctggtctcgaactcctgacctcaggtgatccacccgcctcagcctcccaaagtgctgggattacaggcatgagccaccgcgtccggttatttttttcttttaaaaatagagatggggactcattgtgtggcttaggccagacttgaactcctaggctcgagtgatcttctcaccttggcctcccaaagtggtgggattataggcatgagccactgcacccagcctggcacaaattcggaataagaccctgggttcttaaactcttcatggtttaggggaagactcaaaaaagccacaagactccttgctaacaaagcttgtggtgtcttgaaggatgaaatggaaaaatgaggaagctgaggcagtactggtgctgttactgtcgtggacagaccatggtgctgcagagaaattggtgcagtgccaccgggatgcacaggggtcatgggggctcaggagggggcctagcccaggaggaggggatgcccacactgagacttcaaggagaggctggagttaggcatgtgcagggaacgggagaggcgcacacctggcagaaggagtgtgcatcaagagcctggcagcaagcgactgtaagatggccaggaactgaaagcagttcagggctgtcagagcacaaagggccagcgaggggttgtggcgggaaacatggttggagggagccagtgggcagagccagttcatgaaggatttaccatttctgggctgctgctgcccatcccacagtggagaacttaagaccccaagataaaagtgacttacacaaggtcacacagccagctggggttcactcaaagctagagaaggaatcccaccccgaatcccgcccagatctcagggggacgtcactcacctgcaggcgtccagagtagagctgcagcaggaggtggtcagctgggcctgctgccaggagaaggagggcttcgggctgggacgtggagaactgcagctgcaggtctatgtcggtcagagccgtggccacaggcacctccaggtggttctcaccgaagaaggaagctgtgtgagagagggagctgtggtcaaggctcagactcttgcctggaggaggcgaggtgccgcaaagagggacgggtgggttgcagaaaggggtccgtgctggcgcaccctcatggttctgctgtatggtgctgcctctgagcactgcccgggtcccagcatcttcttggtcctggcaccagaaggcacaggctcaccttgtgtccagcccagatcttgtatttacaggaggtcagacccagaaattcccagcaactcaggtctcctccttggaggttcctggagccagaggcctccgccagctctgactcgcctcccctgggccccagaggagtctccctcgtgggtctggctcctggacccagcccaaagggaaccgcaactggcctgaccatctggcttggtggtcacagccccaaggaatggagtttctggagaatcacccccagtccagactgatccctgctcagattccttctcctaagtgcccttgtgcttgggctcctgtgcagcgcctgctgtgccatgccccgcctccatgggttggctgaggccacgactgggatctgggggtggtgtcagcatggcccacctatccccgcttctctctcaggccattcttccagctgccattgagcgtcggggcaggagcttattggcctgagtctgccaaggagcaaaggctctgaggccagatggggaccatgtgcagtgtcaaaccaaagtgggcccacacttcctccattacccttgctattgcttcctgctggagagctattcacagtccccgatgagcagtcagatccggccccattgtttccaccgtggccaaggaaccagggatgagaacagctgagttcctaacttccccaggccaccacgcaggctgaggctgaagacagggcttgggaggggctgagggtctgctgggcaggccaaagagggcctccccaggcagaaggccatgtctgggcttgcctggggttagtggttcctatgcagggcccgttctgtcccatactgggactcctcctcttttgaattgctgcttcctccagtcagtttccccagattagcctccctgacttccaacccgctgccacaatttctggtccatgccttttgtggtgataagagccaaatataactttgactttgcctgcagatgtccagggctggggggtagagaaacacgggttaaaaacggtgattcattcctgttgggcttccctcaaacccgagagcgagcacaggctgacggccttgatagggataatccggcaccagccccatgtgctggtccctggccagcctgagccagctgccatccgcctgagtaagcagcttcagccgttggaggagtcggagacttgtacaccctaagggcagccagccccactgggagggatgtccaagaaagatcccgtaagaaccccttgggctgagttaaatcccctctagttatctcctcctgccagcactgctggcaataccagcaccttgtctgggaagctacgggaatcaagggagccctgcagaccatctgcgcgggggcggcccagctggttcagcagagcttggcgccagcaagggacagaccagggaactgcaggtggcggccacctaccggggtgccttatctgcaaagacattgattcctaagagcaaaacacagcacactaaagtgagggaggccatagcacaaggggtgggggcacatggccctgcaggatagagccaccaccgtcacctgctggagcggctgacagcagctgccaggagtctactgttgaattttcaggaattttgagagccaggtgatactgcccacagtgagaacatttataccaggaaaagaggcaaatactgcaaatcagggttccccctccccaagaaagcccattgctaaacatttacctatccagcacccacagagaagggggcacatgtccctgcccctacccacccttgcactaaaggtatatgtagacccgccaagtcatggtcaacatcagggctctgggccaggcaggaactgaactagatggttggccctaaccactgaaccacctgcctgcagccccctcccagcagaggagagtagagcctgtttggccagagtgggagggtggcaggaagtagaggtactttccagagcgctggggtctgaatgggtccattgaggggctgggccctgctgcttcctgtggggctgagcgggaggggctcacacaggctgtcttgtgctgctggagcgcgtggccaggcagccccccaccccaacagaggcctctgaggccttgctggccagggctctggaaactctgacagcgccactccctccacctcctggtctccttttttctgcccctcttacactctctgaggggcttcagttgcaagaactcagaatccctgtcttggaggtggtgggggggcagttgaagaggggcttcaaatggagagggtgtgcagaattaagatgtaataagctaggagtcaatccagaggacttcctggaggaggtcacggtggtgtacagacacagagagggaggaataggcagtctcagaggacagcagcaaggccgagtgagactggcaggaagtacacaggtcccctttgggtggggctaggagggtttctgctccatcacccgctaaagcctctggctaacttgaaggaagagaagtagagggaaaagtagaatgggtcaagctaggctcggctgcgtgactggggcggggggatggaggaggttgtggggagacattggcacaggctggatcagacctgccgttgattctcctgggtcaagaggacccatgattcatcaaaacagcagaccaaacctgtagcagccccatgggctgccctctgagccaggagaaggggcccacttcaggcctcagtgtcaccattctgtaaaatgggcacagtccctcccaccccttccccctcctgactgtggggattagtcctgggggtctctccctgatctaggagtttgctgtccatatggatgtggggaaggttaatggcatggggtgcctggaggtgccaagccttgggcatgagaggagcaggatgccccacaggtctgggggcccgtgggaggggcaggaagagtgctgcgtgtatgggtttctctctctggaaggcgcgtcagtgggcgtccagggctgtatattaatagatgtgtatttgtgtgtgcgcaagcatgtgggtggctgctgggggtgtgctttgggtttgcgtaaggctgtgtgtttgtgtgtgtgtgcgcgtgtgtgggccgggagctgccaggacagagcaatgattgtgcccgggcctgtcctgcccttcggtgcccgcctgccattacttggctgggcctggctccatgaaaggggctgtgtgttcttggagggttcctgcccctcctgctcagcgcccatagagaggtttgctaaaggtgggtacatcctcaggcttcccacccttcctccccataaacagggcactgctgtctgggcctgagggtggggtggctccatccttcttcctgagatctaggcctgggggcacagaaaaagcctgtttccttccctgccaagtcccttctcaggggctagaggaaacctcggtcaaggtccccagcaagccccctctgtcagggcaagggctgcgctggcatctccgggctccccggaggcactactaggaggagtgtggatgggcccctgaggcttccagcctgacacccagccctctgtctgacaccaggctccggggacaaggagtcgctgtgaggggaacatctctgcccatcaggcccgcctcccccggccagggccccaccttccccagccaggccagggccgggtctcaggcacagatgcctcttccaggctgagggctgctgtgggctctgttccttctgagtcctcagaaggctgcctgtgtccctgtatctgccccatctctccttcgcctccggccatccctgctgccaggctctgcctctgctccccctggtctccccctagctctttggctccctcttccctctgccccatcctggctgtccctgggcacatcaccctttgctctaggacagtctggagggccccggcctggggccccaccctccatgggtgctgagtcccacagcatcagcattctctgtagctcaagcctgctgcagggcactcagcttccaccttccagacagacaaactgaggctccagaggagaagcgatttgacgaagagaagcagaaagagatccagcaggtcccagcaccacccgtgtgagccctacccacccaggcacccccactgtaccccactctctggcaatggatccctgtgtgccccactcccgccatgttcctggttgcctgggggcagccccacagccaggctgcgtcatgggagcagcagcattcctgggtgtctgctgctgcctgactttataagggagaaattctgggagcccggagctgctggcccgtggggagtgcctgggcccgtagttgagggtgagggcaggagacctggacatctgtatgtgggggagggacacccagtgccacagagacagagcaggaggtgagaggtggaatgcgtaatagagacccattcattcattcactcaatcacaaatacagcaatacagtgatgggaatggaagaagacagctaacatgggagaaagttattaaaactgagaaggagaaatcaagatgccctcctccataaagactggattcacatacagaccaaggcctgaggaaggagacggaggaggaaaactcgagggagacagagaaggcgggatgttggcagcaagcctgctgctgtgcacaggagtgaggaggggatgcccagccagcctgctggggagggagggccctgctccaagacgaagccagacttctccatcaccgcccctcggggtttggcaccacggcgggagatcctggctccaggtctgggcaggcaggggtgagggagtctgagggggctgtgggatggggtattctgggagggccaaggccgggatgaagggctctctgtctcccctcataggtgtgtatgtggtggggcggggggtggtcgtggcccacctgggggctgaatgccggctctgtgagagcatggacgggccaggtgtgcttccccagcagcggaccctccctgaggtcacctggccctctagacctcaggtcagttcccctcccctccccttgcacctccaagggactccccgattttacttccgccaccaatctacttccaaccaagcaggcagggcatgggtgagtgtgtgcaggaatgtgggtcagtgtcacatgtacacacgtgtgtggcggcaaggcaggcgaggaaggggtgcgctgggtccctggtctggccccactgtgggccctggataccgagacataactgggggtcccctccccagcacattggtctccctgggctcctcaggcaagggagaagctgtctggtgtgcctactcaggggtgagcccctctcaaacctcctcccagcagactccccaaggctcagccacccacactgagctatcaccttcacccaaccctgttactctgagggtaacaagggggtaggttacaggggagacttaaggtcagactaaggggagcgacctgcccagtgatgacactggggtcaccagggcccaggcctagaaggctcatcactggccagggtgggctgcctgggagacgctcacacacctgcagacccctcagggctcactgctctttagcaactcttcctggctgcttccagactgggattccaccacccagggccatccccgcggcccaaggactgcctgctcctctcctgtcccgtgagctaccgaaatgcggacaacagtaggttagttccaaatcccatggagcttacaacagcagccatcatctcaggagacactgctttatcccagtggggtgctggagtgctaggcacctgctcaggtgactgcctccacgtctaaatgctgcagagacctctgtcggggtcagggcagcaccaaaaactcttgagccaagagacacacactcaggtcagctgaccttctgtttagttgcctttctggtcccttgcaaggccaagggggccagggaggaaaacagtttcctcagctattggctgggccctgaccctggtcactggcctcagctaccatcctctaaccaagcgctttgagtcacccacgtagaggggcatgtgctggggaacatttccagttgagggaacccgtctggaagatgagtggaagcaggggcaggtggggtgggagaagctgagcttggtccacagaggctgataggggctgcaccctgggctcccagccacatgtcccaaccctggggccttgtggagcacagaggaagcaggaggggaaatgagaggttttgagggaagaagcagcccagagtccacccaggcgggagggctgggccgggggaggaggaagcggggcctcaatggtgtctttgtggaagtcttgctgctccccaggcctcaggcgaggagggtggggtggctgcggtggggagcggttccaagaggcttttccctgccttataatcttccctcttggacagggagatgggtgggtttccaggctccatccgtaccctcctttcccccactttcctggccctagaggacctgggaccctcacctcagtggacccaggctggggtagggtttctggcagggaagagaagagtgaaggaccctcacttggcactgggcctgcacagccccccagccctagcagggctcctgggaggcatctcccatgttacaggtgaggaaactgaggctcagagagggcagtcctccgtgctagcctgtggagcagcggcagggctgggacttaagctcctgtgggtgtggctccagagctaggggctgtgggtgtcagcagggcacatgcaccgtgtgtgcacccagagaggcgtggtgggtttgcttgctgcctgtgaatcggaagtggagcatctgccaatggccccagtgggaggagggtgtgagagctggaccccagcctggggaacacacactctttcccttcctgtcccctgggactcttctgtcagggccgggtggagggggcagcgaggagggggggacagcgaggaggggagggaagcatctgctctccttgggcggtttggcagcccctcctctgtggctctggggctggccgaatcgggagggcccttctgcaggggctggcgggggatgactaggtccagaagccagtgataagtgccagccctgcccactggtgacttggaggtctgggaggagggtggagagacaggggtctgggtgggagctgcccccaggaggctgagggccaggctctctcctgggctgtgtccaggaccaggcagcccatggctcatctctgagttccccttggctctggcagcagaaactgctgaagacagggctgctggggcggcgtctcggggcttccccagcctggcgggctgggtctggagatagtgagtgtgtgagttgggatgggggaagaacagaggaaatggtgactgtgggtctggacggctgcctggacctgaaatctggtggcacaacttgtgcacagtagccttgtgtgcctcctcctcagttcccccatctgaatacagagggtgggctcaccccacagacagaagtccatgtccagggcagaagcctgggtcagggctcacacccccagcacacacacagggctcagagccatgtgcttccatgctttccctggcctcagtgtccccatctgtaaaaggggacctggatagagggactgacacacatctggcctctgaccagcccagcagactggcaagaggtgtggccactaccgtgggtacagtagagccacctctggcctaaatggccacaggtctagccagactggaagctcttgaggacaggaccagggcccacatctccttcccagggcatctgtgcagcaagaaggccatggacctgtgatgagggaggtgatgtcagcatctaagggaacgaaaggatcaaatgagatggcatttgtcccgtgtgagggtttttctatcaggcagagctgtcccaccacagcaagtcccagcactggtggtgctccagtgggagggcgttgccggggggtgcaccaggaaacctcagtgtccttgctagtgaagctctgggctacccaggcccatcagagatcccgagactgagacctctcttcctgggcaggcctgactcctcctggaataggttcctgcctagcacccccacctgccaactgcctggaagcctgcagcctgtgggccccccctggagctgtgcccaccgccaccacactccctctggccctccttttctctcccggcctcaggcccagcctctgctaatgcaccacgtctctctcactggcaccaactctccagggctccaggcccactgccagtgtccctcagatgtccatggcaggaacacccacaggaacccccaagcccaaccccacccaaagcaaggaggactcagtgtactctcccctacagctggctcgccagccccgtgaaggcccgactgtccacctgttgctgagtagacatctgagggtcgcactgaactctcctcctcctccctccccacagccactgctgattaatactcaggttccatccatccagtccccaaattctccttcaacttcatcttcctctcttgctccctggtccatccataaggcggctggccaccgtcctcggtctggcttaatcaatctcctgactccctttgctaatagcagccccagttaacccaaactgaaagccactccctcagcctcccttgcctttggtggctcccattgccccagggtcaggcccccacccccgggtggcactgaaggccagggtgccctcaactctgcctgcagggtctcttgctctcttccaaggacactccacgcctccgtctcactagactctgcactgactccgtgcacacctagcagggccgacctgctgccttcgctcaggctgggcctgctgctgggccagctcttctctcctgtccacctgtgaaatgtcctcatgctctttcaggaaaaaagcccaaagcaccttctgtgtccttggggtgcaaagacactcgctgcggcccagggggctgtgctgttgtcacctctctccatttacactgtgagccttggggacaagactgaccttgcttggggacaggacgtgggaggaaaggagggaggggcccaccagggcatgagggccatgggcccagtgggaggggctgcctctgggagctcgccccagccctccccaccttgtcttacctccagtctcctttccaggcctcctctgccctccagagccccagggctcagaggcaggggactggacactatggcctgggagggctcgagggactgccagagccagagactgcttttctgggcctgtggtgacagagtctggtgcttgtttttaaagaaaatagaatccgagcccctatttatagccggaggccacagccacagacagaagacggatggggtttgaggcttacaggcccctgctctagcatggactgggaggtggggccattcccaggcccccctgcccgcctttgtcaacccccaaggaagtgcctgtgggatcctgacactccctgggacaggatgtagcctgcactttggggcacgggaggacctggtgaggggagcggaacatttctcaggattggtccctggggcccagagtcccttgtgggaatgggaggaggtgagggtctgttatgtctactgagaaggcagagagggccctggggacgggtggggtgctggcggcagggagcacttctgactgccgtggaacccggtaaaggagaagggaaggagaacagagcaggactggagagatgggcagacagacagagagacagggtaggaaagacagacagaaagagatggaggaaccacagccaggggtgggaaaggacagagagatggagagagcgggatggggggatggactgagagatcgggggtgctctgcagcccgggtgaccctgcgcaggggcagacagaagccgtgaggggagactgaagtgtggcttccgtcccatagagtcttcatggtgctccaggcagcgtggtcagagtccgggtggagccggtgaggagggaggaagcaggcgtctctgtggcctcgcccacccccagcctccagggtctaggggctggagaccctccgttcccggcagtctccacggggaaggcccaggcctgttggaggcaacgcaatgcggtggggcagagcccagattgaccttgtcaccaagatccccaagggctgtcttgggcacggccgggaccttgagggacaggtctggtctctggcttgttatggagtgagttccctaggcctggagggctcacaagctaaggctatggcctggactcacacctgctgccagcctctacgcagacccctcccttggctgcgcttgtaggggctgtggggtaaccgtagcctggggcatgtgtcatggagccacaagcagtgactcagacagttaaaaaaggagcagctctgagtggtgactcaattggctctggaggggctgggtgggtctggctggtacaagatggggtggtctgggtttatttttggcagggcggggctggggccagggggtggaagatgggagccgggggtggagaggagccgctgctctcatcccggggggagccccagggctccatgccaacttaggaaagtggctttccaatgccagggagtcctggcaggctgggctgcttctcagccccattccaggcctagcctgccttgctgcttggcccaggacaagcagctggctctctctagatagaggcagaggcccctgtcctgttcccaagaggctcaagctcagaatttagagctgacctaggagactgaagattccacccagaggcccagatagggccaggggtctccccaaggccacatagcagggccaggtagcccaagggctgtggcaccatcagccagctggctcaggcctctacaatatctcgctggccccagggctgtccacggttggagggacagcccccgtctgagtacccacccctggaggggctcagccaggctccagatgggtggccagaagcacacgggccccagatgcccagagatggaaccttggccaggggcagccacctggattccattaaaacatgtgggtggggggcctggccgggccctgtccaggggtctgtggagaagagtcacctctacgtgggtgaaggcagtgggggcctgcacaatgggatcttgccctgagggctcaggcacaggcctgcccttgtccggggtccctccagtgtccctgccccgagctgtgcaccccactctgcagtcacctcagtcacctccccacacctccccctactctgagctcacatacacccataccactgaggggtcctagcagcccagagcggagagggctgtcccctccctcagtccggatttctgctcctcgtgatgcagccaccactgcttatatcatgagtggtggtaacagccccatggtgactctggcaggtgagctgtcccacgtccctgggccctggcctccagcccccacctccagagagggactcgcgaggggttggtagagagcagggaaaagacaggcttctagggtccccgtcccataaaaggtcttggggcctgctcattctcttctcctcactcacctgctctggggacagggggttcctgctgtgccccggcccagtgagccccatcctaggggctgttaggcttgggagaaacaggccctggggagggccaggcaggggctgtccccacttcttctagcactgagagaggggtgtgggcctcagcccagttagccacagagatgcagacccccaccccctcccaccttctgaagggtcctgggctggcaggcagccgctggctgataccctctccagagcccacctctccttttccatgtcacttagtcccacacagactcacggggccacctcctctaggcctttgcctcggaatcttccttaaacactcctaagcagaagtccccatgttgccgggccactccaccctgggaagaagatgctaatagcagagtgactgcagcttcaggagcagatgtccaccgagcattgattccaggcaaagtgtcttgcttaatccttacaacacgtaagaggttggaattatttatccccattttagagaggagaaaactgaggctcagaaagacagagtcacttgcccaaggtcatgcatagagcgtcagggctggaattcaacctgagctctctaatgccgtgtttcaccaccatgtgcctggcctcctgcttccctgtgtgggttcccacagctcaggactcagaggagggagagatggggcctgggtcagggctgaggggcaggggaggggctccctctcagctgctcgcagactcccaaaaagggtgatttgctcctccttgaccagggtgggaagtaaaagtgtgtgtgtgtatctgtgtctgtatgtgtctgtgtgcatatgtgtgtgtctgtgcctgtgtgtatatgtctgtgtgcgtgtgtgtgtgcgtatgtgtgtctgtgtgcatgtgtctgtgtctgtatgtctgtgtgtatctatgtctgtgtgtgcctgtgtgcgtatgtctgtgtctctgtgtgtgtgtggctaggcctcaggcctgcctggctggactctagctgcaggagagctggtctggccccagcaactgtgcacagggaaggggcagggagaagcgggtgtcgtgggaatcagtgtcctggtcccactggtatttatagctgccccttcctgaaatgtgggtgggggaaggggctgctcttaggtgggaacggaagttcgtctcctctccccagccccctctgtctccccagagagtggactggcccaggccagagggcctgccctggcgggggaacgaggcactgtgtcctgattttgggggttttccctggggctgctggctcggggcaggacactctccttgcctactgagcaatactgcgtgtgtgtgagtgtgtatgtgtgagtgtatgtatgtgtgtgtgaatgtgtatgtgtgtgtgtgagtgtgtgtgtgcacacacacgcatgtgcacttactgggtgtcaggctgaagaaggtcatgaaccggggacagaggccaggtgagggtaggggaagaaaggcctgtaaccccacagagatggagggcagggccccaggagaggggccatccaggtcatgggtctcagagcaatctgtggttagaacaggctcctgggggtggcgatactggagctgagccttggaggatgggggaaaagggaaggcctgttgcatggagcagcttgagtagaagtggaaaggtgccagcggttgtggattattatctgatggcctagttctatctgatcagccagtccgtgggacacaggatcaccttgaccagggaggatgatatatttggggagagaaggacatagcacagcacagttgagcatccctaatctgaaaattcaaaatccaaatgcccctaaatccaaaattttttgagtgccaataggataccaccagtggaaaatctcacacataagaactttttttttttttttttttagatgaaccctcactgactctgtcacccaggctggagtgcagtgacgcgatcttagctcactgcaacatctgcctcccaggttcaagcgattctcatgcctcagtatcctgagtagctgggattacaggtgtcgccagcacgcccagctaatttttgtatttttagtagagacagggtttcaccatgttggccaggctggtctcgaactcctgagctcaggtgacctgcctgcctcagcctcccaaagtgctgggattacaggcgtgagccaccgcgcctggcctccacacataagaacttaacataaatttctctcaggcacaaaatttctttaaaaaaatctataatgttaccttcagcctatgtgtataaggtgtatatgaaacataaatcaatttcatgtttagacttgggtcccatcttcaaaatatctcactatatataacaaatattccaaaagccaaaaaattccaaaatctgaaacacttcaggtccccaacatttcagataagggacactcagccagtgtggagtgagggccagcaggcagtgggcaggagtgggaagctggggcaggagaggccacacagccccaggcctgctgtgaggaagctgggaccaccttctgctcccggcctccaggctcccagacttggggaaggacatcttccaagggcccttagtaccaatcttcatggaacccaatctataaacaggtttgtggagtggctctgcatgaattggggtggggcaggcgtcccatattcccaagctcagctgcctccaggccggctcagctggagagccctggggtgcgctggagtgcagtcagaaaatccctggttggctcagtgatctctacacccctctgggggccaggctgtgagccctacaatgggggagacccctgagcaaagcaggtgggatgtgtgctcccggggagctgctggtcctgagggtgaagctaccccccaaaccagggccaaagagtagggagccctccccctaatctcctgaggactcactgtgtgactctgaacaagcaggctcctctgtctgagcccgggtttccccaggatccatggggggctggtctggggtcaggggtttctgcagtaagttccgggaagggaggcagcgtcactgacacacctcaaccttaggccgcaggagagccacacactgaagtgttgaagcaggagcgatggctggaggcctggctaacgcatgcatgccagggctggcagagccagcggcctcctccacaggctgggagccggcctgggtgtgggaaggagctgagcgagaggcaggaatgctcaacaggacaggcactgtccctgatggggcccacccctgccaccaggccaccttgacagcagccctacagctatcaccctacatcagagacaaaagtggcttcattggcaaccctagctttggggggagagggttttttgaaggggatttgcttaggctgtgagaaagtggggagggtttggaaagggagagaacgctggctggtgggggatggggagacagaacaaacatctggagtcctcagcgagctgtctgtccctgcagacctctctctttcccctgctggggcctgagcccactggtgggtggttgtccacctggcctgatgtggggaaactcgctgctgttggggtgagtgagaacaccacggcctgtgtgcccaaagagagacctgaggcagtccctgcttttctctgagcctcagtttcctcatctgtaaaataggactgttggacaggtatggtggttcacacctgtaatcccagcactttgggagtcccaggtgggaggcttgcttgagcccaggagttcgagaccagcctgggcaacatagtgagacctcgtctctacaaaaaataattaccctggtgtggtggcacatgcttgaagtcccagctactcaggaggctgaggtggggagatcgcttgagcctgggaggttgaggctgcagtgactgtttcctgacctgcagggctgctgtggggctgcaggactaacaacatggttagtgcacactatggggtgtccctgaaggtaagagcacagcaataagacagctctgtcctctcctgtttggagttacggaccctcctgagaagcggagagagctaggaacccttgccccacggaggagccaagtacaaaattgttcatacaaattcagttcattcaaaaattcctcatacaaactcagtaggaatggtaatacagtaaatctgaaacctgccctaagcctgcagctggaggaagagccttaactctggaaggctctattgaactgacatatgctggggcggagggcatgttggaggcaagaggagagctggatggggcgggagtcagggggaaaggcagtgaaggagcagagggaccagggagggaccaggcctcagtcccatgcccacaggccccttgttcatttgcccctggccttgaatagaagacacacctcaggtggcacccctgtccccatcctgtgctcacttccttccccgcaagtgccactggcccagatctttaaggtaggggacttggagacagaggcagtagccacctcgtccaggtctgtgagagtggccgtgtgcaagtgtgtgtgcccacatctgtgtgcgccagtaagtgcggacgtcaaggctatttccaactccccctcccctgcccgcccctcctgggcagcacgcccagttcccagacacagcctatacacttcctctgagagctccacacgcaccctactcccctcctgccgtcatcgacagccgcctggcccacctggcatggcccaccccaggccccccaggcgggcagcactaaaaggcccttcttgtcctgcccgggcgggcaggcgtagggagggaggctccgttacacttgctctagaacagtttttctcgagtccgggtgggctgggccaagggctctggcccctgggccctgccctgctccggaggcctggggtggcacacaaggtgcacacaaggctcagtgcctgtcccgagcaccatcggtccccccaagccatcctcagaggcagcaggatctaccctgcttcaatttcttgtacctggtgtccctgtggccctgctcactaagatacccccatcagttctgagtccccacccaggtaacacacaagccctccctgccaggtactccccaacctgggtcccacttcaacccctcacattctgcctttcagtcagtgatgccagggaagaggtgtgggagccaccacccctgcctgccctgtgctcactgtgaccccccgactagaatgtcacctccttccttctctgcctgtccttccagtatcagctcaaatccaatctcccccaatgcttggctctctgctggggcctcccatacagctcagaaggagctggacaccgcatctgtcacccacactgtctcagtggcccaagcctaggccccgacgcaggctgggagcaccctcgaagcagggctgggggctcttcctgggctgctggggttcttggtggaactcagagtacttttcttcctctctggggcctcagtttccctctctatacaagtggaagattggcccagatggcctctagggtgctgactgccaggccccctgacctggatgcctcaaatgttgatgagtagagggagagcctcccagcacgcctcattcggatacgggaggacgagggcctttgcagccaggggcatccaggaggggtgggagggacgccttcctcaggcaggggctgcccctactgcagaaatcagggcaggcagctggaccaggagtggtgacagagatgggttgctggacgggagctctcacagcccctcctcatttccgagtcctcctaaaggcaggggatggtgtaactttataaaaccccacagcaccatgctgctctcttgccctaaaacccttgtggcatctcctttgccaacagggcataaggccgtgggcttcattttgccatttaaggcttctgtgccccagcccagtggttctccctggcctgtgctcgaaatacgcctcccagccaggctgctggccttcctgtctcaacacccctctgcttacgcccaccttggtgcctctgagtcagcgcccctgcctggaggactgactcccttcccatccaccaaggcttggtttgaggcccaccctgtgtcctgccccagcttgcccctgcttttctcccctctgtacttttcatccagatttttgctgtttgagatttaatttgcctttctgcctcctgaatgagtctcagttcagcctctcaatttcccgtgcccctgcgagcctagcaccatgcctgcatgctgtcagggctaagaaggtatttgagaatggctctcagttgaagcccaaggaggtgggggtactggaatccctccttggctggaggctggggcctgaatgagctgaccaccctggtcaccttggatgctcccttcccatctccctggcggcccagcccatccctcaggccctgagatcttaggggatctggtccctgcaggaacagggagcctggagatccagccctgattcaccccgcgggggtcctcccttgactcacttcccttctgggaaccatgtgatgccctcttttagagctggcttctccatctgaaggagagaagggtgtggcctgggcccttgtgaaggaggctcaggccctgcctttgctccatgttgctcttgggaatgatctcgaaggtgtagctgaagcactgaatcacacgtgggtagtgatgatggatgggccctaaggccacagttcttatggcataactagagctgccttcgctgaaggaagaatgctgtcatgttggggtttctggcatcgggacagagaggggatatatcccagcacttctcggaaagcgaacttccattcagcctctgctgggtcaggcatcagtgctgggatgaggaggtgtggcagggggtggtccagagctatctgtaggacaagccccgctgaggggcaccagctctccctctaggaggctgagagtgggtagtgggtggggggtcctgcctgtcaccaacaggaggagggagaggagagaatgaagaggggaggtggcagatagacggatctgcaaggaagcaaggggaggaaagaaggggcagagctggggggcagctggaggggtgtgggggtgctcctcacaggggagggcagggtggctcattcctcgtttcccaccttgtagcactccccattcctggcccagggcatctgaagctggaggacccacttctcactgtcgccgggtccctttggaccccaacatactcaccccaaacttgcctggcaaacaaagctcggccagcattggggtggccccactggtgtctcagacaatccaaacgggcaaagccacgccctaggcaatccatgcctggggcgcctgctcccgcccctaactggacagccttggctagctagaaaccccataacctgagatagcggggtcccgtgtccgccccaggattgaacccctggcgaccccagctagtggtgggagaagcgcagcctgcttgactcccgatctgggggccacttctggctcctcctgtcccttttccctcccggaggaacccctctagttccgccaggctgggtcggggtctcaggcccctcactcacccgcggatgcaagtctggccaacatagtcagggtcaaagccaaggccaggccgggggctggaagtgggggccgcggcccggactgcatcccggcgggctgggcggcaggacttgcgaggagccagcggagtcctgggagctgggagctgagtggagcgagcgcggctctgctcctgggcgcgggccggctccgggtgtccgcgcacttaactccgggggcggggcaggcgcagacccgcgcgcccgctcgggtttcaggcttggactcccccacctgcccccaccctcaaccttcttaaagggcccgtgcggggctgttcctctctggggcaggggtgagggggcccttgcagctgggccagaccccagccccaccctaaagacttagaacaaagtcatagagaggcccagacaccctgaactctggccccaagagccgagcccgggagaccccctcagggaggaggcatgaactgtcccagcccctacttccctcctttctgcctttgcgggagttcaggagacccctccacaggcacactccagccttaggaggaaggacagacaccagccaccctcacaggcggcttttgggctgctttgcctcggaggtcccctaggaacttctccagactccagaggcaccacccgaggtcctgtggggcactgcccatggctgcaacagtgaccttctctgcctggaagggcctcacctcagtctccctgtctgtaagggagagatgtctggatttcctcgcagggcagaagaattctcagtcccgccatgacatttgcctcaaaataaccttgcaaggtgggtgaggagcatcccctcccccatttcatggaggacgaaagtgcagctcaagctgaaagtggctcttacaagactccaggtggaaagtaggtccctggccgtttggtgccagaagcccaggcctcctgacccctgaatccgggtgtttcaacttcccgaggctgcctcctggaaatctggccctggatttggcttctacctaacagcttcaggctggggcccttctgctggctcccttccaggcagcaacatcagcctagtcccaaacaggaggagaaagggcaatgttacttagcttccggtgcctagaggatctgcgtgttctctgtccagtcccaatgttaccgggccttggtttacttcctccattcaggtccctccatctatctgctccagcccatctccagcccaaccccaccttgcaccctcttcccagctcttccctttgaccagtaacagcccagcacttcatactttgcaacgaaactgagacctgttttgcagatgaagaaactgaggctgagagagattaagggactggagctagtctacatagctgctgagatgtggggccaggtctttgaccctaagtgcagtgctcaggtgtgatggtgcctggtccatgtgggggttatgagtattggtcttgaaaccagagagacctgggttcaaatcccagctcccttacttggttgtcaaaccttgaacaagtcccctcacctctctgtggcagtttcctcatttgtaaaattgggttaatgaggattaaatgctttaatgtacctcaagtccctagcccagggcctggcatacggtaggtgctcaataaatgcttatcctttctcctccgtctctgtcatcctgcacattccctgtgattcatggtttacatacagctttacacatatcacctcccttgttgtaaagcttgaactttctcctccagaggctgctgcatacagtaggtgtacaataaatgcctgctgtagttgactaagaaaccaattgctgctgttctgtagggattttggcaaacctaagagcttccatccaggtgccctaggaggcctgggatggaggctgtgctaggctggcctcagtggcggtaaaggcattgattccacaatttgtcccttgttttttttttttttttttttgagacagagtctcgctctgttgcccaggctggagtgtaatggcgcgatctcggctcactgcaacctctgcctcccgggttcaagcgattctcctgcctcagcctcctgagtagctgggattgcaggtgtgcaccaccatgcctggctaatttttgtatttttagtagagatggggtttcaccatgttgaccaggctggtcttgaactcctgacctcgtgatctgcccgcctcagcctcccaaagtgctgggattacaggtgtgagccaccgcgcccggctgtcccttgtttttccttctcctcaagtcggtaggacacctggtcctcattaggggctaattactgacaagctatggggctgggggtgggggtgctgcttggaagactgtgtttggaggaaaagagctttcttttcaggaatgaaaaaataagacagaaggctttttgctctatgaatcaaaaatctgggtgaagatctctgctggccccatctcccccccccaccccctccccatcttccctgctccccacctacacagatgtctgtggagcctccagacagggtgctcccacccacagctgagattcaagtctggattagctgggagcctccccctgccttgttgctagctgggcagagaaacacaggcctggaaaataatggcaaccagcacagcggtaataacccggctggcgcatctctgctggggcttcccagtttacaaaaaacattcacttggtctcttgacaactttgggaagcgtatgtgttggccaactgtgtccctgcttccagatgaggaaactgaggctctcagtggaaaagggatgctgcggctccagcgcacacaggcctggcctttgctcagccgtaacctagggctggaactccggaccaatgctgagcagcatcatgccaggcagactggcagaaagtcgaggtccctgtgtgcctttggaactgacccctgaccacctcccactgtcttggaacaaaggctgctggaccagctgtgcctgctcctcaactgtcccctctccagctcctcagcaagctcacccaaggccctgaagcctcagtgctgaacagagctgacctgggcctctctggcatcctcaggtctggctcgggccttcttccttctgccctccaacctttcccatgactttgcttggccaggcatccttggtggccatccctgactgcccctacctccctggccacatctcaccttcctccagcaagccctcctagccctccttcgtgctcgtcgacttctctttcaaaagattccctggaatcctgatctccgtagctctcctagtttcacctggggcctgcttagctgggtcaggaggtgtgcgtccatgcctccccagccaagcatgggacagagcacagggtgggagggaggaggaaagaaggaggcttagaacacacttataagaaggaagaaggatgttcccacccaggggcaaaagaagattcaaacttctctgaagctacagtgacctgtggtatgtgctgcctccatttctccaattgttcttggagaacaagacaacagagggcccagtaatactcacctccctgccagcagagttcacccaaccatgctggccaagcactgctggtcactcctacctctagtgcttcttggactaagagtccccgctctgggcagtggctgtggtttggccccacccttggccagggtgttttgcaccctcgttgcctgggccccacccaagaagcctgtggccaaagccagcttgctgggaaatggtgtgtgcctgtgccctagatggggtggtgcctaagcaggggtgtgctcctgctgcccagggcccgccctcagggaattggccctctgccatgaaggtcacagaacctaggccactactgtgcaagagggcacgggctttaggcgctggctcagtggccctgcagttttctggccaagagctccatggcagcgggccctgggcctgggcctttgacctggggcctctgttaggagtggtcctgatcctgcttctggcagaggcacacacagggctcctccaagtacaggcagccaggctcaggatgggagggagcagccagtcccaacaattacacagttcgggagctgaaaagttatgtttgccactctcaggagccagctgtggaagggaggccagtggagggctttgccctggcctctgagccacacacaagccgtgctgggaggacaagggccgggggtggtgaaggaccctcttggagcctttgctttccaggagcaggcactcgtcttccatatcacactcacaaaggctggtggcttcagtggctgtgaccagctggccacagctgactcctctggggtagtgctgtttctaaatattagttcctgctgttaacccttgctgtgcggccccagtggacagccggctgcctgcagacagagcctcttggaagtagagtggacagtccccacctggatgaaaaatttgtgagtatatttgcttgagggctgggttggggctcccagaaggagggtgagaaatacctgcttagggctgggaatgaggcttgcagtagatgtcaggggatgtgggtctgagctggccactgggcagggcagtggaaagaatgtggggtcaggagccaggagcccggtcctgccaagcctttttttatgtggccccagacaagtcacttcgcctttctgtacccctttcctcatccgtaaaatgtacagccaccgaggtgcttggatgatggcctccaacagaagcgccggagctttataaactctgaagtgcctggtggttatgatgatttttatgccagggtcctgctgtctgtgactcccccgagtcccttggaggagaggcaagactgacaaccaagagacagctggagcaagctggcggggctgctgttagcctgtgtggagctttagtggggacaccaccctatacaagaatacccagcttggagttcagcccctactggccccattggctcttgtccttgcacagtgaaaagcctagtggtagccaggctccaagatggccctcagtgagcctcaccttctggcattcatgcccttgggtagctccctctcatgttgaatacagccaccttatgcagccaatagggtgttgcagaaatgatgaagtgacgtccaagatgaggtcagaaaagatatggtagcttttcccttgctctcttctgattgcagccaccatgatctgaggataattaagtagactgtggaggtgccaatgtggagaggaactgaagcctcttgccagcagccagtatcaactcaccactcatgtgaatgagccatcttggaagtggatctgccaaccctaatcaaatcttaagattaatacaacctctactttttttttttttttttttttttaagatggaacctagctttgttgcccaggctggagtgcagtggtgtgatcttggttcactgcaacctctgcctcccggattcaagtgattctcctgcctcaccctctcgagtagctgggattacaggcatgcaccaccatgtccagctaatttttgtatttttagtagagacggggtttcaccatattggtcagggtggtcttgaactactaacctcaagtgatccacccgccttggcctcccaaagtgctgggattacaggcatgagccaccgtgcctgacctctactgacaccttgactgccacctcctgagagacctggagccaaaaccacccagcaaagtcacttttaaactcctgacccacagcaactgtgtgcaacagaaggaagttgctgtttcaagcaattatattttgaaagtaatttgttatgcagcaagagattactgatagaagccagcacatcgtagatggcagtccagtgagtcagacctggcacgtgcctggggctcagaaagcaggactctgcttccatgaaaagaagtgacattccttgatcaacaaattcattcattcaacaaatatttcttaagcacagatcatatgtcaggcactatgctgatgctgagggctggggacacaggtgaataaacaggaccctggttttggggaactgacaggctccccaaagtgacttggcaattggttggatgtgggagttgggataagggaggtgtccaggacaagcctaggtttctggcttgggcacttagaagggtgggtggtggtgtcatggattgagatggacagggactggggggtatctcataaggaaatcttggggcatgttgatttcaaggtgcttgtgagaaacccaggtgacactgtgcaggcggctgtatatgtgagcctaatgctcctaagaaggtctagtcaggggaagttttacttccggattgctggggtatcgataagggaattaaagcaaccagaggagatgaggctgcccgggagagaggagcgcggtgcaaaatgggaggaagacccagcactgagccctgagacaccaacgtctcttccttaaaatgtttattttgacataatttcagacttagataaaagtggcaagatgattacaaatgtttcccacatactccacctagatttcccaaatgttaattgtttaccacattttaaattcttttctctctctctctctttttttttttttagatggagtctcactgtttccaggctggagtacagtggtgcattctcagctcactgcaacctctgcctcccaggttcaagcgattctcctgcctcagcttcccgagtagctgggaccacaggcacgtgccaccaagcccagctaattttttgtatttttttttttttttttttttttttttggagatggagtgttgctctgtcgcccaggcttgagtacagtgcagtggccccatcttggctcactgcaagctccgcctcctgggttcacgccattctcttgcctcagcctcccgagtagctgggactacaggcgcccgccaccacgcccggctaattttttttttttttttgtatttttagtagagacagggtttcaccttgttagccaggatggtctcgatctcctgaccttgtgatccgcctgccttggcctcccaaagtgctgggattacaggcgtgagccaccgcacctggccaattttttgtatttttagcagagatggggttttactgtgttagccagggtggtctctatctcctgacctcgtaatttgcccgcctcggcctcccaaagtgctgggattacaagcatgagccaccacacccggccatctctctctctatttttctgaaccatttgaaagtaagttgcagacataatgctcctttattcctaaatatttcagtgagtttttcctcttttttaattttttttttaaaatgagacagggtctcgctctgctgcccaggctggactgcagtggtgccatcagagctcaccacaccatcaaacttctggactcaagggagcttcctgcttgagtagatgggattacaggcacacaccaccgtgcctggctatttttttttttcttttttggtagtgacagggtcccactgtgttgtccaggctggtctcgatctcctgggctcaagcagtatttcctagaacaggaccttctctttcataactggagtgcaatgatcaaaaccaggaaattaacattggtacaatactttgaactaagccatagacttttttctccccagctttgccaattttcccaaaaatatcctttataacaaaagaaaacctcggctttcttctgagtgtctattcatcttgcatggttcttcagcgtttcattgtcttccatgatgttgccatttttgacaagtacaggccagttcttttaggtgaattttggtttgagtttgtctgttttcctcatgattaaattcaggttctgtattgtggcaggaatgcctaggaagtgatgccgtgcccttctcacgcagcctatcaaaagacacataactggctgggcgtggtggcttacacctgcaatcccagcgctttgggaggccaaggagggcagattacttgaggtcaggagttcgagaccagcctggccaacatggtgaaaccctgcctctcctaaaaatacaaaaattagctgggcatggtagcaggctcccctaatcccagttattcaggaggctgaggcaggagaattgcttgaacccaggaggcagaggtcatagtgagctgagatcacgccactgcactctagcctgggtgacagagcaaaagactctgtctcccccaaaaatcccccacaaaaaaaccaaacaaacaaaaccaagaggcacacatctattgtgcaatcattgggatgttgactcgtatcacttggttgaggtgatgcctgccaggcctctcttctataaagttactgtttcccctttgcaatgaataagcatacgccaacattgaaaggtcaggttgaggaaggaaggaagccaggaagaaagccagtgcaggggcagccgagagacagaaggaaagaaggagggcgtcctggagccagcaggaggggcagcatgagtgaggcagggctggcatttattgcattagaggatgaagagtgtcccttggaagcagctgccacctgcaggtggcgggcgtcgagttaagcctctttcgggtggagcagtgggcctggagccaactcaggctgagtcaagtgtgagagggaggtgagaatggagatgactggaaaacacctctgtggggaaggtggtctgtgggctgggcagagagggacaggcagtgacggagaagcatgtgggcttgggggacagtttgaatagatagaggggacttaggatatctagagtgtgacaggagggagccagatgagaggcgcaagtccaaggagaggggtgcaatccacagtgtcccaggcgggacgtgggagccgatgacaaaagacatggcggttctgaggctgtgatggggggtactcgtcagagcccagcctgatggggcaggtggatgggggggccggaaggatggccaggcgaacagaggagagtgagccatgcaggggatgatccctgggggtgggggagagggggagggcaggctgcccagaggtgggggtgggtggcaggtggcgaggagggcaggtccaaggttctggccatgagactgtcctgacagctttagctgcctgatgcagatggacaacgcagacctgggggacgcagtgctgggatgttccaggaaaggggctggatgaggagggtggtgaaagctggaggggcctgaaggatgacgcagaagtgcagggagtgcagggtcagcactggggtctcagagatggggggcaggggatggcctcccagagagactggctgtcagtgctgtgggaggtggtgagaagcccaggattgcagtgggggaccggcctgtgagggagtggagtggaggtgtttgcacatgaggaggtctgggaacggggaggccagggcattggtggtggtccctggggaggcctgagctatcagggtcatggcaggagttggggtggggtggaggtggcctcgagccacggctgctaggtttatgagtagggacccagggcagccctgaggagctgaagggggacacacctggatgccagtgccccagaggaatggggcatttgatggggagggcacagtctggggaccaaggcagccagagacccacggcactgtggactctgaggcatgagggatgtgaatgtcggagcagccagctttggacagggccgagggccacctccaggggtgagctgggtctccatcagagctggaggaaaggaagcatttggaacaaattggagtggcttgtgacctgctggggtgcggggtggcctagtttcctgaagagctgtgcaccaggatgatggggcagaagcagtgagggaggaaggcaggaggctccccgggcctgaaatacttggagactgcccgctcaccaggaaggtgggggtcccagccccagatccggcccctctcagcactgggataccatcagggctcgcagcttcctacaggaaaagctgacgcggatggggctgaggacatagcattggccctggcctgaggccagtgaggctgggtcaccccccagcctggctcagccctcccttacccagaaatcagaggtttacttgccccatgggcatatgggggcacacagggtctgctgctggggggactgggcccctgtcctctgttctgaggcctgtggtccctcaggggcttctggacaccctgcatgcctgtcctacctgctgctctgagccctcgctgtgcctgctgactggaatgcgttcagagcatggcttggtttctattcaatcagagactatgatccaaggagagccctgggttttgtgtcctggttccatctctgctattttgatgtagtaggagactttgggcaagtccttgttcctttccgggcctcagttttcttaactgtgtactggggtggtgacagacacccctgtctaaagccagcagtcatctggttcctgagatggacaccgctgacccggttcaggtcaaatccctagtctgttacgaacagtggaggtgacaggccccaggcccccaaaagcctcctgggttcttaggaatgaagaggttcccagcatgttttcaggcctggggctcatccatccgtcagatggggctggctgccttccctccccttctatgtgtcctctcataccgccctccaactccaactgctcccctgccaagggagtgctcttggtcacaggcacaggaagcagccccttgaaggctcagcaccacccctctgtcctcctttatttgcttcccactcctttttgtatccattgagctagacatggatctctaaagataccacaccctgggataggattctggggaggagctatcagacagtcacaccttagtgataattgacttgatattttgccaggggaaaaatagacttgacagaagagagggcatgtccagagcctgggaggtaggtgggagaggcagggggtagagagcccccagggggctgtgtgtgctgcacaaacccttcacccgtgacccaccaaccctttccattcctttccccaaccttagggcacccactgggagtgaagcgctagctgatacgtaacaccatctctccatttcccttccctgacccagggtcctggggacccccaggccacttggcctggttggtgatgggggacagtgggatagtcagggttccataactaagctcccagcatagaatttccacgccgcagttcaggcgccatggcaaccaggggaaataaacactacgagtttcacagtccaagctctgccgtgacgtcatctccagctccagcctgctggggcctgtgctgactgtgccccagacagccttagctgctcaagctggagaactgtcttccttcccagcttcctccgtgtctggggtgggggatgggggggtctcaggcagggatactctagccccttgactgctgtttagaccctgctgtagctgctgctgctccctgcccagccccagccatgaaactgcccaaggggaccaggagctctgtgtactttgcacagcacccagaaaaggagccattgccctcaaggcaggaggtcaagcagacccctgtcatcatggccaagatcaaaggtgagagccatccccaccctgggcttgggccccctcccctctctccaggactccttccagcctgcctcctgcaaagccccttccaacttccttgaagccttacagaagacctgagcctccaagctgaccctcacaggcagtgttggctgctgggattgtccaagtgggtgggggaggaggggagcatgggacttgcagtgaggcccgctttggaaaaagactaggagcctttgtcctagctttagctttcctcacttcccttcaattttactctcaagggacagcagacgctaattcttactatgttggtaatgactgactagtgctctaagtgggagtagtttagtgcagggattgaaggtttgggttctactggatgatggtcttagaatcttcacactactagtttgtgatatgtgggtagatatttctaagcctcaatattctgtaaaatgggaaaaacaagagcatttaccttacagcattgttcagaggcttaacggaaataatccacgtcggatgcctagtggagaacctggagcagaataagttctcaattaactgtaactattagcttcttattatgcattgtctgtccaagggaaactgcattttatctggaaatactgccttcccccaaacgaagcagctggatggatgctgggctcgtggcagtgcgatagcagcaagaacaaatacccccaatgttcccatggtgcgctgtactggggcttcccctgcctctgacctggtgggcccaggctgagggctgtcctgtccatccttacaggtccggggcccgccaagtacctccggccatcctgcacgggctacatagatcatgacatctccatgttcaaggcaccagcttataccctgcatagccggcactcagagaagcgtgagcgttgccaccccagtcatccggctggggttggagctgttgttggaggttgaggggagagacatggagccattctctgtagccactgggaatctgagacactcaaggggccccctgggtccagaggaagccagcggggattgagggtggggcaactccatgggcatcccctagccgcctctcccaagggagcctataggggatcctggccctgtccagctggcacagcagagtctcctttttctggcctttggctggggcccttcagctccggtcgccatgctctgctagggtcacttgccattgtggccaggcaggaacagctaggaggccagtggggaagtggtggcccccagagctcctcaggtggcctagaacccactggaagggcagaagcagaggccacagatgacctatgctgctgggcagggtgtggtggcgtgcacccgggggtctgagatctggggtgcctgtcaggcctttccctggggagaatacccacctcagcaaggtaagcccctggcctggctgggcctttgctgaatgcccacagcagccacagggctattactccccgttggccccaacccctgattgggtgggtggctgcccaagctgctgggcagctgttattttactgttcctctgagcaagttcttgaaaataccaggtcatgtgttaaaagtcccattttacagatgaggaaatcaagggtccccaaacacccaggagccacagaatctgaagtgggagggagatcttgcctggaggcaggccaggtgctcagtggggcagcctttggggctgaccaggccctctccttggttgccctgcagggatggtgtgccacagcagccctgggccttgctatctcttggatcccaaaataactcggtttggaatgtccagctgcccgcaggtccccatggaggagcgcatctccaacctgcgtaagatggggttatggacagatgttgggggttgggaggttggggggtggggtgcacccttaggacctgggcaggggcaaagggtcaagacttcctccttggaaatgtctggatgccggtatctccctgcaagacaccgacattgcaatgctgacatcaccatgtcttgaagtcaatgttatgacatgcagcatgtcaccaggtgacgttatgatgacatggagctcctgttgtggatgcaatattgtcatgcgaacgagctcacagactgtagtgatctcagaatgtttctgtgtcgctgtcagagggacaatgtctggatgctgacactgtagcaactgggggtaatccaaggggaatgttatgatgacattatggttttttacatgatgaccactgtgttgccatcctgatgtcaggatggcctaagtgaccatcttatttatttattatttatttatttagatcgagtctcgctctgttgcccaggctggagtgcagtggcgtgatctcggctcactgcaacctccacctcctgggttggagtgattctcctgcctcagccttctgaatagctgggattacaggtgcacgccaccacgcccagctaatttttgtatttttagtagagatggggtttcaccatgttggtcaggctggtctcgaactcctgatcttgtgatctgcctgccttagcctcccaaagtgctgggattgcaggtgtgagccaccgcgtccggcctaagtgaccatttggatgtccctgccctgctgctgaggtggtcagcctgaggtcacagtggataaccaggaccatcagttggctagcagagaatgaggtctgttccctgctctgagagccctcccttcccgccactccctttcaggcctgaaccccaccctcgcatcctgccagtactactttgagaagatccacccaccgggggaacgcagggctccccagtacacgtttggctaccggcgcccatacagagtgatggacctcaacccggctcccaaccagtaccagatgccactcttgctggggcccaacacccctgtcagccgagctgctccctgctacagtctggcctccagggacaagaactggttctacaaggaggatgtggcaggaggccctggacctaccacgtacgcccgacctgagccatccatctatcagaaccgcagccctacttacagcatggccaagcgcttcgcctaccctctggacctcacgccacggcctggccccggctcccacgaggtccagcaggtcactgtgcacaagccccacatccctgctttcaccatgggcatcaagcactcactccacctgtgcccactggtcatcgacattcgtgactgaggcccctcttggggcactcactgcccctcatccccagaaattatttttctacaccaaattgagcaatttgaccaagatttctagtagcagagccggtacctgctgagtgtccggcacacagaagacattagagatacattttcatgtatttgttttttccttttctgttcacagttgcttcctgtgggtcctgctctgggtgaggggctggggacactggaaggaatgatacagtccctgtccttgaagagttccattctggttcaccaggtggggaagccatgtgtctgtcctccaaggagccccaggcagagactcgggagagctgcattccagtcctaactgccattacaggctgtgtggccttgtgcagctcctgcccctctctgggctcaggattgccctttagacagtgcacagggtaggcttggaagaggtctaggttctcccaagttccagaactgtgggactgtgctgacagtgtgcagtccccgagacaggggcagggcaggtcggggtgcaggcagaggagcggagtccctctggttgggagttgggagaggagtttcctcggggagggacctaagaggacaagaggagactgctggggagggcgaaggtggaggtcaaggtgagagcaaagcatgcaggtgcagtgacagggaactggggaggcacagagcagcaggggcctggggtgcagggggcgaggctgctacccggggccacattgtgggcagccgggaggggcctcgggctttgccctgaaggtgtgagggccggaagatgctttgggagaagctcggacaggatgggcagagtgggaggcagctcccagctgggcagactgcagggaaggtcagcttgtcacatgctgtttttggggtcactcactatgtccccaacctcaacagcttagcctggcagtgcctgtcagaggagcagccgtgaattagccaggagggggcagcgctgtctcaatcttcaagcccaggcctgtgcctacccaccctggctggcacccgctctggctttgctgctgctgggcggacaggcgccagctcctgttggtcttgaggaggtgagggtctctggggctggcatttgtccttcctctgttcttggcatccagagccccaattcacctctactcctggacacaggaacctggcagtcccaggccagtgtgaggcatggaggggatgcggctgaggtcagcaaagaggctgggtgggagggtgggagccatggagggagtgggagggaggaggggggtgagaaagcccccagacctaatggctcaggcagaggcagactgttccgcagagcagagggtgacaggaagagagcaccgcctcagaaccagtgtctaatggttcatccttataaacctgaacaatatccaggttttaatttaaagtgaaaattgaggctgggtgcagtggcccaagcctgaaatcccagcattttgggagagcaaggcaagcagatcatttgaggtcaagagttcaagaccagcctggacaacatggcgagaccccgtgtctacaaaataaaatacaaagattagccaggcatggtagctggcgcctatagacccagctactcaggtggctgaggtggggggatcgcttgagcccaggaggtcaaggctgcagtgagctgtgattgtgccactgcactccagcttgggcgatacagcaagaccctgtctaaaaaaaagaaagaaaagaaaagaaaattgaattgaagccctaactttggtcagaaaggaacagagcatataatattctttggaatatttttaaaagcacacatacaactaaatatttagaaaagagcctgtggtaaaccccactagggatgtccttgattctgggccctgaggtctcctctccatcccacccgcccccaggccctgggctttgcatctgcccatcctctcaacaaggatggcctgggctggctcttgggaggctgtgggagctcggggacccgtctgtcttgtggcagattagaaagatgtcattttgccaacagtgccatttatcatggcagctgcaaaaattagtgatgcttggtgtgtaagtgttgggtgggggtgggagctggcaggtgacagcagccaatgctccccagtgttaccaggtcagggaactgcaggccaacctctgaataggggctttctgatttaacacttagcccaggtgaaggccctctgttggaaagatgaggaagctggcgctcggagcctggaaataacttcggccacgtgataatttttttttgtgacaggatcttgctccgttgcccaggctggagtgcagtggcacaatcttggttcactgcagtagctgggactacaggcacatgccaccaaacctggttaatttttaaatctttttgtagagacgtggtcttgttatgttgcctaggctggtctcgaactcatggcctcaagtgatcctcctgcttgggcctcccaaagtgggattacaggtttgagccaccatgcctagcccacatgacaaattaatggtccatctctaaataaaggtctaggttctgtgtgtgaccaggaccagggctcatctagggtgaagtgctttacttctattaggagtaagtattatttttgcctttatggctcagtctaggacagaccttcagcctggccccagctgccaccagacagaggcaggattgggagctggccctggagctaggactcactcttggggtaggtttatggtcccaagagaaggggagaaggaggatggagggttcagaaggaatattgggggggggtgaagatgttcagatgagaggtggccccgcaatcaaagggatgccgactccagggaagatgaatggggcctcccttgtgcctcggcctgcaaaatgacagggtcatttagcttgggattgacctttggatgaagcagtcccatcacttgacattgcctttcctgtggtagtgcccccagagaggtgacttgcagaaggtcaggcacggcctcccaggtctggccgactgctgcgtggccccttctgaacaactcagggggttctcgcttgaccttgcaggaagccctggtttgatccttgtaggacttgaatctgtatcttcaggtcactagactccggagcctggcacttgatcacacacaaagcccccatccgtgcattcattcattcaacaaacatttgctaagctcctgccctgtgccaggctctggctgggtccgggggtacgaagacttggtcttcacctggagccctggcctccaggaggtctgaggctgtgtccgtgagagggtgggaattcaccctctcccaccacgagcagatgttggagggtggatgaggctcggtgcctggcaggagacccacctgaggttcctctcttctctctagggggcaagacaggcctggctccatgttgggttacctcagccagggcttggtggtgacatcacagtcccacgagcctcttggacactggctggggtgggggctggtctgttgttccactgttgctggagggaaccccaaggccaatcaccactcaggttcccaggacctggggggatggtggccctgggccaggagcagaagaggggccctgcctgcagggacacatggacacaccatctggaggcacacaggtaggggctgtgcacacacacgtcccttaccgcacacacgtggggcaagacacacacacaaatgcacagacccacaccttactctacacacacacacctggtaccaccactgccttcaaacaccctgccccatccctctctcccaggcatctcatctcatgcacagatacgtgcccacccaggctcactggcgcccctcactgccctggagtagtaaatccacaaaccatgagatgtcccgacatgcagagagaggtgggatgggtgatgggagggaggtcaggagagtccctgcattcccccaggagaggggaccgctggctgctctcagcccgccagcctgggacctggcctctgggcgctgtgcacgtggtcgtgagagggcacccccatgaagacaagccaggtccccactcctgctcccagcactcacagacacccactctcggggctgctcaggtacgggaggactaaacaggagctcctgccacccggctcctttcggggtgtggtggggggctggtgggaggacacatccccctgagtccgtggccctgctcactggtggagagttgcccgccctcccgttccttctgctccctcttcctctccacgcccacatcctcccagctggcctttctctcccccagatcctctcccatgaccaggtttcctctctctctctctctctctctctcgctccctgtgtccctgtgacctacttatgctctagaataatgatcgacattttcaattacccccaaagtaacagccgttcttggggcctggcggaggacggctgcatgggcgtgggcacgggcgctggtttgagtgtggggcctgcgggtggtgggggtggggacgcccatggtcccactgtcctttgtttgctttttctcatccggagccttcaatttttcctggaagattggaagcacgtttcccttcaggggaggaagggagataaaacagagaaataaaaactgtcatcattctcttgtaaacagcgtagagccaagtgggggctcggcaggagagagcgacatgagggagaggccaggacagagaaagggggccgagagggatggggtggggaggtgagcaggagccccccctcaaggccgggtgggtgggtgtcctgcaggaaagactgatgggaggggaatgaggcgaggtgaggctgatccagggctggggccaggttggggggttgcggtttgaggagacacagtgtctgctgagtgccaggcaggccctgggaggcaggcgctattctccgaatcccaccctgcgccaggctctgggggtgctgaggtgagtgacagacatgtctttgcactcttggggcataaactctattggaaacaaagcggtggcttcatgtgttcagcacttatatcaattgaggctcagagagggtgggtgacctgcccgatgacacacagctggaggtgaggagaccaggatcccagccaggtccgtgtgaccgcagtctcctttcacaccacctccgctgtgggcacacttggctcttgcgtgaccttgagcaagtcctcacctcttggccatcagtttccccatctgaaaagcagccagcatgctggctctctgcagggctgaggggagcatcagatgtctggatgtgaaggacgctcagctctggctctctggcgagttggcggggggacggaggagcaaagaccaccggatgctgggagagggactggccggcagggaaaggaggccggaccgcagatttactccctgctgctgcccagtggcaataattgggtactgcagagggtgggtctggaggaccttcttcagcttgcaacaaggccagagcagaaaggtgcctctagggagtgttgtctagtcctcccggccccattttgctgatgcccagagaaaggagggactcctcctcaggtcatccagggcagaagcttgggctaggctttcagggtagggtgcttccctccatccctgtggcaatcaagaagcccccagtcagcttcagagcaagagaaacagagttctacatcctctgcttgatgccaccacctccagggagacttccagggtctcctccagtaggaagtggcctcactcctgccctgcagtcccacactcaaactctccttgctcctcctgccccacccaaccatgactgtcctcctgcccgcagcaaatcaggcagcggggccccttgagacacgagagatggtggagaaccattgttaccactcagggagcatgtgccaggggcccactctgtcctgcggctctacctgcatcctctcacttgaacctcgtaagaaccttggtaagttggggttattttgatccccatttttcaggtgagggaacgggcacagagagtttatgacctttacacacagagtggtggggcatggactcaaacccaggtctgtctgttctctggagaggcacctgcatttggaggtgaaaactacccctgtggccatatgacagtccactgtgaccggacactgaaatgaccagtccagggggcttgtgggctggggtctcagcttcaccactgtgctgctgggtgactttgggcaaggcccattcctctctggaccctggtttctcatctgtgtactgtgtatgtgcatgcatgcatgtgtgtgtatatatgcgtgcgtgcgtgcgtgtgtgtgttctgggctacctcagagatccattctggctttgagtgtggtatatcccatcttgggctggtcccaaggcttgggccctgggatggaaaggttttaaaggtcatggggagggggtgcagatggcagtgtgggaggcagagctctggctaagagctgggccccttgggtgcacctcctgcttgcgtgtcactgtgtagggctggggatcaaggggaggcatggactgtgagggcacgagggatccggctctgggacaggtatggggttggccctagggcctggatgtgtctccctccactgcctgccacagagggagtttgtcttacaggaaacagcctcatccatcagcggcaatggggggctgacagtggccactccccaccagccctggctggaggcagactcataaatcccatgccaggctgggctgtaaattcctgtgattcacatctggcctcttggaggacagagacatttggggctgtggggctggctgttctctcttggacaggacaggtgggtacccgggagaagcctcttcactggcccagcagtctcagatggcccccctgaggagatgcgatgctgagcccctggatgcctcaggcccagcccgagccatctctgcccacgcccaggccacctctgcctgggccattcctgtgctctggcccgaatcaccctggaggtcacgtgtgtggacacactctgtggcctcagagatctcatggggcctgtggccctgtgggtggaggattactcaggtgctggggcaagagactgaaggcacaaactgtttcaatataataaagaaaataattagaataagaatagtcataatacaaattagatatagagatgatcatagacaattaccaatcattactataaacattattaatcattagcttttaattactaatataacctaggaataacctgcgggtatagggtcaggtgctgaagggacattgtgagaagtgatgtagaaggcaagaggtgagccctgtcatgcccgcataaggtccgcttgagggctccttggtcaagtggtaacgccagtgtctgggaaggcacccgttacttagcagaccgcgaaagggagtctccctttccttggaggagtcagggaacactctgctccaccagcttcttgtgggaggctggatagtatccaggcctgcccgcagtcatccggaggcctaaacccctccctgtggtgctgtgcttcaatggtcacgctccttgtccactttcatgttcctcctgtactcctggttcctctttgaagtttgtagtagacagtggtagaaggaatagtgaaagtcttaaagtctttgatctttcttataagtgcatagaagaaaacgctgacgtatgctgccttctctctccctgcttcggctacctaagagggaagggccccctgttctgtgatcacgtgacttgcttcaccttgtcaatcacttagaagattcaccctccttaccctgcccccttgtcttgcatgcaataaatatcagcgggcgcagctgtttggggccactaccggtctccgcgtcttgatggtagtggtcccctgggcccagctgttttccctttatctctttgtcttgtgtctttatttattacaatctctcgtctccgcacacggggagaacacccactaagtcccgtagggctggaccctacatggcctggagggttggctccaagaaccccacagtgaggtctcctgccaatccgcatggcattctgtcttggggctgtgaggacacggtgggagatcacggcccagtctgtgcatctctcattccagggaggccggggccccgaatccactgtcccttagacaggaaggggatagggacactcagaccagggctgcagccatttgtcgcctttcatcaggacttttgccacactcagatgccactggaactctacttagcgttttttaaaaatcagcttacttttaaaatttaagtgtgtgttttagcctcgtctttagccatatttgtgaaatcagggtctgatgtactagtcaaataccatgcacatacacgctcagacacatacatatacacatatatgtgaaaatatacacatgaaatatatccatgaaagtaaacaaagttaaaatagcaaatgctcagctccatgtaccatctaaccctgctttaggtttagagtggctctagtctccccccattatgggtgattcctcactggtgaaacaaagcaggttcagatggctcacagagctgagcatttaccagccattctagccttcctccattttacagacaaggaaaccaaggtccagagaggtgtagggcctgcctgaggtcacacagcgctgggattagtggccagcctgcctgactcccagctgagtgatccttttacggaagcacactccctgtctgtggtgtgcagggccccttcctccagaagcatatgtggactcacagagccctttaggagactgtgccctaacatgcctccttccccgccacctcgcagtgcccagcaccctcactggccggcacgtgcagcacagatctgggtgtgcagccactcagcacactgatccacacacgtgggcagagtcacaacacagaagctcgcctgcacacagaggcatttgcaccagctccctgcacacttgtgcctggtgtgttcagaggaccacctgtgctgctcatggagacagggcttgctcgctaatgtccagctgtcatttctctacctcaggtcagagagtctgacccacctaagagccttccatggctccctacggcctgcagcattgagccccaaaagtcaaactcttcggactttgaaggttttccaccctatgcctcaccctccccacagagctcttcctcattccgtctctgttccctgctttggccagtggctgtcctggatgcggcccacactacacctctgcccacactgcagctctgtacccagataccctccagttcctcgccacataattctatctcagtcatgccccggactgcgttgaagccaggctgccttgaagctctcctagactgctcttttccccaaggaagggtcatgatttgccaaatgtttcgcatgtgttagcaagactggagtcggagcaggcatcaaaccttacatcccatatgtcacacctcaccacagacctggatgccaaataccctgaagagtctgaactcacattggcagttagcaaagtgctcctacagccacatctgcagttaacacagcatccctatggccactgtctctcttgatccccacggccactctgggagaaaggcagagagtcatcatttgatagaaaggatgctgaggctctgggagggaaagggacttgcctaaagccccagggtgaagcagcgtctctggactcccagtccagtgctcttgcccagtgctatgctgcttgcctctacccatctccgtgggtcatcagcgcatcatagggcaagccccaatccctgcctcattttggtttatgggcgctggacccacagccctaccctacagtcatttggagacaaaaacagatgctattgttcttccttagagaacgtggccagtggatccggcacactgggaatcagagtgaatgtccttgaaagaggccatgggtcaacaaggccaagccagaggatgcagaacgcttttccttagaaatctttgggagtgaagcaggcttcagactctcccatccctgcccctgcagccacccctaccacattggtttggacccagtaggttggggcgggggcgggggcgggggcggggtgggggtggaggaaaaatcagattgcccatgccccccaggctccttccccagctgcttctgtcctagcccaggcctggtgccattcttccactcacactcgtgtgcaaacccacacacacatcacacaccttgatgctcacagtcacagcctggcctctgctcctgtgggccagtggccagacaccccctgggatggctcaaaggagtcaggacttggaagtggggacatcagggtagctgaaggaaatccacacacccagaacatctcggggttcagactctctgacctgaggtaggctccccaggggctgggagaggggtttgacggaatggaggatggaggacagcgggaagaagaaacgaggaggaatgcaacgtgtggggcggccgccaagagtgaaaatagagggaagcgccatgcaagtgctggaaagaagggggcaggtgggacgagccccacagccccctccacaaaaagaccacttccgggactcagtgctcctttgggggcaggctccgccagctctccgccactcagggctccggtcccacggtcggagtgcccgggacggagacggccagttctggcggccaggtccgacgctctagaatccagccccatttccctcccggccacgcccgtccggcggcctctcctgtcatattcagcccctactcacctggggaccccgggaggggcgcgagggcacctgcagggggagggcctaaggggtcaggggaagcccccggtgtggagggtacgacgggcgcttcccccagggtggacgcagcaggcagaggcccaggagcagggctccgcaacccgggccgggctgggggcacggcggggagtcggcactgcgtcgtggggctggacttgggcgacctgcgggcgaaagggagccaggaacagaaagaggagcgatgagcggccccgcccaccctaaggccccgccccagcccagtgccagccactcccatgcatgcaagccccttcctgaaggcccgaggcggtcaccggagcttaagccccgccgccagcggcgccaacctcccagatccaccccgccccgcagcccgcgctccacggcaagccccgccctctctaagctccgcctctcgcttcaagtaggcgccaccccgggatgggggcgcgccctgcctggtccggcacttcttccgcggcccaggctggggggctttggggccgtgggggccgaccctggtacctgcgtccgaccgggacgctctgcacctgcagccaggagtcatccacaggaccccgtgggtgtgctgacgatggtcgtcttgatgtcaccgatgatgctgggcgcctccctcagcacgtggtgcatgcgccgcatctcgttgcgcccctgtgcctgctctgccgactcccccatcagcgtgttctgttccccacgcgagtacaagttggccagcagctccgagaagatgaactccttggtctgagagcgggcaaagagggaaggagactgggacctgattgatgcttgtgctgccctggccgccatagctgccccgccgggccctgttgggactgtgcgctggacttggagccgcgagtatggcttttcagacgcggcttctacaccgcttagactcgaagatccgcctccccaccgcccttttctcactcagatgaggacactgaggtccagaggaaaagtcacctgtccaaggtcacagttctgggaggggactgaggacctatcatgccaccaggacacctgtctactcagtttttaatttttggagataggatctcgctttgtcgccaggctggagtacagtgggcgagatcactgctcactgaagcctcaacctcctgggctcaaagtgatcctccaacgtcagcctgtggagcagctaggactacatgtacttgccaccaccaagcccagctattttttaaaatttttgtgttgagatgaggtctcattatgttgcccaggctggtcttgaactcctgggctcaagccgtcctcctaccttggcctcccaaagtgctgggattacaagcatgaaccactataatcccacattatatttctattggacaactctggtctggactgtgcctcccttcctgaggctggtcccataaggctggtctgcatctcccctaggccaacatggccacctgggtcccctctacccccatgaggcgacgcatgcacgttgttgatcatgaggtggatgatggtcttgggcatgaggtcctgcatgttcttgttgacaatggccatgtacgagtccaccaggttctgaatggtctccacttgccactccagctgtggtccatggagagcatgaagctgtcggagccattcccctcagtcttgctggcctgtcatgaagaacacaagggcatcagggtggccaggccatgtagccaggctccaggcatcccctgcaagggtacctggcacattgatgcacagagagaagcaactggcctaaacagacacccagctctccacatgctctaaaaggtttcaggtctctgcccatccctgtatctcttaggaccccagactcccctgattcagcctcatcttggttctgactctactgcccagaatttgcctcaattttccaaaccagaaatgagaaaaaaacatctgcagatcctttgcttaaagacctggccagagctggtgccaggctgcagacgcctggcaggaagcaagagagggtcacactcactttcttcttgtcctgggaggcccacacaccaacactgccaccactgctggcaccagggagcacagccaaagtagacacacacagagaggaaaaggggagaggttgagtgaacctgggacactgcaccccaactctaagtctcctctagacattgccacagtgaaataggggagaaaagagaaggcagtcacaggaaaccaccatcatagaaagggcatgcaagaaatgccatctgtggcagagacggagacacaaaactgccactggagaaggatgggaggaccagaagacttaactctgatctcaccccagagtaggtagtggggaggattcctggttatttctgagccaaacaagggctcagaaacatggcatgacttggcatcactgtggatggtgccccagggcccccctagtatcagcagcttgaccctcctctccttgccctgccgctcaccccaacacactcaaggtacacaccagccctcagaaagtaggacttccagctgttcacctcctcctgtgtctcatgagccagctccagctgccaataatccttgtagaggccaggtgcggtggctcacgcctgtaatcccagcactttgggaggccaaggcaggcggatcatgaggtcaggagattgagaccatcctggctaacacggtgaaactccgtctctactaaaaatacaaaaaattagccgggcgtggtggccggcgcctgtagtcccagctacttgggaggctgaggcaggagaatggtatgaacctgggaggcggaggttgcagtgagccgagattgtgccactgcactccagcctgggtgacagagcgagactccatctcaaaaagaaaaaaaaatccttgtagacattcctgcaagacagggcaggcagtgagggcagatgggcaaagccacaccctccctgggggttaagggcatgcctggactttggggtcatcacatctgagtcaagtcctggcttgctcatttcccagctgtgtgattctgggcaaatcccttcctttcagcctcagtttcctgattgggaaaatgggttaataataattcctgccttgttatggtttggctgtgtccctatccaaatctcaacttgaattgtgtctctcagaattccacttattgtgggagggacccagggagaggtaattgaatcatgggggctggtctttcctgtgctattctcatgatagtgaataagtcttatgagatctgatgggttgcttttgcttctctcattttctcctgctgctgccaatgtaagaagtacctttcgcctcccaccatgattctgaggcctccccagccatgtggaactgtaagtccaattaaacctctttttcttcccagtcttgggtatgttttcattggaagtgtgaaaatggactaatacaataaattggtaccagtagagtggggcattgctgaaaagatacctgaaaatgtggaagtagctttggaactaggtaacaggcaaaggttggaacaatttggagggctcagaagaaggcagaaaaacgtgggaaagtttggaacttcctagagacttgttgaatgactttaccccgaatgctgatagtgatacggacaataagatccaggctaaggtggtctcagatggtgacaaggaacttgttgggaagtggagcaaagatgattcttgttatgttttagcaaagagactggtggcattttgcccctgccctagagatttgtggaattttgaacttgagagagaagatttagggtaatctggctgaagaaatttctaagtagcaaagcatttaagaggtgacttgggtactgttggcattcagttttataagggaagcagggcataagtttggaaaatttgcagcccgactatgcgatagaaaagaaaaacccattttctggggagaaattcaagccagctgcagaaatttgcataagtagcaaggagcctaatgttaatccccaagaccatggggaaaatgtctccaggctatgtctccagaccttcacagcagacccttccatcacaggcccagaggcccaggaggaaaaagtggttttgtgggccggggccagggaccctgtgctgtgtgcagcctagggttttggtgccgtatgtcccagccacttagccgtggctgaaaggggccaacgtacagctcaggctgtggcttcagagggtggaagccccaagccttggcagcttccatgtggtgttgagtctgtgagtgcatagaagttaagaattgaggtttgggaacctccacctagatttcaggagatgtatggaaatgcctggatgcccaggcaaaagtttgctgccagggccttcatggagaacctctgctagggcagtgcagaagggaaatgtggggtcagagccccccccacagagtccctcctggggcactgcctagtggagctgtgagaagaggaccactatcctccagaccccagaatgatagatccactgacagcttgcaccatgtgcctggaaaagccacagcactcaatgccagcctttgaaaacagctgggagggaggctgtaccctgcaaagccccaggggtggagctgcccaagaccatgggaacccaattcttgcatcaatgtgacctggatgtgagacaaaggagataattttggtgctttaaaatttgactgtcccactggattttggacttgcatgggccttgtaatccctttgttttggtcagtttctcccatttggaacaactgtatttacccaatatctgtaccctcattgtatctaggaagtaactagtttgtttttgatttttacaagctcataggcgaaagagacttcccttgtctcagatgagactttggactgtggactttttgggttaatgctgaaatgagttaagattttgggggactgttgggaaggcatgattggttttgaaatatgaggacatgagatttggaggggccaggggtggaatgatatggtttggctgtgtccccacccaaatctcaacttgaattgtatctcctagaattcccacatgttgtgggaaggacccaggaggtggtaactgaatcatgggagctggtctttcccgtgctattctcatgatagtgaacaagtctcatgagatctgatgagtttattgaggtttctgcttttgcttctatctcattttctcctgccaccaccatgttaagaagtgccttccgcctcccgccatgattctgaggcctccccagccatatggagctataagtccaattaaacctctttttctccccagtctcaggtatgtttttatgagcagtgtgaaaacggactaatacatgcctcctcaggtcactgtgaggatttagtgaaacattatcctaaaaaaaataagttaaaagtcttgcttaaatatgacaagcttataaaaattaacagaagcattatattagaatttctaaagtcatttccattgaaatcaagaataagaaaaacatgctgctttccccaatgttagtcaacattatttaaaatgtttagctaatcaaactgaaaaaaataaaacaattggtatgtatattatataaaaaaggtaaaattgcatatttttgtatataatagagaagagaaaatctaatattttaataaaatacaataaataatttaataaaatatctcaaatcaagatatatggtacataaaaatcattagcctttctcaatatgaagaataactagtcatggatataaatttattttttaaataacacataaaagcattatatattgcttaggaatatatataaaaccattatctattatttagaaatgcaaaaatacatttaagaaatgtttaaatgtctgggaattatacacactggcttctagacactagtcatatatctagaaagggggaagatgaaagaatgtcatcatattctataaatatgtcaaaatgttaaaatctagtaagtatgagaagagggtacatgttgcctgtaatattttttttatatttctctgtatatttgaaatatttaataatacaattttaaatttgaaatatcttctctaaagtcatgataaggatgggcggggtggctcacgcctgcaatcccagcactttgggaggccgaggtgggtggatcaccttaggtcagaagttcgagaccagcttgaccaatatggtaaaacctgtctctactgaaactacaaaaattagccaggtgtggtggcatgcacctatagtcccaactacttgggaggctgaggcaggagaattgcttgaactcgagaggcagaggttgcagtgagtcgagattgtaccactgcactgcagcctgggagacagagcaagactccatctcaaaaaaaaaaaaaattggctgggcgcggtggctcacgcctgtaatcccagcactttgggaggcctaggcaggtggatcacaaggtcaggagatcgagaccatcctggctaacatggtgaaactccgtatctaataaaaatacaaaaaaattagccaggcatggtggcgggcgcctgtagtcctagctactcgggaggctgaggcaggagaatggccatgaacccgggaggtgcagcttgcagtgagctgagatcatgccactacactccagcctgggtgacagagcgagactccatctcaagaaaaataaataaataaataaaaataaaaatcatgattaaaaacaataggctgggcgcgatagctcacacctgaaatcctagcactttgggaggccaaggcgggcagattgcctgagctcaggagtttgaaaccagcctgggcaacatggtgaaaccccatctgtactaaaatacaaacaaacagacaaacaaaaaatgaaaacaacaacaataataatggctaagaatgtttgtatatgaagtcatttttaaagacagaaaacaagatctaagcaagtggagagacatgccagtactccagaaaggatagtgttaatgttaattcttagaaaaattaatgtataactatgatgcaattcccattagaatcacagtgaattatgtcttggtccattgtggctgctgtaacaaaatactatagactggatagctactaaacaacataaactgacttttcctaattttgaaggctgggaagtccaagatcaaggcacaggcaggtcagtgtccagtgagagcccatttcattgtttatttacggtgccttcttgttatgccctcaatgggggaagggactaggaagctcccttgggcctcttttataagaggactaatcctgtttatgggagctctgccctcacgacctagttacctcccaaaagctctaccttttaatactgtcaaccttgggggttagggtttcaacacaggaatttggggagggcacgaacattcaaaccatagcaaatcattttacaaaaactacatgaaatgaatgtaaagttcaaatgaaaaaataaatgagtgtccaagaataggcaagaaaactatgaaaataaaaaatagaaacagggagaattgccctaccaaatattaacctacattataaagtcactataatcaaaacaacattaaaagatgaataaaaatgtatctgtggatcagaaattgatcccaaaatcaatgtaagtatatataagaacataaaatatggacagggtactatttcaatgcagtgggaaaaggttaattttttaaatataaactggccatcaatctagaagaaaacaaaactaaatccactatctcatgccattcacaaaaataaggttctgacagtttagaaatttaaatataaggaacaaagaatatgaacatgcaatgcacaggagagaaacatgtgttttataatattatgaaaatacactcagtgtcattaaaactcaggaataagcaagctgaatagtttgtggttttaccaataacttggaatatgatgtagctttaaaaaatattgatccagagtctcacttactgagacagagagatgaaaaaaatcacactgcttaagtgtgattttttttatcaatcataaaacacactatacatgaatatagcaatttttataggtctgtacaagcataaggatgtggaccaaggtacatcaagctattaccattatttatttatggtgtgaggatggaagggactggaagaaagttattaatgaatacttattatatatatgtatatatttcactttttaaaataagcagacttgctgatataatttaaaaataataattttaaatatttaggcatattgagaaaagaaaaccaagggaggctttgcagacactgccaccatcgggagccctgtactatcagccatggttaaccccactgtgttttttgacatcgccgtcgatggcgagcccttgggccacgtctccttcgagctgcttgcagacaagtttccaaagacagcagaaaactttcatgctctgagcactggagagaaaggatttggtaataagggttcttgctttcacagaattatcagagtttatgtgtcagggtggtgacttcacatgccataatggcactggtggcaagtccatctatggggagaaatttgatgatgagaacttcatcctaaagcatacaggtcctggcatcttgtccatggcaaatgctggatccaatataaatggttcccagtttttcatctgcactgccaagactgagtggtggatggcaagcatgtggtctttggcaaggtgaaagaaggcatgaatattgtggaggccacggagcgctttgagtccaggaatggcaagaccaggaagaagatcaccattgctgactgtggacaactctaataaggttgacttgtgttttatcttaaccaccagaccgttccttctgtagctcaggacagcaccctccaccccacttactcgcagtatcctagaatctttgtgctctcgctgcagttcccttccatgcctagctggactgcagagttgagtttatgattatgaaataaaaactaaataaccaaaaaaaaaaaaaaagaaaaacaagggaaaaaatgaattggacttatgaggtataatggctattatcctagagtggtggtagaagaaaggagaggatggagagagattaaataaattagttgtttactgaaacttttttttttgagatggagtctcactctgtcacccaggttggagtgcagtggtgtgatcttggctcactgcaaactccgcctcctgggttcaagccattctcctgcctcagtctcctgagtagctgggactataggcacctgccaccatgccaaactacttttatgtatttgtattttttttttttttttttgagacagagtctcgctctgttacccaggctggagtacagtggcgcgatctcagctcactgcaagctccgcctcccgggttcacaccattctcctgcctcagcctcccaagtagctgggactacaggcgccctccaccacgcctggctaattttttttgtatttttagtagagacggggtttcaccatgttagccaggatggtctcgatctcctgacctcgtgatctgcccgcctcggcctcccaaagtgctgggattacaggtgtgagccaccgcacccagccacttttttgtatttttagtagagacagggtttcaccatgttggccaggctggtcttgaactcctgacctcaggtgatccgcccacctccgcctcccaaagtgctgggattacaggcatgagccactgcgcccagcctgaaacttgtcaagcacaggcagagttcctggggcccagagggatacacgaaatataaggcacagaccttactctctattggcattaagtctgatcgtggatgaaattaaaacacttgaaaccatttatatataatgacgcaagcccctccaaaactgtcaggtcatagaatggatgtatcagtttgctttaccattcacctattggggagtatttggttgtttccagtttggggctattacaaataaatctgccatgaacaatcatgtatgagtttttgtgcagacatcagttttattttctggtacaaatgcccagaagcaattgctaggtcatatattgaggtgtatgtttaattaaagaagctgccaaactattttctagagtgtctgtatcattttatattcccaccagcgatgtatgagttagttttgtctgcatcctcgccattatttgatactatcactatgcttgatttgagctgttctaatagatctgtagtgatatcttactgtggttttaatttgcatttccccagtggttagtgttgaagatctattcctgtgctttaagtcaattcatttttaaaacctaaataaatgtatttaaaaaggaaacttttgctttaggaggccaaggcaggtgaattgctcaagccgaggagttcacgaccagcctgagcaacatggtgaagctccatctctacaaaaaatacaaaaacatccaggcaaggtagcgtgcacctatggtttcagctacttgggaagtgaggcaggaggattgcttgagcctgggaggtcgaggctgccatgagccatgattgcaggattgcaccattatactacagcctgggtgtcacggcaaaaccctgcctgaaataaatgaataaaaggaaacttgtggttagtggttctcagagtgtggtccctgagccagcagcatcagcatcaccatcagctgagaacttgttagaaatgcagattctcaggcgccgtcccagacctcctgaatcagaacctctgaggcgtgggttcagcgacctgtggtttaacacgccctcccggtgagaatcggtctcattcactacagatagaaggaaatggtaaaaatcaattcatccgcatatcgcctaaaatcctcctgtgggccccaggttgccacagcacacttttgggcaggagccccactcacagaggccgtgacaagaatgctcctgcccctggggttgtgcagtgacagctcacacagctccacgtggcggttctgagtttgggaagcgctgatgtagtcctactgcagcccttcctgcccttcaccggactgaggaaatccaggctctgaggagggcgagacttgcccaaggtcacccagcaacatggtcagtctcctttcccagggccctcacaatgcgtggcctgtttaaagcctgcctctattcactgctgagtgaaaaatccagctccaaagtagaatatggggaaggatactatcttgtgcagcttatgtttatagctgcagatacatgggaaaacaagtcagaaaatactgttgaagcagttatttggggagagaaggggtttgctggttttttgtgtttttaacttttctatatctcataatttttatcacaataatgtttagttacataatcaaaatgtattaaatataatattaaaaatcgacatgaagcctgatctagccacggtctattgttggcagagtcaggaagccttccagatagagcaggccctgcacctgccccaggtcacacccttaccccatggtggcctccacatccatacccatgagcatctcctgtgggtgcggccctcccctgcatccagccctgggcacccccagcccagagggcacctcatggtctgagagtccacctgtctgtctctaaagagaggaaagctccttgggacatgtgttctgcttgacgcatcacccctggcctggtacagaaaggtggacagtgggtatttggtgaataaatgaatgaatgattagaacaagtccccaaaatggtgatttcctgaggcccttctccagcttgcctaggtggaaccagttccacttttcacaggaaagccaggtgtcaggagtggggcaggtatgtgtgaatggccaggttctcgaaggctggatggatacagggcttatggcaggtctggggttggcagtgctgctgtgggagcctgtaggagggctcgtctttggaatcccccagggtatcctggtgccctcagctgctgcatggtgtgagaaggcctggcttgtggggatgcacagggtcttgtttggattggccacctggtccagcccagggagctatgcttcctgcccctcagggaaaactcacttttgatgtgtaacaacagctgcaggcaaggggaggtagaggtgtgctgggcctcggccttagaagccagaagccagttcatgcccctacgtgggaaaaggatgatatacgtgggaaagggatggggccttggctagctctagggtcctgggttatggtcagaaccatatggacttatatgagtcacttatggactcagtgacttgggctgacccagcccctccctgaacctcatcagtgaaaccaggacggggccagggctctcgacgcctcccagctccaacctctggctttctcccaggagggcaggagatcagacagaggtaacctgggctcccctgtttacgtcaacctccttgtgaagcctccctctttctgcctgtgaggtgggtggggccagaaggagaggcattcacctgtgggtctctgacttctctgcccaggtgtgcctggagagcctggtctatacccggtgctttgctacaccccacagcctggccaaagcctccctgcctccagagcagccctggccctgggaagaagctggtctctgcattgaatgacaggtagaaaattaaagtggggatgatagctctggaaaggagtcaaggaggaggtgccttcccaaggacacagagggtttttccagaatggaacttgactggtgtgggcaaacatcaggaggtgggaagggtggctccctctgcgggagctggggcaacttgcctgggccaaatggtggtaggttgtgggtagggcaggcagagctggggtgctcagagcctgggttctctgtccttgcagaggactggaattcaaaacaagtgtcccctgccctgtggctgggggacatcctctacttccaagcccagacatacaccagctgccacaagcccctgaggctctttagaggaccaatggacagccacacccacaatgggccagcctgctgggccacctgcaccctggtcagagcccatgactgaggggactctctggggacaatgggggcagtcccatgctgccctcttacaggtggatcagtccctgggatctggtgttgggctagggtgggctgaggctgttctctgccagggtgcctggtggacagcaggtagagcaacttgtccttggctttcctggaccccaggacacagctgaacactgcactttaccctggatgccttcggattctcaggggaccctgggaaggaagagggggatgccccagcaggaggccagggccctgggctatgcttgctccccccagtccctccagcaggcacctcctctccacatcaacatcacctgattcctgaaggcctgggctactgacaagagccccaaaaccctcaccaaggcctgttcttgtatcagagcaactagtatgagttcagagctgaaggggccggagagaaaactcagggctctctaagagttctcagctccctactgtggtgggccccgtagaagtccccccagaaatctgcagctgctgtaagtcactgggaggaagctacagcagacatgtgtttcccagcctggtagatgcagaggggtgtccgggccccgagtgggaggcccaaacacagccttggatatggcagtgcaggattctagacagctctggggccctgggcaagtcatttagcctctcagaaccccattcctggtcatcatggggctcttgtgtggatgtaaagaacccccctggccacttatgtcccatcagtggaagcctagcatgggtggagacccccgagactgaactcagtggtgggatccagcctgcccagctctcctatatagagcccagagccaggaggatgggcttcctggagaagcaggcactcctgtgggctggagagcatgagcaggggtccccttggggaggtggaagaggctgcggtcagtgaaggccataatgaggcagagcttgggcaaaaaaggcatgatgatcaggggatctgaaacccaacagagactggactgaggacactgtggccacctcctccaggtgtcgctcaggaggtggaagctgagctagggctgggcccttgtcctgagtaacgcctcaccagtcttggaaggtatacccaaggtggcttaatgtaagggtgcatctgcgcactctttttgagatggggtcttcctctgtcattcaggctgcaattcagtggcacaatcatagctcactgcagcctcaaactcctgggctcaagtgatcctcccacctcagcctcacaaagtattataattataggcctgagctatggagcctggtttaaaatcttaataaatatctcctcctggtctgcttccctggctgacacacatgctggcatcttgcgcctagacagacatgtctctggacttggttccatttgttctgtcgggctcctctctctcaatgaccgcacattacagtatgtggctattcttacacatttctgtatagaactgagggttagtatattaacgtcaaagttctactggtttttcgaggctgggtggaaagtttgggttaatttaggagtgggcatcttgacaatataggcttttcttccaggaacggtgattctgggacgcaggttttgcacattctggtttattgcttgactcgctgccacagagggatgtcactgctccacacgccatgcccaagagatgtcccaccttatctttctaaatcaagctgaatgttttcagctgacaggatatcacgagtgctgcggggactcactcccctcaacccgagatgaagtgaggcggagactatggagcagatccgtgctgagtgcatttgcccttcctgacctgcactgctgctggctggggctgtgtctgagctgtcagagggcattgatttggggatggggtggggggcagtgctggagagatgcccctcaccttcctcagctcctcctgtccagccgacacttggccaccaaggcccctgacttccaggccccagtcaccactaacagggtgctgcatgggaacaaagtgtaggcccagaacctggagttcaggtcactcctccttccagtcgaagcctctgcccctcccaggtgattccagcctcgttcctccatgggccaaatatcctaaacaaaggcctggacagggggtctttatctgactgcccagaaaacacacgcagaaaggctctgcatgccctctgtggcctgccaggggtaagagcctgcccgtcaaaatgcacagtcctggttcttgcagggagttgaggagcagaagaagaaacaaaggtccatctcattctttcagcaggaacctaaacttgggaaagccagacgcagtacatttcttaatcctgatacttttataactggttatagctgggtcacatgcacaactgttttccaacatctttcaacaggccacataacatcctgtaacttctttttttaaaatttttatttcataaggccaggggcagtggctcatgtaatctcaacactttcggaggccgaggcaggaagactgcttgaggccaggagttcgagaccagcctgggcaacacagcaagaccccgtatgcaacagagaaaaaccctgtctcaaaatttttttagagtacagtggcttgatcacagctcaccgtagcctccagctcccgggctcaagcgatactcccatctcagcagctgggactatcagagcacacccccacatctggctgatttttaaatttttggtagagatgcggtctcactatgttgcccaggctggtcttgaactcctggcctcaagagatattcccaatgcgacctcacaatgcactggggttacaggcatgagccaccatgcagcccctgcaaaatctaactgttcttcaggtgctccttttggacctcctagctagactgccattggcaaatgccagttgattatccacccacatttatgttaatggatttcccatgttttatttgtctagaccaggctttctccacagcagcactgttgatgtttagggctggacagttctctgttctggagctgtttgcgcctcgcaggatgtttagcagcatccccagcctccgcctgccacatgccagcagcactcctcagtgtgacagccaaagtgatttcagatactgtcaaatatccccagggcggcaaaatcacctccagttgagaactgctgacctaaaaccctctggaacaatgttagatcatggtaacgatagcgcatactgctcctgaccttaatgggaatacctctagcatcaaagtatagtagtacctgtatactactgtctgggctgttattagtacactgtattagtccattctcatgctgctatgaagaaatacccaagactgggtaatttataaagaaaagaggtttaaattgactcacagttctgcatggccggggaggcctcaggaaacttacaattatggcagaagacacctcttgccagggcagcaggagagagaaggagagccgagcaaaggggaaagcctgctataaaaccatcagatctcgtgagaactcactcactatcacgagaacagcgcaggagaaaccacccccatgattcaattatctccacctggtcccacccttgacatgtggggattattgcaattcaaggtgagatttggatggggacacagagctaaaccatattatatcctttatattagcatactgtatcaaagtatacttttctttctttcttttttttttaaatttgagacagagtctcggtctggctctggctggagtgcagtggcacgatctcagctcatggcaacttctgcctcccgggttcaagcaattcttgtgcctcagcctcccaattagctggaactacaggtgtgtgccaccacacccagctaattttgattttttttgagtatacatggggttcgacatgttggccaggctggtgtcaaactcctggcctcaagtgataccaccactttggcctcccaaagtgctgggattccaggcgtgagccactgcacccagcctgaagtataattttcacaatgcgaaaagcttgactttcatacagataatgaaggaatatgtataagatattttaatttacaagggagtcagcaacatggtgaagctagttagaggagcattttgagagacagtgtctatagtgttccaggaagtgcattctgaaatgcattctgagatagagacaaaacttgttaatatcctgtagggaggccaggcatgatagctcatgcctgtaatcgcagcactttgggaggccgaggtgggtggatcacctgaggtcaggagttcaagaccagcctggccaacatggtgaaaccctgtctctactaaaaatacaaaaattagccaggcacagtggtgggtgcttatagtcccagctacttgggaggctgaggcaggagaatcacttgaacctgggaggtagaggctgcagtgagctgactcaaaaaaaaaattgtattgggaaataaaactgtcatccttgggaattatcttttccactgcacagaaatctgtaagttaacatatatacatattctccagtatattcataacatattctctagtatatttccctatatttgtggttttcaaagcatagtctcaaattggaagtatcagcgtcacctgggaacatagacatgcaatgctcaggccccacctcagtcctattgagttagaaactctggtgtggggcccagcagcccgtttcacaagccctgcaggggattatgatgcactctaatgtatgagaaccacggctctaaatagtcaaatcatctttaattgtaaaacaagtatctgtgaaataatgctccagtatgacattaaaatgctccagcacgccacccactttatttctgaatttaaatactttgtctgtctgatgttaaatttgctgtttttttcaaatactcttaagacagtttttcatcggttcttaattttctctttttaaataaaaaatggttttccaaatctatccatttttctcttctttaacctattgataggatgaaataaaagttgaaccattcttacgtcttttttttttttttttgagatggagtctcaccctgttgctcaagctgactgaaatgcagcggtgcaatctcagctcactgcagcctccacctcccgggttcaagcgattctcgtgcctcagcctctcgagtagctgggattacaggcacccaccaccatgcccagctattttttttttttaagtagagacgggttttgccatattggccaggctggtctccaactcctgacctcaggtgatctgcctgccttggcctcccaaagtgctaggattacaggcgtgagccaccgcacccagccttttttttttttttttctgttttcctttttttttttttttttgagatggtctcattctgttgctcaggctggatggagtacagaggtaccatcatggctcactgcagcctccacatcccatgctcaagagatcctcccacctcagcctcttaggtagctgggacgacacttgtgcaccagcagaagcagctaattttttgtagagactggggtctccctatgttgcccaagctggtctagaactcctgggctcaagtgatccactggccttggtcccccaaagtgctatgattaaaggtcttatgttcttaaaatttttctttgacatggtataggatagtctagtaacttaacatactgttgttttcaacaggctagtgcttatgatttgtaaaagaactcttcagaaatgagttcaattttaccatgaattgggacattttccatttctttctattccatagagcagtttacttgtcatgagctctgtcttttgaaaacctgaaagcctgcaataaaaccagctgcacctggtgcatgggataggcatggaattgaggagagagctcaaactacggtcagccctctgtatcctcgggttctggatccttggatttgaccaactgtgcatcaaaaatatttggaaaaagtaaaataaaaaaacaaatttaaaaatacttcatacagctatttacaaagcatttacgttgtattaagtattatagtaatctagaggtgatttaaagtctacggaaggatgtgcataggttatatgcaaatactatgccatattatatcagagcatctgtgaattttggtatctctggggtcctggaaccaatatcctgaggtttctaagggacaactgtattcaatttcttctctggttattagtctattctctaatgtatttttgttgttgttttgtctttttgtttttgcctcttcaagtcaatgtcggaaacttagttgttttagacaacccattagctcagagctaccagtaagcagactaccactgcaatctaagcaacggattttttcccccatcagactggcaaaaaataagcatctattgatgttgaaattgtagggagttttcctgagcatgttaattatgacagccctttttgctaggcacctacacaattcatcaaaatgaaataaaacacccatgcacttgaagaagttatctggttatttccttatctgggtgctggttatgtgaggtctacagttaatgaacacttattaagctttatatttctaataggtacaattttctgcatgtgtagtagatttcaatagtttttaaaatgtcttttgccgcagcccgcagctgtgtataatgctattcgcttaacagtggaaaacatggcaatgacctgaatccccctggctcccgggatcctacccccttaagttaaacaaatgaaataacttccactgtctttcctaatgtcttaattcggtcctcagttaaactggcggtgggcgctgctttttttccagggaaggattctggaagacataggaggagacgccagcatttcgccctccagcacctcctgcgggctgtggtccgcttccggcctcactcgagcagaccccgccctcccagaggccgtttgtccaagtcacgtgatcgtcgaatctgttgacctggcgccaccggaaaaagaaattcccgggccctggcttcttggcctgatggtgaggcaccagaggtgaagcgaggcatgggctgctggagcgggaatgagggggcgacagtggctccggaaacggggggagggtgtcttcactggcctctccgcaaacacagtgtgtgcgggtgtgagggctgcaggtctggtagagaagagtccaccgccatcccgctcctgagacgggggcaggagtggggggcaggagtgggggggcgggtaagacagagcaggccggccggcttgtggagggcgaggcaggcagatcccttgagctcaggagtttgagaccagactgggcaacatggcaaaaccccatctctactaaaaatacaaaaaattagctgggcatggtggcacatgcctgtagtcccaggtagttaggaggctagggtgggagcactgcttgagcccaggaagtagaggctgcagtgagccgagatcatgatgtcactgcactccagcctgggcaacagagtgggaccctgtctcaaaaaataaaaataaagtggaagcatcagtatgcatgattgaagtcatgctttccatctatttttttccaccttcccttttttctgtctaaaacattgtatcttaagcttttgcctatgttatcaagtactcataagcattatttgaatggttgtatcataatccattatctggactcattgtcatttatccatctgcagttgctggagatactgccctttctgccacactcagtcacccttctgaccttgcactgtgtccagttatctactaatacccatactggtcatttaggacttaagaatagttatcatagtttttaacattccaaaaagaatgtgtcttcctaaaaatagaatggcttggtggttatacttttaaagcaaaatagacaaagccatgttgaaattaatgttttattttcttcttgtatctattttcacttctcttgtcattttgatggataaagtttcatttggaaggatttttatttcaaaacagaaatagcatatgacatgagaaggggaactctgaaaggttcaacttcctagtttactaagtttgtcacaaaagctactgatagtcaatcatgattggcctgtattgaaagtgagttaacattatgtacaacttaagcactatactttctatccgatacagaaaaataggtggtgtgtttggaaaagtattgggctaggagtcaggaagcttgattgttagtctcaaccctgcttcttgagctgagcacccctaggcaataattcagcagctatttcttaaatacctaaatgaatttcaggctttgtggttgggctgggaatatagacatagatactgcattcatgattctccaagcctcccttcttcaccccggctcacagtgagctttcttatgcattgtgtaaatttgtctcctaacaggccccaactctgtctccaacctccttcccagggcagttgtgaggatcagatgagggagaatatgtgtgaaagcaaattgtaaattattttaaaatgcaataaaaatatgatccatggaaaattatttaaagatccttattaaaattattaaagatccttagaattttaaataaacagtacattaggccgggcattgtggcttaggagagcgctgggtcaaatcagtcccctccagctacgcattgcctggagctgctctccaaggacccctcagccacagaaggcgctggtcctcctacagtgctgccccacccccaccaccacagcctcctgggggtgcagtcaggggtgccctccttcaggctctgcccctgcacccactcctacacaactactctccctgccggcagccccagagaccagattggtttgggcctctgcctccgcaggcccgaaccaccatctcttctgctccccagaaagccagctcccagcacacaggcagcgttccctcttcattcctcaacacagagggcccctcacaaccctctcagcagatggtagagctccccacgcatcctcttaaagaggcttcaccgttgatggccacaagccccaccatgacctcctcccagggagtgaattttcttacatgtctcccaccagagcagggacaaaataaaacataaaagcagcagctgttaaattatcagcaacatttcctactaggatcaactcacggagtgggcagtgtattccattaggtggatcagtgcaggggttagcaagcgttttctgtaaagggccggatgggaactctttaaggctctgcaggccactgggtctctgtcaccacctactcaaaccctcccctgtagcaagaaagcagccctagcaacatgtcaacagataagcgtggccacattcccagaaacctttctttatggacatggaagtttgcatctcacgtaattctcatgtgtcacaagatacgactctactttccatgttttcaaccatttaaacatgtaaaagccattcttagcgcgtgggccacacaaaagcaggcagcaagaaatttggcctttacaccaacagcagctgacccctggatggagcattagagcttgggtgtgtgtcccactccagggcttccaggagaggggatgcaggccgatgccacctccacccctgtcgctctaggggagaaggcagagctggtgctgtatgaagtttggctgcagatcctgggccagccctacaccaaggccttggaggacaaaaccagccttgagttctgggcacttcaggggcaaccgacaagatgggtgaagtggcgggatgaagtgggggggcggggaagaagcctcgggaagatgggggatgactggacaagactttggtagagctgtgaccctcttcatcctctcctgaccccccagctgaccctcgtcctcagatctctgcagaactttgaccagtggtggtggaggaattccggtgggtccagggtggccctgggtgacccagggctcagacctgggttctggggttgaaggcaggaggctggaagagatgacctcccttaggccccccaggctgcccagccccctgaagtgggatgatcctcccaccaggctggacccactgaccgtcagagtgggtgccaccttcttcagggcggcatcagcccaggctctcgtgtgggtctgcacaccctgggggaggcagagggcctcttggtagacacggtcatctcagacctcggtcagtacctccttccctctgcaggccccctccctctgtccatctgcctcctcccttgggcttgctgcctctacatgccctgatctgaaacctgcctcccctcctcatggagccctccaagatgctcctagccccagctctctggtcccgcagcaacttctggtgccagattctgccttctcagaagtctgggaggcagggccccacctggccatagccttcttggtctgctctaggcactgctagccttgaagcctccagcctgctggatgcctccatccccggctatgctgtggctctcctcattctaggcctcctgctcgtcacattcacccttgtcctggtgagtgtctggctgggcccaggctccttcctgaggggcaggctgagcctttgatgccttgagccttgagccaagctgaggagtgagcaggcccctttacacccctgattcccccacccaagcccagcatctcctcatcctccagctggggctgcagggtttggggccagggggctgggcctgatcccagtgtccccacccttcttgtcaaggtgctaaagtggagggcctcccatggggtgttcagcctgggtgtgtagaagcacacagtgtggtacagaggaccctctccagacaggtaagtggagggcggttctccctgaccccaccccaattgtttgttctgggtggggtccaccgcgccccctgccaaggccttctgcaaacactccccaggggctgttgtgggcagcacctgggtggtgcagttggtgtgccagaaaagctccccagtactgggcagtggcccaggcagtcaagcagactccctcaagcaggccccacctacccctcgcctgttcccagctgcctcccaccaaccctagaaatgatgctgggagctgacagaaactgaacttaggagcacaggaggccaggagacctgggacagagaacaggaggtatggggagggaatcttccttcccccacttcccactgcatgagggccagacagtggcacctccaggtcctggaaggacatgtgtggacccaactcagttggccctttgtcttatggcctttcttctccctcccccggggccaggtggatgtgggaggagacgaaccaccatcctgggtgcactcagactcattccccactcctggccttcactccctttcctctacacacaggtgacccctcatgctgctgctccctctgctgaaacccaaactgcaaacctctcctctccctgccttcaccttgccccacggcttccacagacagtgcctcaaccccgaggaatgaatccgaagttccaacaccactgactttcccaggaactcagagccagagagggccaaggaccagctcgaggacacacagccagggcttcttccctccgaaacccccaaggactggacttgcagggctgggacagaggtggggtgggggaaagcaatgccttgtcaacccacgtggggagccccactcccatccccaaggtgcataaagttgaggaacacccctgctcccacgtccatgctcattcagggccctgctccaagtgcttggcactcacaccagcctcctgccctccacaggtattggtctcgtttacagatggggaaatggtggccaagagcctcccccagcacatatagctagaccacacagaggacttaggcacagctggggggtccgcagtctctgctgcctcacctgccaccaaagtgtggtcctgctgccaggtggcaggaaggggacagaagcccgccccaaagagggctggggcaggggcacccttacgcctgcctggtctggcccagtagggctggagagactgtcagtcctaagagaaacactggccttttgggagtatggaaaagtcaggaagcaatccaaagttggtatttaaaatattgatttctagatatttagatggtcatctggtgtgaggagctgggagggccccagggtagagtccacaagaggaggaagattgaaaaggggtcagagtggaaatgggagctgctgagggcaaggcccaaccccctccttgaccccccaaagccagccacagagccagtcagcctcaggccagagggtgtgagcaacggggaccctggctgctctacagtggatcagagccactgggtgtggggagtcttccagggcaggtgtggggccgccggggcaaggcaagctcccagggcagagactgaggccaccccctgcagccccactgcaggggggaacaccgggataggcaagggtcttaacccagaaagccccagcagctcccgggcccatcaggacaccattgaggcttggcggtggtggaacccaggaatggtctttgaacccatgacctggaagggggagccaaggatagtcctggcctgaaggctcctctacctgcaggcagtgtggaggcccagcgaggggaccccaggaacccagaccatgagcttacgtggccaaagacagcagccagcaccaagacatcaaagagggcgggtagaaagatcatcacataggggttgactgcagccggcaccaggttcctctgtacttctggaacacacaggcctctccttcctatccctgaagcgcccatgcccccaccccggcaccccgaaaaccagcctaacatatgcatttgtcctgggtcagccccactgtccaagcaactgcaatttctgactagagagccagggcagggcagggtgtaggaggggtccctggaagatgcccccagaatgccctgatgcctaaaacattccccgttgggccttctcagggagggagggttaagacagccttgttctctccagctacctccatcaccactggagcccttacaggcgtcaggggagagaattggctcaatggagccaggaacagcatggacacagccctggggctgaggctaagtgggctctgggagaccgtcactctctcttcaagctttggtctcctggccctctacaagccaggctgtttcaggctttgcgttaggccttgcacagagacagagttgaaacacagctggtggacacagtgggctttagggagggggcacgtacctgggggtgggggctgggtaacagggaacggaggccctggggctagcatggcctgtctggaggtggcacaatgggacctgcaccacctgaggacagagggtccacctggaagactggaccagccagatggccaccaagctggatggccaccgtcagagcctgcaggacagcagagggggctgggaagggacagaggacagctgaggggcagggaatgtgggttcctccatacagacacatgagtcttccctaagtgggtcttccccatgggggtgagggggcattcaagacacacctccagcccacctcaaaccatctcaggaggccaccaccaactcacacaggccagttgcattgtcacagtgaccccagaacagcacagccctgtccttcagatgaataaacagagggagagacgcatgtcacagccaggagctgggactcagacccaggtccagctgcagtgctttctcgatggctctgcctgcacctcctccaggacttagttcctgctaacaagtgagcacttgagtacaagtgaaataggtgctattatccctgtccagctgtctggctgctggggaaagggaagcaaggcacaggtgacttgcccaaggccaaagtgacagggctggttcaaccccatctgtctcagccagcacatccccatggcagaggctttactgtgatccaaacctggaaggtggaactccttccaatgtcccacccagggcacagagtatgcagccccatgtttggggaagtgaccgggtggggaggtgacagtgtgggaaacaatccagctaggccaaggcctcatggagcccagggttccctaggaccaggagagctctggagcccaccccgacacccattggaaacctggaatccgcacctgcaggagatcaggagaggggtttggcctccgatgcacctgcagcaaggtgagacaggcacaggtgggcgccctgcttccaaccagcgtcaggagagcaggaagcagatctcctgcctgaccttcctctcctgcctcccccaagcagaggagaaggggcagccgcccatcaggccattgcccagattgaagccactgaagctaggtcccaacaggtgagtgtgacccctgactatcccaggcccggcccaatgcagtcctgtctctggtgaggacctggtagacaggagatgtgacatccccaagtggctctataaacctcttattgaggataatcaaggaaatgggcaagaccatcacgctcagcaaagaacctggcaggcacgagggggaccaggggcaggcaaaagtcagtttgggcccaggcctggcccctggaaggatggtggatgaggggccagccacggtgaaggggaatggatggccacgggctgggtggtcaggactgtcagctcctgcagcccctgcggaatgtctgcccaggcctggctctgcgctcagccttctgcctggagccacaggtgcctggacaccagcctcaagtagggatggtggtaggaaaggcacttgtggccacacgtgggcacctaagcatgggacagaggggtattatgccccaaagagactatagaggccaagaacttaagcaggtctgacaccatcaataaacccccttgtcctgggtcacatcaattaagtcagcgcctaccctgaccctgaagctgcagctcagtctggttgagactcacaaagagatgttagtgctgggcagggggcctggcccagcctgcgatgtccagcaaagctgtgggctggacaagaatctctgaagattagtccaggacaaggacagctgtgtctgggcagggagtgggggcaatgctcagggggcaggaggcctgaggacctttaactaggtaggatgccaggtcaggacgtgcagaagggaaggtggcatgacagcatcctgcccgaggccaggctataaacctcggggctgccctgtctagcctaaaccatgctgccacccagatgccatccttcaaatgtgaggctgggctgggagagcccccagaccccttatccctcccgccccaagctggttcccatccctcaccagaaggaaagtgaactcttctatggggcacatcctgccaggttctctatcacctgggggaaggggttggggggagggggagctgcagctgggtgagaaagagcccaggtccactctgtccctacctgacaggtgacctcgggcaagctgctttctttgcctggggccaaggagagtcacaggggaagggccaggttaagagggctccaccctggagcccagagctacccacagagaaaaccgcccatcctcttgattctgctcccagctcatgctgctgggataacatcccccccatcagagaggccgtgggaggcagaggctgacctttgctccttcaggcacctcagcaggtttgggtccaccttcatcatgatcagggagtgggtccctgggatcacaaaggtgaggggcagcttcttgggctccaggtgctccaaggtacaccctgcagggcaccagagctagaagggcattggggaggctgggtgcagtggctcatgcctgtaatctcagcactttgaaaggctgatgtgggtggatcatgaggtcaggagattgagaccatcctggctaacatggtgaaaccccatctctactaaaactacaaaaaatagctgggcgtggtggcacttgcctgtagtcccagctactcgggaggctgaggcaggagaatcacttgaacctgggaggcagaggttgaacagggctaggacctgagctctgcctggccatggtgactctgagccaagtaaccctacattagtctcagtctgtcactgtgtctcataggggatgtcagcattacctttggagtcaaagtaggtaagccagggtaaccagagttccctgcagggaccaagaccaaaggatgcaggggtcaggcctgtcccagaaggtcaggctgaacaagaggctgtgtcaagctggggcagctgaggtcctgcccttcaggttataggcatctgggtcctggtctagaccctcatatgccatccagagacccaaccctagggacaattcctcccaagctggtagaaagagtagatcattgtactcaccgcaccaaaagctctgaaatgatagggcctgtgggtggggagaaagactcttcaggaaaatgttctcaggggcagggaaggtttgagctggatcttagggcagccagagaggtaggtgacaggccccctcacaaagcctgtcagataatgcaggagggacacaggtgtagtggtgggaatgttctggaagacagcaggaagcctcccactcactgatggggctgagtgaggtcaggtccacacaccaggagaagctggaatccgcacaccggtgcactttgttttttgttttagagacagggtcttactctgttgcccaggctggagtgtagtggcacaatcatagctcatcacagcctggacctcctgggttcatgaaatcttcccacctcagcctcctgaggagctgggactacaagtgcatgccaccgtgcctaattttattttttgtggagacagtatctggctatgttgcccaggctggtctcaagtgatctttccacctcagcctctaaaaacactgagattacagggacaagccagtgctcctggtcatgctagtgcattttggctgccatggtgcacaggaggtatgagctggggggtagaatctgctcctggacctctacccaggcctgcacccagactgactcctgggctgcagggagcaggtgtggagagaatgcagtgagcagagcgggctagccagtgatggagacccaggctgggactaggagagatagggctgcaaccctcggcctagtggccctgcccaacccactggggccaagatgacttcctaggagccaggcatggaggccagcatgcacctgaactgaggacagaagattctgatgagagggagggggaggcctctgacatagtttggatacttgtcccatccacatttcgtgttgaaatgtgatccccaatgctggaggtggggcctatagtgtgaggtgtttgggtcatggtgggggatccctcatgaatggcttagtgccctccccatggtaatgagtgagttttcttattttttttcttttatttatttatttatttatttatttttgagacagagtcttgctcacagcccaggctggagtgcagtggcacgatctcagctcactgcaacctccacctcctgggttcaagtgattcaatgagtgagttttctattagttcacaggagaacaggttgtttaaaagagctgatgcttcttctctcttgcttcttctctcaccatgcgacacgtctgctccctctttgcctcccgccaggagtaaaaacttcctgaggcttcaccagaagcctagcagatgcttgtacagcctgcagaactgtgaggcaaataaacctcttttataaattacccagtctcagggccaggagcagtggctcatgtctgtaatcccagcattttgggaggctgaggcgggtgaatcacttgaggtcaggagttcaagaccagcctggccaacctggtgaaccctgcctctactaaaaatgcaaaattagccaggcatggtggtgcatgcctgtaatccaagctacttgggaggctgaggcatgaaaattgcttgaattgggaggcagaggttgcagtgagccgagatcacgccattgcactctagcctgggccacaagagcgaagctccatctcaaaaccctgtctctactaaagatacaacaaattagccaagcctggtggtgcatggctataattccagctactcggcaggctgaggcaggagaatagcctgaacccaggaggcggaggttgcagtgacctgagatcatgccagtgtactccagcctgggcgacagagctagacttcgtctcaaaaataaataaataaataacccagtctcaggtattcctctagagcaacacaaaatgggctaatacagcctccacgcttggtgcccactggacctgacactcagggaagggctggtcttgactctgccattaacagccagactatgacagagttgttcccctgctctgcctcagtttgtcctctctcagctaagcagagcagggataattgcttctcatgtgggccccaggacaaaacaaagccctgagtcccacaggaaggtagatgggttatgtccaagggaagacagacctgaggcagtattttatgttcccgaggtggcagaggtacatggagaagatgcttcctttgtgggccagggagaagggaagataagcagagaggtgccagacacctgcctcacccctacctcccccaccccatgccaggcccattcccacttagcccccaactcaggcagcaccattctacttatggtcagcatgacttcccagccaagctgatgaaagctgacagcttggattcatcagggacagcatgtagtataggtgatgtgcaggacggaagtggagaggggacatgggagccacggtgtcaggtctggggctgccaacatggtacctgccttggctgtaaaaaaaaaaaaaagtcactgttttggggttttctggatgaaacctctgattccattttttaaaaaagggtcgagacagtatgtattattgattcaaagtcataaccagatgcttagagtaaatcattgcatctattgtttcaaaaaccaacctcaggattattaaaagttagttttattggatttttctttagctgtgcttattcactcaggtgagactcactcaggtctgtcatttccaagcccatgttttactactttgtaaccctatttggaaggaaaactgcagctaagattatgacccatcctgccatgaaaagtttcacacatatacaccacatataccccccaccacagtatgatgacacagcaacccaacctcgggcaaatggtaccactgccagcaaatgcatgttttctttatttcttcaaaatgttttttctttatttcttctaatagcagcaaatgcatttaacattttattgagattctcaacagctgtcatttggtttgtatagcaaattgtttacaaagtaacctttttccatttttgatattttaatgaaaattatgttcttcagttttaaagccccatccctctcccaaagaaaggttaataactaactaccaagtaatgattatttaggaaaagaagaaaagcaaaaccagcttgtaaacacttctggaatgtgggtaaggggccaaagtcaagcccttctgggcccagtgcaggtgctaggcttgcctcgggacaccatcagcacttccccatccacaacatcctcaacagctgggagccatgtgtggacccagggggcttcctgttccacaagctcccctctctttttcctctccacgcttgctgttgggcctcccttccaaatctgcctaacaaaggcagcaggatctttaatactgttcagctttgtcaatggagacaggatactctagaaagttgagagatccctggtccagtctgggggaggaaaaaatatacagtgtagcatagatggttttacttgtccattcagacacatgctcatacttattagatggatgtatcagatgcttcaaaagtcctgatgtgtagtagcacaaaagctgcttgtaaaaaaagaagttgcaaaatgataaaaatttctgcagcagttcaggctcctgatgacaaagctggttctgataagtagttcttttgacatgcacagcagctttcactgtaagtcctgtgttccagcggtttcatttagaccataggaagttgaaagtaaagtttaaatgttctctgctgacaaaatgtggtatatatccatcaatggacttctactcagtaatgaaaggaacaaactaccaaaacctgttatatgtcatggaccaacctcaaaaacattagctaagtaaaaaagccagacacttattgtataattccattgatttgaaatgtccaaaaaaggcaagttgatagagacggaaatggtctgatttacctcaagaggtagggattcaagctctctagagtacatgtgatacatacatgagaaaaaataaggaaaagaaaataaatttatatgtaaataaatgaaaataatacttctccctgattataaagaaaatcactttctttttgtaataatttggaagacaaaatatgaagaaaagtcttaaattttgccactcaaaacattctggtttgttgctttttgtattttttatgcatatgaacattttaaaaagtagaattgtaatatatagtcttttgtcactgtgttttgggcatatttctatggcagtaaatatatccttggcatcatcctctttaaaagcccgatgtatattaagttaatcattgccaccccagaagtaaattttcttatacaaatatagtttaatggacgcaagcaagcatttttgggctgaattcatagaagtagaatttctggaggaaaataacataaagcagttttaagatttttaatagaaattttcaaattatcctgcagaaaaattggttcagtttatactcccaacaggggcagagctccagtgtccccttccatttgtcctctttgctggtatttaagcagaaaatctcattgttttcattacatttatttggtttctagtgcttttgaacctttttttttttttttttttttttgagatggactcttgctctatagcccaggctggagtgtaacagtgtgatcttggctcactgcaacctccacctcctgggttctgggttcaagagattctcctgcctcagcttcccgagtagctgggattacaggtgcccaccaccatgcctggctaatttttgtattttttagtagagacggggtttcaccatgttgatcaggccagtcttgaactcctgacctcaggtgatccacccacctcggcctcctaaagtgctgagattacaggcgtgagccactgtacctggccttgaatcttttttatatgcttattggccatttttattcttgtgggaaatgtctgtttctccattgcctgttttctggccaacctccaaagtcacatttcacttttatcctgttgattgaaagcattttaacttagtgattttttaacataaccaggagcaggacagactgtaattatctagatcttgctctgtcacccaggctggagtgcagtggcatgatcatagctactgcagtctcatactcctgagctgaagcaattttcctacctcaccctcccaagtagctaggactacaggtgtgtgccaccatgcccagctaattttttaaatttttttatagagatgtgaattcgctatgctacccaggctgttcttgaacttctgacttcaagtaatcctcccaccttggcttgtcaaagtgctggaattacaggtgtgaactactgctcccagccaagagctcattttgtttgctagtggtgttcttggtatctttttatatttgaggctttggtgctagtgctgaagtattacactcaccatccgaggtttaaaggacttttgcggtaatattgaacagatggaactgttaagttctgcatctttgcaggcatacaaaatgtgcctaccaggactctgctttatagccattgatagcaagaagtaatacagtaaaactttgccttactagaggctttgaaagaatggagtattctgatttaattctattaacttggaagtatgaaggtaaaaagaattcaaaacttacatttcctgttgaatgcaatttgaaaatatagccaatgattccacttttcttctctagtaagtttggacattctgatctacttgctgttttattatagaactgctagtgtgcctgagacttacattgtgaagacactttttaaaaaacttgagcggtaagagggtgtaaatggtattgtgtgagatcaggctggatgagaactgacacttgtaaacatactttttaggctgaatctctgattgccatttgttttcttatttaactcataaaaataaaacacattggatggagggtgggagtaggaaggagatttatgtcttttaattgcatgtcattgtttcatatcaagacagaacatatggtatccttggctttggacctacagaggaaacacatttttctacctgccgtatgccagaggttcttgaacacctggagggatgactgcagcacagattgccgagccctactccagagtttctgattcaccaggtctggggtggggcctgagaatttgcacttataaaaggttctcaggttctgctggtgctgccagtccagagactacatttttgagaaccactcttgtctactaactgtaaattgtagaactctagaacaaagcttagtttggtgtaggaaaagacgctcacaggttatggagcaaatcatgaaagattcaacccttgatcccagcctagtgtggaattcaggtaacaatcaatacacagtgacataacacaattcttggttttcatgattgcaagtcatagccaagtatcaagtgagaaattcagtttcatttgcaaggcttagagaggccaggtgattctagaaaaataggccttgtatttactttaaaccagtaaagaactttgagtgcttattaaatggcaagctttgtgtttttatttatttttttactattttattttttttgaaatggagtttcactctgtcgcccaggctggagtgcagtggcatgaccttggctcactgcaaactccacctcccgggttcaagtgattctcctgccccagcgctgggattacaggtacccaccaccatacctggctagtttttgtatttcgagtagagacagggtttcaccatgttggccaggctggtcttgaactcctgacctaaggtgatccacccacctacgcctcccaaagtgctgggactacaggtgtgagccaccacatccagcccaaaagctttgtgtttttaaagatattagacatgtttcttgttttttaaaaaatcttaacaatgtaggagaataagagaaatgtttttccaaaaaagagaaatcatggtgatcattttaccttattggaatgttggataatatagtccgcttcattattcatcaaacatgctatggattttccatttttataggatttatgtctcaattgaggtaatactggtaattcttatactccatctgaagatgaaaaatgtaggccacaatcatagaccatgcataggagctggataatgaagacagctctggaggaacatgtagacacacacacactgacacacatatatataaagtataaatacatattttttaaagtttatttttaaagttttaaagcaaaagccggcccctcccctctcccagagtaggcaggccccacccctctccccaagtgggtggggacagcatttgcataggcagctttccctgtgatgccacaggttcctcgggacaaactgctgcctggccatgcctcctttccctttcatctttctcattgaccaatgggcttggagcattaaggccacacccctattctgtgttctagtggggccctggttacgcctcctctggctcagtcacacaggtgcctgatacgtgactggaggtgttcgctgatgtggccccaaccctgccttcctccccaccccacgatgttagaagaaactcaacagagtaaattggcagcagccaagaaaaaggtaaaacacacgagttcatggccccccaacccagccagagatccctccaatgacaagaccactgctagagtccataccactcctgaggcataccgggctgggcccccccaatttggggcctctggactccccccaccaaagtcttgtcagtcagccctgccccttcaagcaagcagcccagcccctgccctcaccaaccaccccagggtgactttgggtgggtgactcctagtgctccctgctccacactctgccctcatgtcctgccaccccaagcctgacctccctgggttctttgggctcatctctccaaggacctgggtccccagccccagcccctcccgtcaccagtcatccctgggtgactttgggctggtgattcctggggttccctgctgcagactctgctctcccctcctgctgacccaagcccaacatccctgggctatttggactggagtctccaaggacctgggtcccagccctaagtccccctcccccatcgtggatcggtgactcagccatcacactgatgaggtttcccccacccccaggaggagtggaatgtagtgatgtcacagtccccctaggaactgtcattactgctgcaagaccagcctttgatcttatgacccaatcccctaagcattctccccccatttctggttcctctggttgcagcacaaatttccagctggaaggggaatggggactatgggacctaagagcaagaggtttcaggctgctttattcccttcacatagacgttgacagtgtgaaaagcctacacttcccccgtgagctcaaaatgttgacagtatctctgggtgacaatggaaaatgggtttggttttgttttctcccaggcttctactctccagagagacttcaacatttttttctgagttctccacctcatattctaattctccatggttctgggaccagactgcccttcagtcagtggtctctgaagtgagattagctcatcttctatggaatagatcttggaaaactaaacttgacagcttgaatcttcctcatatcatctcaacttggggtacattgagtgccacaggataaatgcgggagatctttctgaagcatcagtttcccttgattctcttgagacagaaaaaacattaatatacttagggatgaccctcacataggtttctaagagtataccagacttttctctgaaatgagatgggttgtactctttctgataaattcccagatttaacaaaaaagctgccttctgccatgaggacacatagatataaaagtttgagaggtactggtgcacttcttcacactaacagacatgtgaggatgtatgactctaaaccacagagtgtgcagttcctgcctacttaatgtttacttttctacttctgcctctggttttggtccctggcagctgctgattcatggcaaaaccccagagcttggagtcagaagactgagtttaagttccattattgccccctccttttttagccataatatcaatctctctcagtcactaagtgattgtgacaacacattgtacagttgttagtggcattaaatcagatggtgtataagagtattttgcaaaaactgtaaaggaggctgtggctgtagggactggtagttctcatgtgtattactgttcttctttcccacagctaaaagaatatcagcagaggaacagccctggtgttccagcaggagtgaagatgaaaaagaaaaacactggcagtagccctgagacagccacttttggtggttgccactcacctggggctgtgagtcttggctggccaggctcctggggacagggggcccaaggggcagtagagggtaattgttgagattgctgggtactggttaagaattctgggtttgaatcctgcttctccatcttctagggatctgatttacagcaaattgcttgagctctttgggcctgtcttttcacatctgtacaataggggtagtattgtttgacttccatttgtaaagtttaaatgagattccttattgctgtttttatgttaatccctagtacatggtctgctgtaaagaccaaggatacccaggaaatggtcattgctctttgattttcctgatccccattctcaaggggaagctgggccaatgagtacagccacttgccatcaggctgtcccctataggagtcactgaaggggcctggtgtggtgaggagagtcccgggtactaggagtaagagaagatctaagttgccaccagcttgctgggtgaccacagaaaaattgcttcttcccctgggcctcagtttcctcctctgtaagatgatactggataagatcagtgcctttcaaacttgttttttagctggagcccccttagttccagtgaacccttactcagaagtctggtttttttaatggaggtggaggtctggagctctaccagattcatcacccacgtcctgggcctgaggagaggggttcagtgagcatatgaagagctgcattggtcaggtgactccactctgtgactgcattgttcaggagacttttccatctatttgttcctgccctggcaaggcagcaggtggccatttcaaagagtgggacaggccaaggttttaatctcctctgctcttcttcagcatttcattttcctgaacccacatcctcctcctaccctgactttcttgcttctctctaagacacttctgtctttctccccctgcccttgttttttccttttcacctcctgtagattcaggacattctgaaggtgctggtgtccaatcttaaccattccaatggggtagcactcccccattggataagtggaaggtgaggcagtgccaagacccttctctggcttgctgtctccggctatgcatggccctgaggcttctgtggtttgggggatacctttcctctgccttgttttatgttgctgccattgaccttcagcctgtttatgtctgcttcttcacctgcttgattgattgggttttttccttccctgcatcttttatcatcttagaaatggtgagatataccttaaagtttaaaagtaatttgggaataatgtacagagcaggcatatgggctttggagccttttttttttttttttttttttttgagacagggtctcactctctcacccagactggagtgcagtggtgcaatctcggctcactacaacctctgactcctggattcaagcaattctcttgccttagcctcctgagtagctgggattacaggcacttgccaccacgcctggctaatctttgtatttttagtagagatggggtttcaccatgttggccaggctggtcttgaacttctgacctcaagtgatccacccacctcagcctcccaaagtgctgggattacgtgcatgagccaccatgcctggctcattgctgtttttatactttctctatatccataactgtttcccatgtaagtttttgtttttttgaatttctcatttttattacttctgcatcatctgttaccctgaaggatctggaggtaagaggccctgggccaaggtgcagtgaccctgcaggccagccctccaacctcctttcacagcaggggctaggtgcccctctgccagctgagacagcccacacacaccccagccctaatgattgttctctccacctctccccacaatcctcctccaactcctcctctctgcatgcgcctcagagtcggtaccaagaactggaattagccctggactcaagctccgcaataatcaatcaactcaatgaaaacatagaatcattggtaagagtccagtagggtcccctgagtccatgcttctattcctgggctttagtttccccttggggtcctgaagaaaggggctggggggccctggtgccaagggcaaatggggagctggagcacccaggcctcacctggagggaccccagagcaaggagcatgcagcatggctcttctgttgctgccctctttgccaactctctcttctctagatatccctgctccagtccttgccacactcgccctggggttgtcgtctctcagggaagtactagcctgactggttgtcagggaacctgcgtttctaccctgagtcagtccctaatttgctctttgagtttggacaagccacctgtcctccttgggctcgtgtttccggagaaggtagagcatcaaaggtctctattagctctgagaatctgagatttaaaggcctccagaatggaaacctcagggtcaatggctcctgtctgtccttttccatcctatatctgctgtgaagaagcatacctggcccatacgtgctcagtaaatgtttgttgaatgaaggcacctttctaaatcacaaactggcagaagagtgggcatttctcagactccatctctagaggtttatgttactgtcctttcaagagaatccagattcagactttgagttctgtggctgtgggtgaaaaccaacaaagacccacatcctctgtccttgggagcttgaggagagttgaccagttcgtgttgccactgggtctgagaatgttgcctttaaaatccattgctggcccctgcctaccgcttcctggtctgggaaatagagttgagggggccactctcagtcacctgaatttgactctccccacagaaacaacagaagaaacaagtggaacatcagctggaagaagtaacgtgattttttgtttgctcacaacgtgactgctgggtttggggggcactcagatgcagaggcgccagtctcatcttgccctctcccagcctggggaagaaggctcacccctcagattccaccccatccccacagggtccctgataacctggtcccatgggtgggcctgtcctggggcattggtggcattctgggagcatgtctcttgctgtgccatctcggcctccccctagtaagagctctgtcttcctcttcctataggaaaagaaaaccaacagtgaaatacacaaagcacagatggagcagttagaggtgagtggagggtggggagctttctcctgtcctctggagaatatttctttccttctctttcagcatttgcttggcttttctcccaaacattcaattccaggcaatcgacatcctcacattggaaaaggcagacttgaagaccaccctttaccatactaaacgtgctgcccgacacttcgaaggtgggaacctgggcaccccatcatccttcaacctgtcactttgacaggtctttagggggagtcctttgggccccatctcaacctctctcattacagaagagtccaaggatctggctggccgcctgcaatactccttacagcgtattcaagaattggagcgggctctctctgctgtgtctacacagcagcaggaagaggacagggtgagtccaaccagcagccccatcccctggcagcctggcttcccagattgaggagtgagcctaaaggtcccttctgcaggacggagtgtcctgcccagaaggcagcatggtcatttctcgctacttttgtgtatggctgttagaggcagctgctgtgggtgagttggggggcactgtggagagtgagcactggatgcagagctcagaggccaagtgcttgccctgccctttcctggctgtggccttggccaagtcctaggtggggtattgggtacttatactgtgaaggtacagaagagtacctttagtatgttaccatttctgtagagagaagaaaggggtgtgtgtgtgtgtgtgtgtgtgtgcgtgtactatgatgatatacaaaaacatgtctgcaagggttcataaaaaactcaggagagagtaacagggtggctgggagactcttcccttctgtatcttctgagttttggactatgcgaatgtatcatcctttcaaaaagtgaacaaaagattaatttccccctcctatctgtgtccccacccccagcaagaaaaatgggcttagagaataggatagacctgggtgttcaaatcccagctctgtctaagtgatcttaggcaagcacttaaccttgaacactcgatgtttttcatctacacaatagaggtaatcctagtaactgtgtcatatggtggttgtgaggattaaatgggattgctagcatggaacctggtgaagcactccataacggttcaaacagtggtagtaataacagtaataacaatagcaatattatctgatctctctgggcctctgttagccagctgtaaattcgatctctttccctgtcccttccaactttactgagttcttttaaaaattgggccatgggcttggaaatgccttgatctttactaaccgagttgtatattgagcctagccctagcccttttaaggggcactgcccgggatccccagatcaaaacttctcactcttcaccctccagtcctcgagctgcagagaagcggtcctccagtggcggttacagcagaccataaaggagcaggcactgctgaacgcacacgtgacacaggtgatgctttgcagagggagggatgtggaaggaagatgaccccaggtggccaggagcaggtgaggaccagtgacagcccttcctaacttgtgtgcccattcttgcaggtgacagagtcacttaaacaagtccagctagagagagatgaatatgctcaacatataaaagaagagagggcccggtggcaggagaggatgtggaaaatgtcggtgggggtgaggtctgacccttcagcccccactttagataggtcactggatctttctgggcatctgtaaaatgggaatagtacagccagaggtggtcatgggtctcggctttgtggaggtggggacacagagggagatggtagcctgtccagccaccagcccctctctccagggccctttcccatgtgctttgggcaggctcgcacattgaagaaggagaagaagcgtgtcatacatcagatacaggagctggagaggagcttgtccaaactctctatgtgaaagtggcttggaaattggctaccgtcgggtgggaggaatcgttagcagtgaggccaagtttgggaagcctgagaggagctgtgcatcaagaggagggttttttttggagggggggtggggaatccagaggcccttattgtctgctttgtttctcagctgagcccccatccccggcacccccagcagtgacctctgtggtggagcagctacaagatgaggccaaacacctgaggaaggaggtggagagtttggagggaaagctccaatccaaggtggaaaacaaccaggccttgagtctcctgagcaaggaacaaaagtagaggctccaggagcaggacgagaggctccgagagcaggaggagtggagggtgcgggagcaggagagactgtgtgagcaaaatgagaggcttcgggagcagcagaagacgctacgggagcagggtgagaggctgcgaaagcaggagcagaggctatgcaagcaggaggagaggctgcgaaaggaggaggagaggctgcgaaagcaggaaaagaggctgtgggaccaggaggagaggctgtgggaccaggaggagaggctgtgggagaaggaggagaggctacaaaagcaggaggagaggctcatgctctcccagaaccacaagctcgacaagcagctggccgagccacagtgcagcttcgaggatctggtgggttgccccacctggggagcctgccctcatccctatctatccaggcctttgtttccccacctgtaaaatggggcagtgtagctctcacatgaaatggtacttctaaaggcacctgtgagccagagctcatcaggccttgctctgatggctgtgggggagaagggatgatttttctaacctgcctccacccttcctggtgacatgggaggcagacaccaagttctggtgtctccagctgcagtggatggccactgattgcttctctctgtccagaataacgagaacaagagcgcactgcagttggagcagcaagtaaaggagctgcaggagaggctgggcgagaaggagacagtaacctctgccccatccaagaagggctgggaggtgggcaccagcctctggggaggggaggtgccaggccaaaggcagctccagctggggggcagctgaccccagcaccctccagggcagccctatgactgtttcttgcttcctgccctctgacttttagaggtgggtagccctgggctcctcccaggtctcaaaatcatcatcccagctagaggcatggattcccccagtcataggggaagagacagtggtataagaggctccttatgccaggcatggtggctcatgcctgtaatcccagcactttgggaggctgaggcaggagaatcacttgaggtcaggagtttgagaccagcctggccaacatggtgaaacctcatttctactaaaattacaacaacaatgaaaaatggtgatgtatgcctgtaatcccagatatgagaatcacttgagcctgggaggtggcggttgcagtgagctgagattgcaccactgcactccagcctgggccacagagtgacactctgtctcaaaacaaaacaaaacaaaaaagcctccttggattcaaactggattctggcctcggttccactggtgaccattcaactacttttcatctctaggtctctgtttctttaacttcaaaaggaagttagcattttccttgcagaggtgctgaggattgaatgagagaatacatggaaagcattaggcatgtagcacacttagcagatggtggttggctccctctgcttttccaccagtctgtggcctacagtttaaatgggggggaaaaggacatgagatttgaggctagggaaggaggtatggggttctaggcaagggaggaagtctcttaagcctggagcaaggggccaggggcctgggcaggtgacagagccccacaggccctctctaccctattaatgggcccagaatctggaagccagccaccacgtgccctcatgcccagggccttcctgcaggtgaagctgaagagccaagagtctcagagtctgcagcagcagcgagactagtacctgggacacctgcagcagtacgtaaccacctatcagcagctgacctctgagaaggaggcgctgcacaggcagttactgctgcagacccagctcatggaccagctgtagcagcaggaagcttggggcaaagcggtggctgagatggcccaccaaaagttgcaggagacctaggggagggtgttgctgaggacagggccccgagggggatgacctggcaacctctgtgccttctcactctgttttccatccccttaggaaccagctgccagccaccagaaccaacagctagagacccagctaagcctcgtggctctccctggagaaggtacaggagaccactcagaggaagaggagagagccccaggaggaaggggggactgttagcagcataggattgaggggttggaagagatctttagaacagctggtcgttatgccaaccgggtgtccgcactaagttcagcatcaatatggtgacctcctaggagcagggggccatcaggttgcctaaggatgagtgaactggccagatcagaaagggagcaggtcagaactcctgcactgaccagtaatgggactgtgcctgggcaatatagcaagatcttgttcttaaaaggaaaaataaaggacagcagctcattcccctctggggagaggctggctcagggttacacattgagggtggggacagaggtaggcccagagtacctcccttgttgggttgtctgaggatccctctggccacctccccacaggagatggaggacaacatctggacagtgaggaggaggaggcgcctcggcccacgccaaacatcccagaggacctggagagccgggaggccacggtgagcctgactttccctgccccgctttgccaccttcctctgtggtccctcccagacccccttatgctcttggtttcccaccttctgatttctctggcccctcaccccttccgggagccagtgatcagacaccatttcacctgtgaccaacaggtgcgctctctgaggccccaagggaaggggctgtgctccacctccctgcctcatttgttctgtgtatgcccctacaagaatactcacctcttgccttcaagtggcatttttcaactctgctggagccagttcccaggaggagcaggcacggctatgtgggcagtggaaggtgcgaaggctgtgccacctgcacctggctcatctggtggccttggcctggaaggagccagaggcagaggccccagccccagggactgggggtgactttgtgtgtggggagagctaccaggccctcaaggaggctatggagaaggtgaaggtgagtgagtcctggcaagggccaagaaaagtaggggcagggcaggacaggtcactcccgagatgtgaccccattattttggctccagagcggctttatggacctcccgaaggagaaggtgggcaggaaggagcaggtggaaaaactagagcttggattcatccagctctctggagcgacagacggcatgagtgagcgggaggccagggcacggcagggggagctgcagggctgtcggagggaccccagcgtctgagccgtgtcctctcacaggagagtacatcactgaatatgagagccagggggcagtgccaaacacgcggcaccaggagaaggaagacatcatcaggctggcccagaaggaggaggagatgaaggtagggcgtgcaacatctctgcaggggtaggggtgggcgtgggcactggagccggctccggtgtggcggctgagcacccctcccttcaggtgaagctgctggagctgcaggagctggtgttgccccttgtgggcgaccacgaggggcatggcaaattcctcaccgctgcccagaaccctgccgatgagcccgctccaggggccccagccccccaggaacttggggctgccgatgagcagggtggtgagtagagccctcaggcggggtgggcaggcaggagcaggggaggctggcgctgccctcagacccccgcctccctctctctgaagatttttatgaagtgagcctggacgatagcgaggagcctgcaccgggagcggccggggagggttctccccatgacaaccccactgcacagcagatcgtgcagctgcctcctgtaatgcaggacacccaggagcacccaggcttgcccggcaacccctgtgtgtcattcttttaccaggcagccgagaacagggagataaacatcatcatctaagagctggtcaagaaattaaaaaaaaaaaaaacaaaaagttatggggttcatctcctacacaattcatttactccatttgaatgttagagccactcatgtttatttgtgtttctaatttacagtttaaatttatttgtaaaaagttaagggagagtgggtctttccctgatgttcactctggcatcctttagcatttttgtttttaatttgataattgtaggtcattagcacgcatatcgagtttgcccttatgtggtgggagttcaaacacacaaagacctactatttgcgcaaaactattcttgctggtttggaacaggctgccatgcttttttaatgttattgcagcacgtatattcattacagaattcagataaaatgtgcttatgttctgctattatgtttgatcgaatcctaaccacagtgagctcttcattagctcaatatgtggtttgccctcaagtgcgcaccgtttattactttgtaatatgccactgtgagtactgacatttagagttgtttaaaggccgagaactggaaacagcatttcccctattttctgtgtattggggatgagagtaataacattttggggagcttttaaaatctcacagaagaggaaagtggcctgctctggcaggtgtgtgcaggatacagtgtgtttcatttgttctggtgccaagaatgagcgctgtactgtggtggcttccttaggatttgtgtgtgctctgggctcatgaagatattgtatcatgagctgcagcagttgtaccctttctcgataacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacaccaaaaggcactgcttggcattcttcttaatgtatttagtgaggatcataagaaatcctttaagagtttaaatgtccctggaacaggcatacgggctctagtcaagaatgaattcgagtgaaggaaagctgtgtgacacttggccttcctctatgttcatggagcttctttgaggctagaagattgattttatcatctagacctctctggctaatacctattcttcagccacgttggtttctctgacataggaatttacttctttcccttgactggaaaacactttaaaaataataaaaaccattattataaaccaatatatgtgagagtacttagttgaaacaaaaaggagttttagtagacagtattatactacacatgaaaatcaacgtgaagtttatgcaacttaaaatgtttacaagctgccgtgcaatctaatgtttgtgaatgtccaagtattatgaggaaaagtgtctatacaattatagagttatatttcctcacagggttctttacaaagagtgaaatatgtttttatacctctcggtttcagttagaggcatattttgtgccatatttatgttaatgtgcctatacatgatgaatgaattatttcagtcatacattgcctaaatcataactttaagatgcttgggaaagaatcaacagctaaaatttcatgaagttctaaagtctgtgttccaaaatacgtcacattattaggatgcagggagagatgcatgtgtgctccctggggtgggcatttctagtgattagaccatctccatttttagcatttggcatcttcattgatacttttatacatacgacattaataggagagcaataataagattttacagatgaaataacagatttgcctgcagtcactgaaagagtgcaaatattgggttattgtgacttcaactgactcttccaaattgtttgaatttatcaatgtattagataaacccagtttcagaatgataaggaaaaactgttagaccaaataatgtggctaattaacagtggtacaatttctagcctgagggtttaaaatggacttaaggtcctgttcttgcctcctattttgtgaacttgccgcttttgcattatttgagttcacttgaaagacagttactttaagtccattttaaaccctcgggctagaaatcatactactgttaattagccaacttatttggtctaacagtttttctttataattctgaaactgggtttacctaatacatttataaattatttcaaaggtatttttatagttcagatcacttcacttttaccctgataaatataaatgactaggaatgaccttcagatagcctttagcacctgtaaccaatctgacaataatgtgttcatcaggtacctatggattaaatcacacactggcatatttaagctgaatgtcagtctggaaaatgaatgtactatattaactgaaataccactctttgtgtaggtattctgtcatatatttaagaaaaattaaatagcatgtaaatcgtatgacaataacctaagtctttcttcaaagtgcatgcgttcctttgcaatacctcattcagccaagtatttgttctcttcctcattcagtataaggcagctttcaatttgcttagaaggcaatattggaaggttagagtttatcagaaacatagaattttaaagtgtgagttcaactgaataaattagaatttctgtagaagtgaagaattaaaatacctatttaaatattgcaatatataataatttttaaagtatttgattaaacctgataggtttttccagaaatgaaaaaaaatcagttctaaaaccaaagctgatatttagaaaatctgaaaatgtaaatcagccctatccataatatagtttctctaaaactttatcttaaagagtcgttttaaaagaatataactatttaaaaatgtaactgctatcttaatgttttgaaataagttaaaacattttaaaatatgaatactgtagtttaaaagaaaccgggggaaggaaaagtagagaaagaaattccaattccaatgcaaagctttatttgccaagttttcttagaatgacttttaccaatttatgaattcttgtaaacagaatgtataatggaaatactgaaacactgttgcctaaagtggcataattgactgctactgtgatgctactgtaatgtaataaattattaaattgttgcaaagtgctgtttttgccttaaaattttgtgtgtcttgaaaactatggtgttaaaagtattgaaactgtgcaaatgctgggcacgcttggcatgagataatcggtttttatttttacaaaattgtaactatgcaagtgtgtttatttaaagaacacaaaccaaagttatgggataaaaaatgttgtggaatgaaaaagttacgggacaaaaaatgttgtggaaaatttgtggcaaaaaaaagttgtgcaaaaaggtagaataaagttttatgaaaagttttaaaaaagtattatgaaaaagaagttataggattaaaaaataagtcatgggataaaaataaaagcgggcccttgtcagcataagcctggagaagtggggctggagtctctgcccccaccatgtccctaccaccccttcccagtcacccatttaccattagggtagcaagacaacacccctgtctaatggggggcagacaaacagaccctttgccacctgaccagggctgagtccttacatttctggatggcaacgtttgttacttaagagctagaggctggtggagttggtttgtttggaggaggcctgatgatctccctactctcaccaaagcaacttttccctcagggcggctcccatcttcttattcagagaggcagctgaggcgggacagtggggctaactgtagagcaggcaagggctcaggctgctggggtggacccccttccgcagtgtacatataatgtctgtgtaacattttgtatatgcttgggggtagggtcaccccctgtatcatacctagcggaggttggagctggcatatggggaggaggttctaatcattatttggggctgggaaacttacttattgatagcataggacagaggaaggaggcggggatggggtcctggctgccttggtgatgtgactcctgcctggcctgtgaggtgtgttgtgggatgaccatgtgtatgggactgtcaagattttatcctagatcactactggattgccaacagatagaggaggtgggaccctgactatcacccctgctctgcagtggatttggctctcggcactcccagactgggagctggataccctgacctggcagcatgactcagactgcacgacagatacggcgtgcccaggatgacgttcctaggcctctggcagactcagattccagccccacacacaatgccctccaagttccagcccctacaccatgaaccacgagctctctgccctctctgacagctccagagagcacccacgtctgccaccttgggcatggagcctgttccaagatcccacaggctcagccatggaggctggggcgctttggggccatgggggccagccctggtacctgcgtcgggctgggacgctctgcacttacagccaggagtcatccatgggcccccgtgggcatgctgaccatggttgttttgatgtcgccgatgatgttgggcgcctccctcagcacatggtgcatgcacagcgtctcgttgcaccattttgcctgctccgtggaatcctccatcagcatgttctcgtctccacatgagtacagtttggccagcagctctgagaagatgaactccttggtctgagaatgggcaaagaaggaaggaggttgggacctgatgcctgtgtcaccctggccaccccaccaggccctgctgggactgtggaatggacttggagccccaagcatggcttttcagacgtggcttctacaccacttagactcaaagacccacctatccaccgcctttttttcactcagatggggacactgaggtccagaggaaaagtcaagtcaccagtccagggtcacagatctgggaggggacccaggacctatcatgccaccaggacacctgtctactcagtttttaatttttggagataggatctctctctgtcgctaggctggagtacagtgggcaagatcactgctcacggcagcctcaacctcttgggctcaaagtcatcctccaaggctagcctgttgagtagctaggactacaggcacgtgccaccaccaggcccagctattttaaaattttttttgtagagaccaggtctcactatgttgcccaggctggtctcaaactcctgggctcaagcgatccttccgccttggcctcccaaagtgctgggattataggcatgggccactgtgcccagtcccacgttatagttctatgggacagctctggtctggaccgtgaccctctccctgcacctggtcccacagggctggttgtcatctctgccaggccaacacagccacctgtgtccccagtgctacaggagcccctgcccccatgaggtggtgcatgcatgttgttgatcatgaggtgcatggtggtcttgggcgtgagaccaaccatgaggtcccacacggtcttgttgacaatggccacataggagtccaccaggctctgagtggtctccatttgccacaccagctgtgggtccatggagtgcatgaagctgtcggagccattctcctcggccttgctggcctgccatggagaacacaaaggcatcacggtggccaggacatgcagccaggctccaggatctcagcccttccaagggtacctggaacattgaggcacagggagaagcaactggccagaacacacacccagatccccacatgctctagagggtttcaggtctctgcctctcaggaccccagatgcccctgatcaagcctcatcttagttctgactctagtacccagaatttgcctccatttcccaatccagaaattggaaaagaacatctccaggtccctcgcttgaagacatggccagagctggtgccaggctacagatgcctggcaggaggagagaagggcatactcactttccccttgtcctgggaggcccacacaccaacattgccaccaccgctgccacctgggagcacagccaaagtagacacacacaggaaaaggggaagggttgagtgaagctgggacactgcaccccaaatttaacgtgttgatgaattcaatttgctaatattttgtggaggatttttgcatcaatattcattagtgatattggcctgtagttctctgttttggatgtatctttggttttggtttcagggtaatactagccttgtggaatgagtctgaaatagttgggtaaggtctctattttttgaatagcttgggtaaggttggcatgagttctttaaatgtttggtagaattcagcaatgaagcaccaagtcccaggcttttctttactgggagactttttattactgctttgatctcattatttcttattggtctgttcaggttttggatttcatcacggttcaatcttggcaggctggatgtgtctacaaatttatccatttttagtaagttttcctatttctttgcatacagttgtttattattattattattattattattattattattattatttttgagatagagtcttgctctatctcggctggcatgtggtgccatgatctcagctcactgcaacctccgcctcctgggttcaagcgattcttctgcctcagcctcccaagtagctgggattacaggttgtgcaaccacacccagctaatttttttgtatttttagtagagacgggtttcaccatgttggtcaggctggtctcaaactcctgacctcgtgattcacctacctcagcctcccaaagtgctgggattacaggcgtgagccaccacacccggccttgcatgcagttgctttttaatagccactagtgatcctgtgaatttttgcgttatcagttgtaatgttttcctttttcatctttgattttattcacttgagtcttctttttttcttagtcttaggcttaaagtttgtcaatgttgtttatcttttccaaaaaccaactttttatttcattgatgctttttattgttttcttcattttaattccatttatttctgctctgatctttattatttcttttcttctactaattttgggtttggtttgctcttgcttttctatttctttaagatgtattgttaggttgtttatttgatgcttttctgctttttaaaagtaggtgtttatagccataaagttccctcttagtattgcttttgtcgaatctcataggttttggcatgttgtgtttccattatcatttaagaaatgtttcaatttccttcttaatttcttcattgacccactggtcattccagagcatattatttaatctccatgtgtttgtgtagtttccaacatttctcttgttactaacttccagttttattccattgtgatcagagaagatgtttgatattatttcatttttttcctaatattttaagacgtattgtgtgatttaagatatggtctatccttgagaatgatccatgtgctgaggaaaaaaatgtgtattctgtagcccaagggagaagacacccaccctcactctgctgcaacagcactcttctcagggatggggcagtggagtgctgttgttacacaaggggctctctgtcggggagggaacagaagtctgttctgtagtgtttgccattttcggtggtgcaaatattccatggctgatttcaagctgccaccatcttctcagcctgggcttgtttgtcccacccttgagaaggctttccaggtatttgaaaggatgcgggtgttgtgatctaaactgtatctttattaggggacactccaagcccagttatgctatggttcttgcagactcatagaggaactaccttggtggtcccggataagatctggaagaattttctgagctaccaggcattagagactcttattctctacctgtaatttctttctaaaaaacagtctctgactctgtctctctgtctctgtctctctctctgcggcccccccccatctctctctctctttctctctctctctctgctgagccacttggagctgggggtgagctgacacaaaatccctatggccaccaccactgggactgcactgggtcagacctaaagccagcaaagcactgggtctcactcagggcccactgtcaacactacctggctattgcctatgttcactcgaggccctggggctctactgtcagcaggtgtcaaagccagccaggcttgtgtctttcccttcagggcaacaagttcccttaggccctagcatgtccagagatgctgtctgggagccagggactgcagccaaaaaccttagaaatttacctggtgctttattctaaggcggctgagcagacaccgaaaccatgagacaaagtccttcccactctgtctttccccttccacaggcagaggagcctcaccctgtggccaccaccacaggcgcacacggagtgctgccaggctactgtcgatgttctcttagggcccaagggctctgaaggcacttgtggtgaatgcttccaggcctgggactcacccttcagggcagtgggctcccctctggcctaggacgggcccagaaatgctgtctaatagccaaggcctaaaatcagtgaccacaagagcccatttggtgctctaccccattgtggccaggcaggtacgtaagctgcaaaacaaagtcccttttacctttccctctgcttttctcaagcagaagaagtctctcaccacagccaccatagctgggaatgtgctgggtctcacctgaagccagcacgtcgcagagccttactccaggcccatagcacactgcctgggtatcactgttgttggctattcagggcccaaggttcttgagtcagcaggtgatgaatcctgccaggattgggttgtttcctttagggcagaagattcccttctagcccagggtgtatctagaaaggtaattcaggagctaggtcctggaatgggggcctctcaattctgactggtgctctgtcctactgtggctgagttgctatccaagatgtaagacaaagtcctctttgcttttcccccttctctcctcgagcaaaaggaagaagtcactttagttgttgcaagctgcgttgcctggggttgggggagcggtggtgcaaacactcccttggctgtcctggctggtgtctctctaggtcgtgtgccccctgagtccactggctctgagcccagcatggcattaggatgtgcctaggagttgaagtcctgatggactagactgcctttcaagtttatttagggccccagggcataacagcctgccatgccaaggcttgtcaaaacccaagcctcaagccttctaactactgggatgggtgaacccctctgggtagggctggtctaaatgcttcctccatgggcaggtgtcacgtgagttccacctggttttgctttctgctgtgacaggacagcaatgagttcaaggcaaagtcccacagttgctgtattctccctcccccaggtgcacagattctcagcaccacagtgaccactgctgggggagggggaggggtgatattggtgtttcaaggctgtctctcccaccctcttcaatgcctctttcagcaacatgaagttaaacccaggtactgtgagtcctcgcctgatttttggttcttatgatgatggttttctggtgaagacagtcgttaaatttgattttcctgcagggggaatgattggtagagactattattcagccatcttgctctgcccctcctccctcacttcactttaattacctcctaatagccctatttttaaatacaatcatatagtgggttagggctccagtgtatgaattttgaggagacacaattcagtctatagcatttggacttgggaagagggaggaaaagaacacgcacaggaaagtcacagtgtaagcaacagtatggaggtggggaagttcagctcatggataggaaaaattgatccaattaggcagggcccacagggagatatggtgcggtggtgagaggtggccacatcagaaagaaccttgaatgccaggctgagatgggaggcatttcctgttgtgtagaaggtaccatgaggtgatgggtagggtaacatgatgaaaggacatttgggaggatggatctggcatcagtgatgggtaggggtgaggagtgaacaaatctggaggccaggaaactggacacatggcccagagttcaggcccagagttaggctgttcaaaggcagtttccacactgagttcccatgtggatccaagcatgcagggggagatgatttggaaaagcaaaagcattctcttcccattaccacacagtttcccagctgagctcatcaccagagtcctacaaatcagacagtcaaactaccccaaactctgtccctagaagctgtgacccagagggagcccttgtccagctgtagcccagggacaccgcagcctgagcaggactgcacctgttcccccccaggagcctcatctctgtctggcctggctttggcttccaatgccctcagctttggcttcagaatctgttgggtcagattcatgagagctctggccttcttcggtttagggatttttaaatagttttttcaagcaggcagtagatgagctctgcttgcttacctctaagaattggctagaactcacagaaggctgttatactcatagttacagcttgattacatggaaaggatacagattaaaatcagggaagaaaggtatagggctgagtccaggagggcaccaggcatggagtgtccattatcccttccccatgcaatcagagtgcattaccctcccggctttgctatgtgccaatacacatgaagtattcccagccaatgaggctccctcaagcctcagtgttctgggtttttactggaacttcatcacagaggcatgcttgattgtccatgtggctgcgctcagtttccagtctccagtacttccaggagtgacctaaagcccagactctaaatcacatagttgcttttttgccctggctagtccctaccctaaatcttattattaggctgtccatcatgagccaagatccccaggcaaagatattcctatcaggtattacatgttgacagttacctcccaggagtctaggacaaaggccagatctctttttggtcaaggttaattttttttccttattttttaaaactatacgacatgccatcattctattattcaatctttctattttatcttcaaaataaccctaattggtgggtaaggatgtttattattataaacgagatctcgaaagaaaagacacttgggcaaagttgcacagtctatctttgactcatggtgcaatactctttccactctctgagaacactgagtcctgtgaagaaggtgaaaggaaggtgtgtgcgtgtgtgtgcacgtctgtgttggtgtgtgtaaatgtatatctaataagtgtgtatagatatgtgtatgtctctgtatttgtgtttgtgtatacatgtggatgtctgggtgtctatatgcatgtttgtgtgtgtgtacacatgctcatggggaaggttaaagagaaaattggcccggtgcggtggctcatgcctgtaatcccagcactttggaaggctaaggcgagcagattgcctgaagtcaggagttcgagaccattctggccaacatggtgaaactccatctctactaaaaatgcaaaaaaattatctggacgtggtggcatgcacctgtaaacccagctactcaggattgcttgaaccagggaggtgaaggttgcagtgagacgagatcgcaccactgtactccagcctgggcaacagagtgagattccatctcaaaaaggagagagagagagtcagcagtgtgcagtgatgcacatctgtaatgccagctacacaggaggtggacggaggaggatcacttgagcccgggagtttgagagagagagagaaaatttcaataatcttgcagttagaaggaaaaacctggggctgagcacaaagagacataaagcacagcataaagaggcagagaaatgtctaatgaaaagtgacaaagaattaattagttcttatataaagaaatataggactttagcagcaggataaaactggaatataatttcttctagaatcctgataatctttgtgagaaaactgttggtcatatatgttaattgccaaaacttgcaggaccctatgcaatagaactagcaaataaaaccatctttctgaaactcactatgctacaagcagcattcaactctttctcaaccaagatttcactaacctatctccagcttccagatggtgagggaaagtgtgatgagattttatgataaattgtgcctgtctctgagtccatctccttctattgaagagaaggaaaatgaggtgagcacattacagccctgctgacaaaagtcacaagataagcaaataattattacttaaaaccagggagtcctataatttattcatgaatgccacacattctatattagatcttccatttcaatttacttgtattatttgaagctaatttataagattcaaattattcagaaaatgctcccacgtaaatagaagaaaacactttaaccagaggaagtatcatgctacacaatatggtgtggtggtgaagggtgcaggctctaaaaccagaaaacacaggttcaagtcctggccttaccaccttgggaaagttacatggtctctctgtgcctccatttccccatctaaaatgtggggatgacaataatagtgtctatttcacagagcagttttgaggaaaataatatatgtaaagcactgtgaacagcagttagtgctatgtaagtgtttgctctagttattttaacatttcagatgataaatatctaccctgttattcagatgacaagcgtccctaagctgataacatgatgaagagcttttgggtttcttaatttccatcagttttgtgagggaaaaaataccacatgaagaagagcaactgaagcaggcgtgaggaggaaacttggcttaagattggggggcttggggttattaggctttcatcttctaaaatgtcctaagctccattgataagaagacacttagtatcaatccagctaaaaaggaacaatagaccccacaagacactgagttagagacaaaaatagcagggtaataaatgaaatatggaaaactacacaaccagaaaaataaacagctaccagtacccaaaacgtggttaaatctcacaggattatattgaatgaaagaagccagccacaaacgtgcacatactgaatggtcccatttatatgaagctaaagaacaggcgaaactaatccatggttgcagaggtcaggatcctggttaactttgaggggacagcaactgagaaggggcaagagggagccctctgtgctgatgggaacattctgtatcttgaactgagtggcggtcacataagtgtgcacatatgtaaatagtaaggagttgtagcttaaggtataggcacctcgctgaatgtaagatactgtcttagtccatgtgtgctgctgtaacaaaatatttgagactgggtaatgtgtaaagaacaaaaatgtatttctcacagttctggtgggtgggaagtccaagatcaaagcgccagcaggtttgtagtctagtgagggctgctctctgcttccaagatggcaccttaaatgctgagacctccagaggtgaggaatgctgtgtcccagcatggtggaaagaacagaaaagcaaaagaagaaaaccgagctgggtagctccctcaagccctttcataaggtcactaatcccattcacgagggggctcctccttacagcttagtcatctcctaaagactccacctcttaatactatcacattggggtttaagttccaacatgaattttggaggagacacaatcattccaaccatagcaaatatactttactaagaaagaaaaaaacatagtctctaaatatgatattttaagagtttatatatttaaagctcaattttctgcttgcttacatacatatttgtgaccatgagtgtcattcttggctgagaaacatttcagtaaattttaaaaagtctcacattatctattaatatcttattcagataagatcaaatttctaacctacattttaggttgagacagaaacccagtcatttgttgcaatgtgagaatgacagagagatagtaactagcagaatccaactataaaactaaatttaagggcacaattctctactaatcactcccccagacaaatcattacttggatagcaatgaatcaactaaaaatggaagtgagaaaagttcgagtcctttttgcgatggatggatgcttatgagactattaagtgaagggggttcggaaataaggggataaatggcatactaatttgaggttgaatggagtaatgagatgaccttggaaatataagaatcctgcttaatggggcttgtctacttgcaattcgataaactaatatacgtaaattcaaggagataaaggacatgagcactcagcacaaaattacaggaatagatttagcaaagaggaaccaaagttgagataagggccactgttccaggtctgacatctttaattcttgagtcatggggatggtaaaccagagaacagagtcttccgactggaagctaaaaccagcctttggggtgggttcagagagcctgttcagactcaagatgcgaaaacagatgttgcatggtcgaaaacatcccgagtgcaagggcattttcaaagacagcggtgctcagggaaaaagaatactgtgtgtttaaaaagaaaaaaaattaaaagaaagaatggaaacaaggaggaaaaagtgaccggagtgtagggtgaccatacgttctggtttgcaaggtacagctaatgttatgtctgctgtcctggtacaattattatagtgccccctttcactctccgaagtgtcttgatttggatgataaagcatatgatcaccctattaaagagaggaaattagccagaagacctttgtgtcgattttaaacggtgtggactgatccgcagtcgcgctcttgccgctgcccagctgagcagcgtgcaccacctctgcgtcgccctaccccgccctgcctgggtctccaggaaggttggagcggaacccgcgctgctctggtgccacctgcaggttatatgggggaactgcttctctccaccccactacccaccaccccacatccccaccgccaccttggacagccttggacttggccaaaagacattaagagcacgcgaagccctggctggggagtgggctggaccctgcagtgaagcccgcgttacagaatcagacggtcccggcttaagccaacaaagccaagctcctctacttcctacccactcctggtctttctcattttgtagacaggaaactgaagcctaattcagatttttcattggtaggattgtgaagcatacagcgggagcctcccaggtgccattccccacatctctgtctttccgctaacactttagggtagtggggagcttaagcttactaagttcctactgtgtactggccagagtgggcacttttatctccagcctcgcaattgatgggaaataggtgattatacaactaggagacaggatcagagtgggctagcgatgtgctcacagtctctcagctgaaactggaacccaggggtctttgattctaaagctagtgctctttttgggtctccagcttgagtaatagttgtaaaatacaaagagcaccatgaaaatctaatatcaatccatataagactgtattgcaaacagaaacatagagtgtcttcgtgggagtgatggggaggggggagattacctcaattctatgtaacctggaaactctccgaggaaaatgaatgaagcatgaccaagtgcaatttgtctgataaaatctgtcagaacgtggggccttgtgtgtcctgggtagtgaagatgagaaatcatggtgctggacatttgctaaggtgttccttatgaaatcactcagggcctcagtgcctccactctctccatgaccccaggcagtttccccatctgtcttcatcctactgcctggcacactatccatcaaactgtttttagagttatgtctcgataaaataaaaatcatggtgggagtcatttacaccctagtgagagtcatctaagattcccttatcttttcagaccttttagctgaagttggttatgagagaggatggggagggggaaaagggttggggcaagcacttggagcttgcactgtttcttgccggtgccctggcacagtgtgaatatgtccatctaaatggagagctctatgcatgttcctctctactccctttgtcactaataccagttcccaaggcagagccccaggagggctggactgaaggacctggaggtaatagcaaacgcttggctttgggtttcaggtcaagctctgccagtgacttgctgtgtaagaggagacaagtcagttcacctctctacacttcagtgacctcatctgtaaaagactggtctggactagattaatgattttcttatttattttattattattattatttttgagatggagacttgctctgtcgcccaggctggagtggagtgcagtggtacaatctcggctcacggcaacctctgcctcccaggttcaagagattctcctgtctcaccctcccaagtagctggaactacaggtgcctgccaccacacccggctaatttttgtatttttagtagagatgtggtttcaccatattagtcaggctggtcttgaactcctgacctcaggtgatccacctgcatcagcctcccaaagtgctgggattacaggtgtgagccactgtgcccagcctaatgattttctttaggttttgcaattgttttttgttttaacattatactcaattcttcctccagcattattaaggtataattgataaataaaaattgtatatagttacagtattcaatgtggtgttttgatatatgcatacattataaaattattaaatcaagttaattaacatttccatcacctcacaacttattattattattattattgtggtaagaacatttaagatgtatttgcttagaatagtgtttactagcagtgaggaaagttaagcgggagagagtagccaaaggctggctaacaggttaacagatacaagagtacatggctgggccgggcgcggtggctcatgcctgtaatcccagcactttgggaggccaaggcggaccacctgagggcaggagttcgagaccagcctggccaacacggtgaaaccccgtctctatgaaaaatacaaaaattagctgggcatggtggctcatgcctgtaatcccaggtacttgagaggctgaggcatgaaaacaggaggcagaggttgcagtgagccaagatcatgccacttcactccaccaccctgggagatagagtgagactctgtcaaaaaaaaaaaaaagtacatggctgagtttggtggctcatgcctatcatcccagcactttgggaggctgaggtgggaggatcacttgaacccaggagtttgagagcagcctggggaacatagggagattcccatctctgcaaaaaatttaaaaattcgccatgcacttttagctactccggagggctacagaggtcaaggctgcagtgagctgtgattgcaccactgcactccagcctaggggacagagtgagaccctgtccgaaaaaaaaaaaaagaatacagctagataggaggaatagttctagtttctttagcactatagggtgactataatttatgacaatttattatatattttcaaatagctagaagagtggattttgaatggtcccagaacaaagaaatgataaatatttgaggtggtggagacgctaataccctgatttgatcattatacattacatacatatataaaaatattatactgtaccccataaacaagtacaattattatgtatcaaataaaaataataataaaagcaaaaaatctactctctcagcaattttaaagtatacattattattaactatagtcatcatgctgtacaacagatctccagaatttataagattctatttaattccattcaaagtactacatacatagagttaagaacaaaatggtatctggagcaagaaatcctcggtaaaacaaaaaaagaagaaaaaaagaacaaaatggtaataaaaggcttatatcaaaaagcatttcctctgccctttcctttcttgcattgagtcctaaatcccagaggccatcactttaaactcattttgctatttcctctggtatttatcatcatatttctaaataatgtttatgttgctatttcttgatttgttttcttcagtatctgtctacctcctggcatagctcagtatagggcttacctcccttatgaggtcttaacaatttccttgcttccaatctaccagtctgattggatcatagtcttatgaaatccaaagcatttccattattgtaggtatctaaatattgttccctaacccaactcctgcactgaaattgtctaatttctttcctttttttccctcagagttaataattgctttgtatttttttccttcatttgcttatatgtttttgtacctattacctaccttttttttttttttgagacagagtctcactctgtcatccaggctggagtacagtggcacaatctcagctcactgcaacctccaagtcctggatgcaagcaattctcctgcctcagcttcctaagtagctgggactacaggcgcataccaccacgcctggctaacttttgtattttttagtagagacggagtttcaccatattggccaggctggtctcaaactcctgacctcttgatctgcccacctcagcctcccaaagtgctgggattacaagtgtgagtcaccgcttctggcccacctactattttattttcagatgctccaactgatttatcaaatgcctagtgataatgatccaaaaactaagaaacaccagatactgtatcagacctgttattttcctggaggcttccctttctcccttgccctccatccttctgctccaatctggactcagctctcagcccatggcacatctggcatcctggcatgtctctgcaccatcgtgtgaatttcctcctgcctcttctgttgcatctcctgttccttggccccagatcttcttttttcctggtttactctctcactgtgttgcagcacattttccagtggcttcctgagaaagagtgaatggaagccaagctttctgaccctcacacattttagaatgtcattgttctaccccaactcctgattactagtttggctggatgtaatgctctaatttaaatgtaacttctcctcacattgggaaatattgctctattattttctagttcccagtgttgttgggaataagtccgtgtcatgcggagtcttggctctttacatgtgacctgtcttttctctctggaagattttagggttttctctctatccttagttttctggaatttcccaatgctgtgccttgctgtaggtctttcttcattcactgtgctagtcacctggtagactcttttgaactagaaaattatttccttctattgtgggaagccaccagcaggttcgtgtgagctggttaatcacattcttttcttccaaggacggaggtatcaaggccctgggaaccttataagtggatgtggggaaagggggcctgaggtgaatccaacaaagctgcagcacccactgagctcatgtcccagggctaggctctgcctgaggacaggagacatgggtgagacccacttcctgcccagtcccatggtggggctcaggacacacatggtccaggaggcccccagccccagctacattgacatgcacctacctgtatgcagcgatcagtgagccacaggacaacttaggggaaggggcagctccagagtgcaggataggagggaagtaaataatcatggggtggggagtggccttgtggggaaggggcaaaggcagggctgtgtgtgtgtgtgtgtgtgtgtgtgtgtgtgtgtgttgtgtattggaggaaatggggagagcatctgtagttttgtctgcccccttttttggccactgcacccctttcttcgtgaatagtttttcttctcttcatggactgagtgtctctgtctcctccaaattcatatgttgaagccctaaccctctgtatggctgcatttggagatgaggcctctcaggaaatcattaaggttaaatgaggtcctaagggtggggccctgattcagtaggattagtgtccttataagacgagacaccagagagtgcactcactgtctctctgcacaaatacaaagaagaggtcacatgagcacacaatatggcagccacctatgggccaagagaagaggcctcagaatgaaacctaccttgctggcactttgatcttggatttcccagcctccagaactgtgagaaataaatgtctgtggtttaagccacccagtctgtggtattttggcatggtacactgaattgactaatacatctccctgccctacttcaaccacatgacactagaggggtcggcagttttagagtcccagctactcagccaacccagaccagaccaagcagaaactttcttctggaattttctgaataggaactaatagaggggagccccatcctttcctcgggggcaaagccagtaagacagaagcctcatgctgccaacagcctgactctaacctcgtggggagagttgctctgagagcacaaaactgatctgcagactgaggtggagacagagacaagggaaggagcctgcaaatcctaacagcgctggtgattctgagtccaggtattcctgaggcccagctgttccctgtcctgcccatggctaacttactgaccaatgagcttcccttcttgcctaagccagtgaattttctgtcactcacatccaaagagcccggactgtaatggcagggtatggcagggctgagctggctggggcagaggacggtgtgggtggaatcagcagtgacaggcacacaggaagtgcaggtatcgagtggcctccatgaggtctccctccagccccgactgtgagcaaggctgggctcatacgctcagtaggtcagagtgagggatttggtcagaggtgccatgctcagggccatctttctatgggccagactcttcgtcatcaaaggttttgccatcagagacagttttagtcctatcttgggttcacttgatcaattgctgttctcctgctttcaggatctttacactaggctgccctacctgggggttaggaagccataggcatcctggtcataagtctggaccccaaaaagggcttctgccagcctgctaagggttccagagggcaggactgaggggtggtgggaggagcccagcctggacggccgagatatatatagtgctcttgattcatctcttggaacttttcacccatcaagtttaggctcccagtggggcacacatgggaaagacaatgcccatgtcttcaactagtttccccatcagaagtggtcattgcaccaagcaccctcctccattaaaaccggacaggccaagggccgctttcctaatggatgagtcttcttggtctgtctcatgttcccaacagagctccctccatgggatgggaaggtgccatcccagggccgccgttttgacccagcctccagccaaagctggtccccctgccaagcaggccctagagttacactggagagtgacaagcctcatctgaagatttcttgctgaaaattgtcagtttcctgcacaagtacatcctggcagtttacacatttatgcttagcgttccattactggaacgctaagcttgtggagttatttatatcctactgctcagtgtcatcgccaaggtctgatttttcacagaaaaacatttgcaacctctgacataatgagttaattcaaattaaacccagaaggagactgctgcttcagtctcaactgcttggaaattgtgctatgtagagctttcgtttactgaaaattgtgccttcagactctgtgcagattaacctactacatagagcaagtacacacatagggcaccaaccaaggacaagtgtgtacctgtgtgcacacacaaatagaaaatccaaaaataaatattttaatttcagctatcatggaagttttgtgtcatttctccaaaaatgcccatgtcaaattttattttataatttagtcttgtttttatttagaattacttaagaaaaaggggagctgagtgtggtggcttatgcctgtaatcccagcactttgggaggctgaggcagaggattgcttgagcccaagagtttaagatcatcctgggcaacttggtgaaaccccatctctacaaaaaatacaaaaattagccagatgtggtggtatgtgcctatggtcccagctgtgcaggagactgaggtgggagattcatctgagtctggtaagttgacgctgcagtgagctgtgatcgcatctttgcactccagcctgatgacagagagaaactgtctcaaaaaaaaaaaaaaaaaaaaaaaggaaaaggaagaaagaaaggcaaagaaagaaagaaaatgaaagaagaaagaaagaacgaatgaatgaaagaaagaaagaaagaaaagaaagagaggagctctgcacaataattttgcagtgtcttgggtctctaaagatcttaattaggacctaaactcagattaggctgggatcctgggcagtgtggccccaaatacagttatgggaggcccttccaagataagtctagactgagatagagtaggtctcaggagaggggctgatatgcccatggttctcaacctggctgcacctggagagcttggcatcacctggagagcttgaaaacattctgatgcccaagccccaccctagagattctgagctaattggtgggggatggcctgggcaccaggaattttcacagctcacctgatgatggcactgtgcagccagggtagagaaatactgacctttgctttctccacgttgtgtctgccttggttttcccatattcccccaggctccaggatctgaatgaactacaggaattgagaattagccctcccacccagccactttcttcccctgctggggaatctttgagccttcattttggctataggcctcgatataactcatcggcccagggatcggggcaggagtggggctcctggcagagagcagagtgtgggctttgtagttacacagacttgcattcaagtcccagctctgtgatgtcagaagaagatctgatccatagttggttaccctgcgaagtggagaaagtgtccgcctaaccggcaagatctctttgagactgaaatgagagaaagctggggcaacaagtgagttccttccgcgccatttctgtgagctggccctgtagcttctccttggtcctttgagttctcagctttagctctcttactcctgctccttctcctcactctctctcttttccaccctggataagtgccctgcttctccccacaggttaaccaccctcccccgtacccagtgggtgatgaaagtcttccctggttgtgccagcatctccctgatacttcctttctctcctgcattcaaccatgatgaagcccagcacagtctccctctcttgtgccccatttccaccacaaggtcactgtcagctcttacacagacatccccagtagcttccactttggcctcttccaaccagccattctggtattgcagccatattcatctttaaaagcccaatattattaagtcactctcttgctaaattctgcaatggctttgactcacccttggcctgcaggatctggcccctgcctgcctctgcagccaccttttgcttcattctttctctcttactccctctatcacctcagatccctgagggttccctccctcctacctcaggacctttgcacatgctgttctctctgccagaaacacttctctttgacagtgaatgccttctcaaatatcccttatttggggtgttgactacccaccccatcagattaggtccctcactatatgctcttatatctctttatactttttcaattaaataaattttgatcacgtgatttatggccatctcccctactagactgtaagctccataacatcaaggaccaggccagtttttgttcatcgttgtaacccaaatgcttagcactgtgcctggcacaaactaggggccatttggaccaagtgtctaggttgtgtagacttgcagcccctgtggaagtgtgtggataaacatgagaaacaggatgactgcctccccagcatggcttgagtgtttcctggatgtgtccaggcgggtatcacatgctgggtggcatcagaggagtgccctgttttccttttataagagaaggaaaggttagagactatgaacagtcagctgtgggatcatacagtgtctgccctgctccacttggctcaaggcctctggggaatggggatatgggacagggacatggcgcatggtgcaagtggttgtggcagcgagccttatggaggaacagcagtgagtcagtcccttcttggcatgggacgctgcctctgcaggcataggaggccatattccccactctcacacccagtcagttgggtgcttctaacttgagctgtggcatttggcatgtaaaaaatgcattcctggttttccagcttggatctcatggtaagcaggggtgtgaggtctgaggaggatgagtgtttcagtggagatgtctggataacttttaggataagtatatcccaaacattgcatgggatatactcatacaaaaaaactatttgctgtttatctgatattgtaggttaactgcatatcctatagttttctttgctcaatctggtgcccctaagcttggggcttcctcacttcaccgtggtgctgttgtgcccttccttcattataccacactaggctcttggggtacacagaggagtgagacaggacccttccctcagggaactcacagtctaacataagagataagaatttgaacagagatcgccaaagcaatgcaaactctatttctgagaatttggggacccttgttggaatagaacagctttagaattcagaagagatcagaaatcatggaacagaataggaagtccagaaacaaacctgaaggtttttcttttcttttttttggagatggagtctcactctattactcaggctggagtgcagtggtgtgatcttggctcactgcaacctctgctgcctgggttcaagcaattctcctgtctcagcctcctgagtagctgggattacaggtgcctgccactacgcccagctaatttttatatttttagtagagatgaggtttcaccatcttggccaggctggtcttgaactcctgacctcatgatccacccacctcggcctcccaaagtgctaggattacagacatgagccagcacgcctggccacaaacctgaatttttataagaatatattgttttagcgtgtgataaaggtggcattaagacctcttgagcaaagaagaattattcaataagttttgttagagcaattaattaactacctggaaaaaaattaagttagaatcattactactttaaacctcatgccagaaatgaattccagttgttgtaaagatgttaacaaataaaactgtaaacatactaactaggagaaaacataaaaaaagaatatttacatgatcttggggattatgaaggactttctaagcatgatgctcagtactgtacagaaggtataaagaaaaattgttctattcat

SEQ ID NO: 714 - DNA, 6158 bp, Homo sapiens
atcatgtcaaggcaataaagacaatggtttcgttacctcaaaagggaaatccatagatagcacatcacacaggctttcgggagtgcaagggaagttctttagccccacaaatttaaactgaaatagaaattagaacaaggaattagtacgttataaatgatactggcccaagcaattgaaaatctctgtcaggccaggcatagtggctcacacctgtaatcccagcactttgggaggcaaagtcaggaggatcacctgaggtcaagaaatcaagacaagcctggccaacatggtgaaaccccgtctgtactaaaaatacaaaaattagccaggcatagtggcatgtgcctgtagtccaagctacttgggaggttgagggaggaaaatagcttgaacccaggaaggggaggttgcagtgagccatgatcatgccactgcactccagactgggtgacagagcaagactccctctcaaaaaaagcaaaaagaaaagaaaatctctgtcaaagaagaaaaacttgtagtcccagctacttgggaggctgctgaggtagaaggatcgcttgagcctgaggtcaaggctgcagtaagctcagattgtgccactgcaccccagcctgagtgacagagccagaccctgtctcaaaaaccaaaccaaaccaaactaaaccaagccaaaacaaaaaaacaaagaagaaaagttttcagtctcatccttctctactaattcccctctacttactctcttaactactaggtcgtggttcccaatctttcctcccccttttttttaagagatgagatctcattctgtcacccatgctagagagcagtggcacaatcacagctcactgcatcctcaaattcctgggctcaagggattctcccacctcagtttcccagtatgctgggattataggcatgagccactgtacccagccccaaccttcttttatccacaagaatcatctagggagcttttaaaaattactgatactcaggaggctgaagcaggaaaatgacatgaacccgggaggcggagcttgcagtgggccgagattgtgccactgcactccaacctgggtgacagagcgagactccgtctctaaaaataaaaaataaataaaaataaattactgatgctggccaggtgtggtggctcacgcctgtaatcccagcactttgggaggccgagaagggcggatcacgaggtcaggagttcgagaccagtctgaccaatatggcgaaaccccgtctctactaaaaatacaaaaattagccaggcatggtggtacatgccagtagtcccagctacttgggaggctgaggcagaagaatcgcttgaacctgggaggcggaggttgcagtgagctgagattgtgccactgcactctagcctgagcaacagagcaagactcggtctcaaaaaaaaaaaaaaaaatattactgatgcacaggccctactctgagattctgactgaactggtctggggtgggatccaggttttttgttgttttttttgagacagagttgcgctctttcacccaggctggagtgcagtggcacaatcacagctcactgcagcctcaacctcttgggctcaagtgatcctcccacctcagcctctcaagtagctggaactataggtgcacgccaccatgcctaatctgtttttgtatttttttgtagagatggggttctgctgtgttgcccaggctggtctcaaactcctgggctcaaacaatccacctacctcagcctcccaaagtgatgggattataggcacacatcaccatacctggctaatttttttgtttgtatttcttttgtagagatggggttttgccatgttgcccaggctgctccgaactactgagctcaggcagtccacctgccttggccacccaaagtgctgggattacagatgtgagtcactgtgcctggcccaggtattttttttttttgagacaaagtctcgctccctcacccaggctggagtgcagtggcacgatctcggctaactgcaagctcggcctcctgggttcacagcattctcctgctcagcctctcaagtagctgggactataggcgcccaccaccacgaccggctaattttttgtatttttagtagagacggggtttcactgtgttagccaggatggtctcgatctcctgacctcgtgattcgcctgtctcggcctcccaaagtgctgggattacaggcgtgagctaccgcactcggcctggcccaggtattttttttaaagctcttcactgggccgggtgcagtggatcacgcctgtaatcccagcactttgggaggctgaggcaggcagatcacaaggtcaggagatcgacaccatccttgctaacacagtgaaaccccgtctctactaaaaatacaaaaaattagccggtcgtggtggtgggcgcctatagtcccagctactcaggaggctgaggcaggagaatgctgtgaacctgggaggcggagcttgcagtgagccgagatcacgccactgcactccagcctgggtgacggagcgagactctgtctcaaaaaaaaaaaaaaaaaaaaagctctccagctgattttaacatacagtcaggagtgggaaccactgtattgtactaggttgagtggttgtgtgttattctcttggccccatgacagctaccactaataaagggctagtgaaatccttttcacacctgcaaggatttttagactgaagcagcataactaagtgattagaactacaaactctaaagtcagattgcttgggtttgaatcccattctgccaatcatttaacctccatatactttcatcttcccatctgtaaaatgggataacaacagcacatatctacttcgtagggttactgtgtggattcagtgagataatatacatagagcacttaaaccagtgtcttagagagagcagtcttccccttcctcaatgcatgttcctccaggacctacatgataataacatcactgaaagtactgatcatatttattctcctataactggttgtccaattccctttaactttttttttttttttttttttgtgacagagtctcgctctgttgcccaggctggagtacagtggcacaatcttggctcactgcaacctccgcctcccaggttcaagtggttctcctgcctcagcctcccaagtagctgggattacaggcgtgcaccactacacttggctaattgtttttgtatttagtagagacagggttttgccatgttggtcaggctggtctcgaattcctgacctcaaatgatccacctgcctcggcctcccaaagtgctgggattacaggcgtgagccacggcgcctggcccttggctttaacattttttgtgagcaatccaagcaaatgccaatctgcagggctaataaaatgccctgaaaatagctgtcacatatttaaatcactgattattattgagtgcctaccatgagtattatgttaggaggacttgcatatttatataatttggttcttataacaaccctgtaaattagatgttattaccctatttttcagatggaaaatctaagggtaagtgagattattaacttaacttagtaataaattttttttagtctttttttagttattattacttcaataggtttttggggaagaggtagtgtttggttacatgaataagttcttttgtggtgatttctgagatttggtgcacccaccacccaagcagcgtacactgcacccaattatccctcatcccccttacccttccccagagttcccaaagtccattgtgtcattcttatgcctttatatcctcatagcttagctcccaattatgagtgagaacataggatgttaaattagtaataataaaagccaaaaatggaattcagatctacatgattgatactcttccctttataccatgctgcctcaaaaaagatcatttcatacataatgattatatttagataacagaccaatccacactactccccataaggaactcagtgatcctaacaccaggccttacaggattaagcttggttttctctcccagtccttcttcttctggtaactttgaatgcatccagtagaatcggaaatcagtctgccacagagaagggaaacagaaagatgaaatactttccatttcaaactctaatataaacaaaaacaccccatgctatttttttttttttttttttgagatggagtgttgctctgtcacccaggctggagtgcaatggtacagtctcggctcactgtaacctccgcctcccaagttcaagcgattctcctgcctcccaagtagctgggactacaggcgcccactgccacaccaggctaatttttgtatttttggtagagacagggtttcaccatgttggccagagtggtctccatctcctgacctcttgatctctccacctcgagcctcccaaagtgctgggattacaggtgtgagccactgcgcccaccgggcctcttcattcttttaaattattttgcttttggaaatttaaaaagatacatacagtcttttgtttacgttataaaaatatatttggttttagttaccaaatttgtaggttgtgaatacatgtaataaaatatccttcagcagaattaaaggaaaatatgttctagattgaatttatgttctgagttgtaggcttggttctacacgtgggcaaggtacttaagacctgtgcttcttagcatctcagcttccatatctatatgtcaaggacaggccaggtgcagtcgttcatgcccagcacttcggtaggccaaagtgggtggatcacttgaggtcaggagttcaagacagcctggccaacatggtgaaacgccgtctctactaaaaatacaaaaattagctgggtgtggtggcaagcgcctgtaatcccagctactcagaaggcggaggcaggagaagtgcttgaacccaggatgcggaggttgcagtgagcccagatcgcagcactgcactccaacctgggcaacagagcgagactccgtctcaaagaaaaaaaaggatgataatagtacttaccttacaataaggacgtgttgtaagggatttaatgagctaatgcagaaagtgcttagcaatgcacatcttgattgttattgtttgaatgagatgcaccttagaattctgagtaccaatacctagtgtgttttggaaacctagtatgcgggaatggcttagaaagaagcagcctatggtgacagcctgcatgaagatcactggaggcctgttcacacatcagcctcaggcccatttctacaacgttctgatatgcctggtctggagactacacaccgagaaccactatgataaactaattgacagggagcaaaaggaagtaccaaaacccccaaacccaccattatacaactgggacaatgacggggagagtgttcttaacagggatggaggccggtggggctcactcagcctcacctgatgactgctgctgttacctgttaagaatcaccaatagtaaaatgttgggggtatggtgaaacagaaggggagaatattggggcctctcctcctttgaaaagtctcctcctagagctaacctttgagatttgaggttctgggtcataccaaggaggccctgccattttcagggtcaggatgtggttggtgaaggagtggaggttgcaggagtctagtagatggtgacttacattcaattccaccttctcttcctggggctgctgcacaaggtggcatccccacccccttgccccacaatcttcactgccagaaatcctcccatactctggagagagataagggggtgggtgcagctgctatcaagtcccagcctacacccctgccatttctttctttcttcctctcaagaactgcatgtttctcttagttcctcctatttctcttttaaaactaagctaatttaaacacactcaaagatgcagggagcattagataatgttcttgatataccacatcctgtgcacaccaagaagttggtcacataccaaacccacatgctgagccgctttcccaggaggagaggagaagacaggaagagccacgagaggaggatccatccctacctggcaatcataaaaagggtgtccccgccagcacatcacatcca

SEQ ID NO: 715 - DNA, 97905 bp, Homo sapiens
ttaaaaacaatccctgacctcaactaatttctgcattaatgcaataggaacttcaggctgcccttggtaagaatcagagacgatatccttggtatttgaatctttatctcagctaggatattttctcctttgcatcaatacagctgactggaggttgacttcatcactcctttagtttcagtattgtaaccagtctggaatacttttttttttttttttttttttttttttttttgagtggaggtcttgctctgtttcccaggctggagtgcaatggcgtgatctcggctcactgtgacctccacctcctgggttcaagcaattctcctgcctcagcctcctgagtaggtgagattacaggcgtccaccagcacaccctgctaatttttgtatttttagtagagacagggtttcaccatgttagccaggctggtctcgaactcctgacctcacgcaatccgcccacctcagcctcccaaagtgctggtattacaggcgtgaactactgcatccagcctgctttctttttattgaagtgtaatatacagaaaaagtacaaatataagtgtactgcttgatgaatttttttattttattttttgagacagggtctcactctgttgcccaggatagagtgcaacagcacaatcctggctcactgcaacctctacttcctggctcaagcgatcctccagcctcagcctcccaaatagctgggactataggtgcgtgccaccaggcctggcccatttttatattttttgtagagatggggttttgccacattgcccaggctggtctcaaactcctgagctcaaagcaatccacccacctcagcgtcccaaagtgctaggattacaggcgtaagccactgcacccggccagatgaattttcataaactgaacacactcgtgtctgtgcccaatgcacagatcaacaaatagaatattctgaacttgccaaagcctcgccttttgcccatcccccaccccacagtcagttactactctgctgaagggtaaccactatcttgcccgttttttttttttttttttttttgagacagggtctctcgctgtgtcacccaggctggagtgtaatggcacgatctgggctcactgccacctctgcctcccgggttcaagtgattctcctgcctcagccttcagagtagctgggattacaggcatgcactaccatgcccatataatttttgtgttttttttagtagagacgggttttcaccatgttggccaggctggtctcgaattcctgacctcaagtgatccacccaccttggcctcccaaagctctaggattatagttgtgagctatcactcccagcctcaggcttgaactcctgggctcaagtgatctgcctgcctcccccttccaaagtgttgggcgtcagccaccgtgccgggccaagtatgctttttctccctaggcaagcaaatggttctaggactaaactggagtaagaaacagcaggacctgagtagtacaaaccattgattggagacaggagaggatggagtctctcaactcactatttacacttcacatttgttttgcccactgatcctcaggacaccaggggtcagtgatttatccaaagtcacacaactaaataattagtattgagctaaaacttgaacccaggcattctaactcctgatctaggaactgggtgaggaggagaattaataaagatatttaactgagtgggctgagagagaactcagcagtgttttcagaggcacagctgtgtgtgtgggcgtgtgggtgtgtaaggaaagagagttctccggaactgttatccatcactgttttaacaggacaatgtttggaaatttctgagcacaaacgtgaataacaaaacaaagtgcaaggcggctggctggccagtttgttttgagaggtaaatccaggagacccagagtagagaggcaactacctggcttgcctgtaactgcaggcttgaaccaatgaactcaagtatggtactgtcatcctgcccaatcaaatcttaaaggctgggctgggcaccggggctcacgcctgtaatcccagcactttgggaggcccaggtgggtggatcacttgaggtcaggagttcgagaccaccctgatcaacatggtaaaaccccgtctctgctaaaaatacaagaaattagccagacgagatgttgcatgcctgtaatcccagctactcgggaggctgaggcagaattgcttgaacctgggaggcagaggttgcaatgagccgaaatcgcaccatggcactctagcctataaaacgagagcaaaactctgttgcaaaacaaacaaacaaaaatcttaaaagactgcagaatggcttgtagtatcaaaagattgaaaacattatgaggccgggcacggtggctcatgcctgtaatcacagcactttgggaggctgaggcaggcggatcacgaggtaaggagaacaagaccatcatggccaacatggtgaaaccttgtctctactaagatacaaaaattagctgggcatggttgtgcgcaccactgtcccaaccactcgagaggctgaggcaggagaatcgcttgaacccgggaggcagaggttgcagtcagccgagatcgcaccaccactgcactccagcctggtgacagagggagactctgtctcaaaaaaaaaaaaaaaaaaaaaaggctgggcgcggtggctcacacctgtaatcccagcactttgggaggctaaggtgggcagatcacgagatcaagagattgagaccaacatggtgaaaccccgtctctactaaaaatacaaaaattagctgagtgtggtggcacatgcctatagtcccgctactcgggaggctgaggcaagagaatcacttgaacctgggaggtggaggttgcagtgagccgagatcgccctactgcacgccagcctggcaacagagtgagactccatcccaaacaaagaaacattatggcccatcaatagaagactcagtaaataaattacagtacacacatacactgaaataataggttgacatttattgtgtccttacatttaccccacacactgttctaaatgactttcattgatttactctcaccataatagtataagaaaggtgaaactatgatccttattttacaaaaagcatatatagtagatccattgatacagcctccttacttttttttttttttgctgagatggagtcttgctgtgttgctcaggccggagtacagtagtgcggtctcagcttactgcaacttccgcctcctgggttcaagcaattctctgcctcagactcccgagtagttgggattacaggcgcctgccactacgcccagctaatttttgtatttttagtagagatgggttttcaccatgttggccagactggtcgtgaactcctgacctcgtcatccatccacctcggcctcccaaagtgctgggactacaggcgtgagccaccacacccagctgtttttcttttgtttgagatggagtctcgctctgttacccaggctggagtgcagtggcacaatctcggctcactgcaacttccacttccctggctcaggtgattcttgtgcctcagcctctcaagtagctgggattacaggcgtgaaccaccgcgcctggcccctccttgctttttattttttttgaggcagagtgtcactctgtcacctcagctggagtgcaatggcacgatctcagcccactgcatcctctgccccctcgtttcaagcaattctcctgcctcagcctctcgagtagctgggattacaggtgtgcaccaccacatctggctaattttttttattattattatactttaagttctagggtacatgtgcacaatgtgcaggtttgttacatatgtatacatgtgtcatattggtgtgctgcacccattaactcgtcatttacattaggtatatctcctaatgctatccctccccatgaccagccccgctgtttgatgttccccaccctgtgtccaagtgttctcattgttcaattcccacctatgagtgagaacattcggtgtttggtttcctatccttgcgatagtttgctgagaatgatggtttccagcttcatccatgtccctacaaaggacatgaactcatccttttttatggctgcatagtattccatggtgtatatgtgccacattttcttaatccagtctatcactaatggacatttgggttggttccaagtctttgctattgtgaatagtgccgcaataaacatatgtgtgcacgtgtctttatagtagcatgattcataatcctttgggtatatacccagtaatgggatcgctgggtcaaatcatatttctagttctagatccttgaggaattgccacactgtcttccacaatggttgaactagtttatactcccaccaacagtgtaaaagagttcctatttctccacatcctctccagcatctgttgtttcctgactttttaatgatcgccattctaactggtgtgagatggtatctcattgtggttttgatttgcatttctctgatggccagtggtgatgagcattttttcatgtgtctgttggctgcataaatgtcttcttttgagaagcgtctgttcatatccttcacccactttttgatggggttgtttgattttttcttgtaaatttgtttaagttctttgtagattccgaatattagccctttgtcagatgggtagattgcaaaaattttctcccattctgtaagttgcctgttcactctgatggtagtttcttttgctgtgcagaagttctttagtttaattaaatcccatttgtctattttgggcttttgttgccactgcttttggtgttttagtcatgaagtccttgcccacgcctatgtcctgaatggtattgcctaggttttcttctagggtttttatggttttaggtctaacatttaagtctttaatccatcttgaattaatttttgtataaggtgtaaggaagggatgcagtttcagctttctacatatatatccggctaatttttgtatttttagtagagacaggctttcgccatgttgaccaggctggtctcgaactcctaacctcaggtgatctgcccgccttggcctcccaaagtgctgggattacaggcgtgagccaccgcgcccggcccaaaacagacgttttgttttgtttttctgagagagagtctcaatctatcacccgggctggagtgcagtgatgcgatctcagctcactgcaacctccgcctcctgggttcaagcaattctcatgcctcagcctcctgagtagctgggattacaggcgcccaccaccatgcccagctaatttttgtatttttagtagagatggggtttcaccatattgtccaggctggtcttgaacacctgacctcagatgatacacccacttcagcctctccaagtgctgggattacatgcgtgagccaccacacccagcccagaacagacattttataaaataagacatttaaatctcaacaggcatataaaaagatgcttaacttcactgatcatcagagaaatgcaaatcgaaactacaatgaggccaggcatggtggctcatgcctttaatctcagcactttgggaggccgaggcaggtggatcacttgaggtcaggagttcaagaccagcctggccaacatggtgaaacctcgtctctactaaaaatacaaatattagcagggcacagtggtgcacacctgtaatcccagctactcaggaggatgaaacaggagaatcgcttgaacccgggaggcggattgcgccactgcactccagcctgggcaacagagtgagactctatctcaaaataaataaataaataaaataaaataaaattacaatgagataccatctcaccccagttaaaatggtttttatccaaaagacaggcaataacaaatgctggcaaggatgtggagaatagggaaccctcatacacttttggtgggaatataaattagtacaaccactatggagaacaatttggaggttcctaaagaaaacctaaaaatatagccaggtgaggtggctcatgcctggaggctaaggcaggaagatcacttgagtccaagattccaggagtttgagtccaggctgggcaacacagtgagacctcatctgtacaaaatataaagaaaatcagctaggagtagtgatgcacacctgtagtcccaggtacttgggaggctgaggtgtgaggatcacttgagcctgggaaataaaggctgcagtgaactgtgattacaccactgcactccagcctgggcaagagagtcagaccttgttgaaaagggaggagaggggaggggaagggaagggagggaaggtgtaggggaaaagaggggtgaggggaggaggggggaaggaaggggaggggaagaaaaggggaagggaggaaaaggggaggggagggaaggaaaggggaggggaggggggagaggaggaaaaggggagggaggaggggaaggaaggggaggggaagagaggggagtgggaggggaggggagagggaggggaggaaagaaaagaaaaagccaaaaataaagctaccaatccccctcctaggtatataccccaaagaaaggaaatcagtatgttgaagagacatctgcactcccatgtttactgctgcactattcacaatagctaaaatttggaagcagcctaagtgttcatcaacatataaatggataaagaaaatgtggcacagatacacaatggagaactattaagtcataaaaaagaatgaggccgggtacagtgactcacgcctgtaatttcagcactttgggaggccgaggggcagatcacttgaggccaggggttgaagaccagcctagccaacatgatgaatccctgtctctgtttaaaaaaatactaaaaatacaaaaattaaccgggtgtggtggcgcatacctgtaatcccagctacttgggaggctgaggcatgagaatcgcttgaacctgggaggcagaggttgcagtgagccaagattgtgccactgcactccagactgggtgacagagtgagactctgtctcaaaaaaaaaaaaaaaaaaaaagagagagagggatcctgtcatttgcaacaacatggatggaactgaaggtcattatgttaagtgaaataagccaggcacagaaagacaaacttcccatgttctcacttattttgtaggagctaaaaattaaaataattgaactcatggagataaagagtagaaggatggtaaccagaggatgggaagggtagtggggggtgagggagaagtggggatggttaatgggtacagaaaaatagaaagaatgaataagagccaggtgcaatggctcatgcctataatccttgcactttgggaggccaaggcaagtggatggcttgagctcaggaatttgagaccagcctaggcaacatggcaagactctgtctctactaaaaatacaaaaaagatcacttgagcctgggaggcaggggttgcagtgagctgagatcacgccactgcactccagcctgggtgacagagtgagaccctgtctcaaattagaaaaaaaaaaaagaatgagtaaggtgtatttgctagcacaacagggtgactatagtacaaaataatttaattgtacatttcaaaataattaagaatataattggattgtttgtaacacaaaggataaatgcctgggatggataccccatttaccttgatgtgattattatgcgttgcatgcctgtatgaaaatatctcatgtgacccataaatatatacatctactatgtgatgtacccacaaaaaagaaaaagagaaagaaaaaaaatagcataagtttcaggtctctgtctagaaagcttatcctcccctcccagcaccttcttcaccagacatatctgattcatccttaaggtctcagctcaaaagtcacttccccagcaagatcttccttgattactctctaaactgaactgcactttctgagactcatagcacccttttattcgtcagagagctgatcacaatttgtaattatgcacttgtttctacattcattggcctagtgtttgtgtgccttactagattgtaagcttcaggatggcaggaaccacatctgtcctgttggcccctgaactcccagcacctagaacctagaacatagtaggcaatcccttgataaatgtgttgaatgactgaatcaaggaagatggccactttatctatgagacatatcttaccattttcccctctcttttgttgtatttatttgggtttaagaatagacatacttccaatgctggagttggaattttataaccttctccaccaaacatttttatttctaaaatccaaagctcctctcaaacattgctccaaaatttctactgcctataaaagagacttgtgttgtgctataaagatgatatgaggctgggcgtggtggctcacgcctgtaatcccagcactttgggaggctgaggcgggtggatcacgaggtcaggagttcgagaccagcctgaccaatgtggtgaaaccccatctctactaaaaatacaaaaattagctgggcgtggtggcgcgtgcctgtaatcccagctactcaggagactgaggcaggagaattgcttgaacccgggaggcggaggttgtagtgagccgagattgcaccattgcaatccagcctgggctacagagcaagactccatctcaaaaaaaaaaaaaagatgatttggctataaaagattcaccccaccctgccaaaagaaagaaaggtgggcacagtggtgcacgtctgtagccccagacactcaggaggccgagatgggaggattgcttgagcccaggtgttcaagaccagcctgggcaatgtagttgagatcccatctctaaaaaatatctatctgtatagagtgcaatggtataattatagctaattgcagctctaactcctggccataggagatcctcctacctcagccttccaagcagctaggactacaggcacctatcaccatgcccaactaatttttaaattttttgtagagacaaggtctcgctctgttggccaggctggtctggaactcctggcctcaagaaatcctcctgccttggcctcccaaagcactgggattataggtgtgaaccaccatgcccagtctcatttctttattagaaaggacagctagggtgattgcctttcccttttccaatgtacaaagttagtttttaagctatccttttaatcacgtacacagaactaaatatagttcttgttcctaaaagtctgcagtatatccaagcacctgttagcagcttgccacacacctccatttagctttctcagcaaggtcactcctctgtgcagcagcagagaggaggggctctcctccagggtgcattctcattccaccttagtatttcttcattcactcaactaaaagttattgacgtaacaagtgccaagcataatgccaggcactggggacctaaagatgaggaagaccaggttcctgacctcatggaacttgctagctaatagaaggagtatgtagtaaagaacttaaccttgcaaagagtgttctggcctttgcccttcgctcctgggaggtaacctctaagcccttggaatgtcttgcctgataaaagtatctttgtttaccaggaggcagaccttaggccacactggacagtctaacaatgtgatttaggcagaagtctttggggcgtaccagatagtttagcaatgtgatgagggaggagggaagactttggatcacactttatcaggtagacttatggaggggctggagactgaggtcagtcacatgggcagacaatcaggtccacatgactgagccccaataaaaattttagacatcattccagccagacgcggtggctcatgcctgtaatcccagcactttgggaggccaaggtgggcagatcacctgaggtcaggagttcaagaccagcctggccaacatgggggaaaccctgtctccacttaaaatacaaaaattagctggacgtggtggcagatgcctgtaattccagctacttgggaggctgaggcaggagaatcacttgaacccaggaggtggaggttgcagtgagccaagattgtgccactgcactccagcctgggccacagagcgagactccatctcaaaacaacaacaaaacaaaaaaaaactttggacatcaaagctcaggtgagactgcctgattggcaatactctgtgagtattgttacacatactgggaaaattaactctgtccatgattccactgggagctctgcatttggaactttcctgctttctgctccgtgcatctcttcccttggccgactttactctgtttcctttcactgtgattaaactgtgattgtgaccataacagctttttttttttttttttttgagacggagtctcgctctgtcacccaggctggagtgcagtggcgcgatctcggctcactgcaacctctgcctcctgggttcacaccattctcctgcctcagcctcccaagtagctgagactacaggcacccgccaccatgtccagctaattttttttaatttttagtagagacagggtttcaccatattggccagctggtctcgaactcctgacctcatgatccacccgcctcgtcctcccaaagcactgggattacaggcatgagccactgcgcccagcccacatcttgatatttttgaatgctagcttgaaggacctatttcagagtgccccttacattttttttttttctttttgagacggagtcttgctatgtcgcccaggctggagtgcagtggcctgatctcagctcaccgcaagctctgcctcccaggttcacgccattctcctgcctcaacctcccgagtagctgggactacaggcgcccgctaccacgcctggccaattttttgtatttttagtagagatgggttttcaccgtgttagccaggatggtctcgatctcctgacctcgtgatccgcccgcctcggcctcccagagtgctgggattacaggcataagccaccgcgcctggcctccacctggtcatatttctttagagattatcaaactacctcttgccacctgttttaaagatggttgtgttggctgggcatggtggctcatgcctgtaatcccagcactttgagaggctaaggtgggcagatcacttgagctcaggagtttgagaccagcctgggcaacacggcgaaaccttgtctctaaaaaaaaaatacgaaaattagccaggcgtggtggctcatgcctgtaatcccagctacttgagaggctgaagcaggaggatcactgggaggtcaaggctgcagtaagctattattgcactactgtactccagcctgagcaacagggtgagcccctgtctcaaaaaaggaaaaaaaaaaaaagatggttgtgttataggttgctatgactgcatatttgttttctagccagccctctaaacagcacccagtttcttttttttgtttgtttcttttcttttcttttctttttttgagacggagtttcactcttatttcccaggcatggagtgcaatggcgcagtctcggctcaccacaacctctgcctcctgggttcaagtgattctcctgccttagcctcccaagtagctgggattataggcatgcaccaccacgccccactaattttgtatttttagtacagacggtcaggctggtctctccatgttggtcaggctggtctcgaactcccgacctcaggtgatccacctgccttgggctcccaaagtgctgggactacaggcgtgagccactgcgcccagcacccagtttctttttattgtagagtcatcttcccatgcaatatatttgagtgatgctatagtctgggataattgccctcccttagtcaagtgtcaggctcataactcaagatgggccaatcacattctcctcccacctcagctcccaagtagctgggactacagccagcacgcctggctatttttgtattttttgtagagacggggtttcgccatgtagcccgggctggtcttgaactcctgggctcaagtgatccacccatcttggcttcctagagtgtgggattacagacgtgagccatcacacggtccctaactgatactattgccatggcctaccttgcttgccttggcaggagggccagcttggcatgagttagcaaagaaccactatttgagatcacctattttatctcaagtactgctggaacccatgcacctagaaaagaccagggttttcaaccagtagatccagaataagcagtcttattgaatcaaaggatatatcagccaaaataatcaacaagcacaacttgatattttttaatggtagcttgaaggacctatctcagagtgccccttacatttttaactaagaagccagtattatctattgatcactgaatagcagtgtgtcccctggtcgtatttctctcactctctctgtctttttttgttgttacaaaaactgccagctctcacagtgattttaccacacctatgtatttacaatctttttttttttttattttttatttttattttttttagactgagtctcactctgtcgcccaggctggagtgcaatggcgtgatctcggctcactgcaacctctgtctcctgggttcaagcgattctcctgccttagcctcctgagtagctgggactacaggcgtgtgccaccacactcagctaattttttgtatttttagtagagacggggtttcaccatgttaaccaagatgctcttgatctcctgaccttgtgctcctcccgccttggtctcccaaagtgctgggattacaggcgtgagccaccgcgcccggcctacagtctgagaaaagtcatgctgagttccagtggctgcactggaagagtttgtgtcaccctaatccacttgtgtttggcagtgatttatccacatttgctatttctccacttggtcatttctcattaatgtctaaacctactgaaacctgacttctgttcctgccacttcaagtcctctcaaaggactactggtctcctgttttccaaatctgagggacatttccccagctttttcttacctgacttcagctgccatctatgtgctgatacctccagacctgtatctatctacttgccattcatctccagtcaccttaatactcagcatgtcccaaactgaactcaatacctttcctcctcaatccccctcaactgtgcttttcctgggatccttgtccttgttagtggcactcagtcacccatattaggaatctaggaatcatcacaatgatgattccatttcttatatttcacagctagtgagtcaccatgtcctttaattcccacctctctcttcatttcctctacaaccttaattcaggccttcatcatctctctcatagggtactgccagatcctcctacctagtttccctgccactagtcttttcccctttgaatccatccctgccatagcagagtgatcctttctaaaaatataggtttgatcatgttacttcaaggatgtaccattgactgcaagatacatgtgaagcttctcatcctgccatgcaagttcattcatgacctgaccttagtatatctctccagcctcataaattaccttgcctcctttgctgcctacttttcagtgatgctgttttacagttctgtgtataaatgcatctgtttcatacttttcccctacaccatccccgctcactctgacttcattcacctggtggatatacctattcgtctttgaaggactccattcaaaagacacctgtttgaacattttcctctgcaggtagagtagccattctttgtgccctccccatccatacagccagctctcacagtgattataatattttatcacacttatgtatttacatatatatttcccaaactcagggaatagtccacagactaccgttactttggataccagttgcaagtttggggaaccctaagactaccctctggttatataattcgccacaaggactcacagacctcattgaaagctgttatagtctctgggcgcagtggctcacccctgtaatcccagctactcaggagggtgaggcaggagaatcgtctgaactggggaggcggaggttgcagtgagccgagactgtgccactgcactccagcctgggcaacacagcaagactctatcccaaaataaaaaaaaaaaaatcaagttgtgattgttgataattttggctgatatatcctttgattcatgcagctgtccccagagtgtgtgtgcctgtagtgcctgtgtgcgccctttggggaagtagtccttccagacctgattatttctgaacagagtatggccaagtcactattgacactagcatgcatagcttctgaactgatatggttggctgctgatagcacagactagagcactcagaaaattatcaaacagagactaaatgtttaggcacttaaaacatgctccttggcaagaggaacacaatgttcctattacagaattgacctaaattcaggaaagagcttattgatgtaggcaaatgcttgaatctgcagccagcaggatcatcaatggatgagggtgggagcggggagtcttccaattttacaaggtcagcttgagcaactctctaagagccgacactaagactagttccactggatgtactgaagttgtataatcaggctccaaataactactacctctgcccaaatctgttcccagaactaatcaacatgcagggaccactgcatgtcagacaagagctgacctggatccctgtgaaaatctgtccacaggacactagtgctgctggagggaatggtgaagtacttgtatccatgacagagtcctagaaagatgggaagcaatatgggagctgactgaagccacaggaagtgggatccatttcctgaatacaaagcagaaactaattagtcagtttccaacacaatcttccattctcacagctgccaaagacctccagttcacaaatctcaagagaccttgcctgctcaaagttctttcttagctcctttcatccatgacacaaaatctaaaacctgctatctctctccagcctcttctcccaaactgtcctggtgggcttcttttctcacaggagtgtgagctcctcaagggcagggactaagtactgtccacctccataacccctctacttggcaggggcctaggacaagcttatctcctggtaggcacaaatgtttgctgaaggagtgaatgaactacatttgcattttatctctggcaatgtctaaaccaaagaaaatcacacttgtcttctcagaagagggaacatattcaaatacccagaattgcagttcctggtaaaacctttcggcggcagcagcaactggaaactcagcagaatctttgagtactaaaaagagtgaaatgggccaagacttgaacagccatggttgaagtagcccaggggactgagatgggaaggggagattcatggctatctaaagcttaagaaccacaaaccagttctttcttacaaatcacatatatttacattgtggatctgggatacacttatcacagtaggagctgctcaaatcaatctgaatgctacgcaatctgggaacctccccataactgtttgagccagcatttcagattatagataagctgtttccagctggactgggtttggaaagttcactctaaagaatgaagtcacctgttgtcactgtcctcctctccaggattccttttggggccaggtaccatcctgtggctccttaaggaggcttctctctttaattctccatgaggcatccagggtggtctgggctatgggaagaacccttcaacttgggagtagacaggtgctccaattcatagtgcccattctcagaggccttgtgtgtgagtttctccttcatgccttccttctggctcttcttgtgctccataatctgctggagctggtgcccagcatagtctggcttggtggtcagcgggccagccggcacagctacaccaaggacatctgacaccatgtaggggcgcagccagcccaccaagggagtgcttccggggctgtagtgggtctgtttgtggtagaagagaagtccatctacctataagacaaggggaaattgaggatcaaatgacttctggggccacatgtttccaggagagcctatacacacaagggcagctcttgtggtccgactcctttttctgggtcactgacagaggaaagagtcccagcttctcacacatgccgtttctctaaataaagaaatggcctagaaaactaaatttgagaaaataaaaacattggctgggcgtggtggctcatgcttataattccagcactttggaggctgaggcaggcagattgcttgagctcaggagtttgagaccagcctgggcaacatggtaagactccatttctactaaaaattcaaaaaaatagccaggcatgtgtggcacatgcctgtaatcccagctactcgggtgtctgagacacgacaaccgcttgaacccagtaggcagaggatgcagtgagctgagactgcaccactgcactccagcctggcgacagagtgagactctgtctcaaaaaaagaaaaaaaaaaaggaaaggataaacataaatagcactttcctgtttacagagtgctttcctgcccactattttactatcttacccatgacggtgtctgagagatggggctgctcatactcagggagttctgaggacctccttaaaacacacagtgagtaggaagcaggacttcaacttgaactctggtcttctgtccccagattccacggactttccaccacttaggggtctgtgttgtggtggatgagctctgtgcatggaatgaaaagcagaggaactggacaggcccctccggggcagcagattgctgcacacagtggaaacaggctgtccagatgccctgcttccctggctactgttggttgcctaaacctccccctaaattgtttgtgagccatgttctgggaaacagtttttctcaacgggaagacctcctacagtcccacattttattttctatgattcagtgactcatctctaaaaagcatttattgtcactggggcataagggttataaataaagatggtattcttaccaccttcttaattgactcccagaaatgctggcaactcagcctttgccatttccttatttgggaagctgtgatccttatataaaattacatccagttcaagcaaatgcttgcagtgactgggcagatttttttttttttttttctttctgagatggagtttcgctcgttgcccaggctgcagtggagtgcggtggtgcgatctcagctcagtgcaacctccgcctcccgggttcaagagattctcctgcctcaacttcccaagtagctgggactacaggcgtgtgccaccatgcctggctaatttttgtattgttagtagagccggggtttcaccatgttggcgaggctggtcttgaactcctgacctcaggtgatccaactgcctcgacctcccaaagtgctgggattacaggtgtgagccactgtgcccggccaaggcagaatttttaagggaatgatgggcaaaggaaaatgtgcttgttgagcctagagaaggtagctgcaggttctgaggctgacaagactgttgaggactggggagcctctggggctgtgaggtttgttttttgttttttttttttgagacagagtcttgtgctgttgcccaggctggagtgcagtggctcaatctcggctcactgcaacctctgcctcccaagttcaagtgattctcctgcctcagcctcccgagtagctgggattacaggcatctgccaatacgcccagctaatttttgtatttttagtagaaacgaggttttgccatgttggccaggctggtcttgaactcctgacctcaagtgatccaccggcctcggccttcccaagtgctgggattataggcgtgagccaccatgcccagccgctgtgagactttcagtgctaaaacagggcgagtcctgagcaaactggaatgaggtggtcacctgactcatgctcctgctcagcaagtgctgctgtccccaagggccatcttctttggtgaggaaaggattagggatttggacatttgttggagtcattcagtcacagaagcaccttcactttacaagcagccacgacagccaaaccagggacctgggtctcagcttgcagtaggaagaggcacacaagaaggatctaggcatgcaagtcttgctcctatctgggcctcagtttctccggacctcagtttctccatctgtaagatgagggagttggacgagctgtccattaagggcccttccagtgccagcattctgacttatccagcatgggtggagctcaggctctgaagggcagcaagtacatcctttctccagaatcagctttgtcccattctgatgctttgacacagcacaatcaaggaatattttaagactttgtgtaactaagtctctctgcagcctatcatcatgtcaaggcaataaagacaatggtttcgttacctcaaaagggaaatccatagatagcacatcacacaggctttcgggagtgcaagggaagttctttagccccacaaatttaaactgaaatagaaattagaacaaggaattagtacgttataaatgatactggcccaagcaattgaaaatctctgtcaggccaggcatagtggctcacacctgtaatcccagcactttgggaggcaaagtcaggaggatcacctgaggtcaagaaatcaagacaagcctggccaacatggtgaaaccccgtctgtactaaaaatacaaaaattagccaggcatagtggcatgtgcctgtagtccaagctacttgggaggttgagggaggaaaatagcttgaacccaggaaggggaggttgcagtgagccatgatcatgccactgcactccagactgggtgacagagcaagactccctctcaaaaaaagcaaaaagaaaagaaaatctctgtcaaagaagaaaaacttgtagtcccagctacttgggaggctgctgaggtagaaggatcgcttgagcctgaggtcaaggctgcagtaagctcagattgtgccactgcaccccagcctgagtgacagagccagaccctgtctcaaaaaccaaaccaaaccaaactaaaccaagccaaaacaaaaaaacaaagaagaaaagttttcagtctcatccttctctactaattcccctctacttactctcttaactactaggtcgtggttcccaatctttcctcccccttttttttaagagatgagatctcattctgtcacccatgctagagagcagtggcacaatcacagctcactgcatcctcaaattcctgggctcaagggattctcccacctcagtttcccagtatgctgggattataggcatgagccactgtacccagccccaaccttcttttatccacaagaatcatctagggagcttttaaaaattactgatactcaggaggctgaagcaggaaaatgacatgaacccgggaggcggagcttgcagtgggccgagattgtgccactgcactccaacctgggtgacagagcgagactccgtctctaaaaataaaaaataaataaaaataaattactgatgctggccaggtgtggtggctcacgcctgtaatcccagcactttgggaggccgagaagggcggatcacgaggtcaggagttcgagaccagtctgaccaatatggcgaaaccccgtctctactaaaaatacaaaaattagccaggcatggtggtacatgccagtagtcccagctacttgggaggctgaggcagaagaatcgcttgaacctgggaggcggaggttgcagtgagctgagattgtgccactgcactctagcctgagcaacagagcaagactcggtctcaaaaaaaaaaaaaaaaatattactgatgcacaggccctactctgagattctgactgaactggtctggggtgggatccaggttttttgttgttttttttgagacagagttgcgctctttcacccaggctggagtgcagtggcacaatcacagctcactgcagcctcaacctcttgggctcaagtgatcctcccacctcagcctctcaagtagctggaactataggtgcacgccaccatgcctaatctgtttttgtatttttttgtagagatggggttctgctgtgttgcccaggctggtctcaaactcctgggctcaaacaatccacctacctcagcctcccaaagtgatgggattataggcacacatcaccatacctggctaatttttttgtttgtatttcttttgtagagatggggttttgccatgttgcccaggctgctccgaactactgagctcaggcagtccacctgccttggccacccaaagtgctgggattacagatgtgagtcactgtgcctggcccaggtattttttttttttgagacaaagtctcgctccctcacccaggctggagtgcagtggcacgatctcggctaactgcaagctcggcctcctgggttcacagcattctcctgctcagcctctcaagtagctgggactataggcgcccaccaccacgaccggctaattttttgtatttttagtagagacggggtttcactgtgttagccaggatggtctcgatctcctgacctcgtgattcgcctgtctcggcctcccaaagtgctgggattacaggcgtgagctaccgcactcggcctggcccaggtattttttttaaagctcttcactgggccgggtgcagtggatcacgcctgtaatcccagcactttgggaggctgaggcaggcagatcacaaggtcaggagatcgacaccatccttgctaacacagtgaaaccccgtctctactaaaaatacaaaaaattagccggtcgtggtggtgggcgcctatagtcccagctactcaggaggctgaggcaggagaatgctgtgaacctgggaggcggagcttgcagtgagccgagatcacgccactgcactccagcctgggtgacggagcgagactctgtctcaaaaaaaaaaaaaaaaaaaaagctctccagctgattttaacatacagtcaggagtgggaaccactgtattgtactaggttgagtggttgtgtgttattctcttggccccatgacagctaccactaataaagggctagtgaaatccttttcacacctgcaaggatttttagactgaagcagcataactaagtgattagaactacaaactctaaagtcagattgcttgggtttgaatcccattctgccaatcatttaacctccatatactttcatcttcccatctgtaaaatgggataacaacagcacatatctacttcgtagggttactgtgtggattcagtgagataatatacatagagcacttaaaccagtgtcttagagagagcagtcttccccttcctcaatgcatgttcctccaggacctacatgataataacatcactgaaagtactgatcatatttattctcctataactggttgtccaattccctttaactttttttttttttttttttttgtgacagagtctcgctctgttgcccaggctggagtacagtggcacaatcttggctcactgcaacctccgcctcccaggttcaagtggttctcctgcctcagcctcccaagtagctgggattacaggcgtgcaccactacacttggctaattgtttttgtatttagtagagacagggttttgccatgttggtcaggctggtctcgaattcctgacctcaaatgatccacctgcctcggcctcccaaagtgctgggattacaggcgtgagccacggcgcctggcccttggctttaacattttttgtgagcaatccaagcaaatgccaatctgcagggctaataaaatgccctgaaaatagctgtcacatatttaaatcactgattattattgagtgcctaccatgagtattatgttaggaggacttgcatatttatataatttggttcttataacaaccctgtaaattagatgttattaccctatttttcagatggaaaatctaagggtaagtgagattattaacttaacttagtaataaattttttttagtctttttttagttattattacttcaataggtttttggggaagaggtagtgtttggttacatgaataagttcttttgtggtgatttctgagatttggtgcacccaccacccaagcagcgtacactgcacccaattatccctcatcccccttacccttccccagagttcccaaagtccattgtgtcattcttatgcctttatatcctcatagcttagctcccaattatgagtgagaacataggatgttaaattagtaataataaaagccaaaaatggaattcagatctacatgattgatactcttccctttataccatgctgcctcaaaaaagatcatttcatacataatgattatatttagataacagaccaatccacactactccccataaggaactcagtgatcctaacaccaggccttacaggattaagcttggttttctctcccagtccttcttcttctggtaactttgaatgcatccagtagaatcggaaatcagtctgccacagagaagggaaacagaaagatgaaatactttccatttcaaactctaatataaacaaaaacaccccatgctatttttttttttttttttttgagatggagtgttgctctgtcacccaggctggagtgcaatggtacagtctcggctcactgtaacctccgcctcccaagttcaagcgattctcctgcctcccaagtagctgggactacaggcgcccactgccacaccaggctaatttttgtatttttggtagagacagggtttcaccatgttggccagagtggtctccatctcctgacctcttgatctctccacctcgagcctcccaaagtgctgggattacaggtgtgagccactgcgcccaccgggcctcttcattcttttaaattattttgcttttggaaatttaaaaagatacatacagtcttttgtttacgttataaaaatatatttggttttagttaccaaatttgtaggttgtgaatacatgtaataaaatatccttcagcagaattaaaggaaaatatgttctagattgaatttatgttctgagttgtaggcttggttctacacgtgggcaaggtacttaagacctgtgcttcttagcatctcagcttccatatctatatgtcaaggacaggccaggtgcagtcgttcatgcccagcacttcggtaggccaaagtgggtggatcacttgaggtcaggagttcaagacagcctggccaacatggtgaaacgccgtctctactaaaaatacaaaaattagctgggtgtggtggcaagcgcctgtaatcccagctactcagaaggcggaggcaggagaagtgcttgaacccaggatgcggaggttgcagtgagcccagatcgcagcactgcactccaacctgggcaacagagcgagactccgtctcaaagaaaaaaaaggatgataatagtacttaccttacaataaggacgtgttgtaagggatttaatgagctaatgcagaaagtgcttagcaatgcacatcttgattgttattgtttgaatgagatgcaccttagaattctgagtaccaatacctagtgtgttttggaaacctagtatgcgggaatggcttagaaagaagcagcctatggtgacagcctgcatgaagatcactggaggcctgttcacacatcagcctcaggcccatttctacaacgttctgatatgcctggtctggagactacacaccgagaaccactatgataaactaattgacagggagcaaaaggaagtaccaaaacccccaaacccaccattatacaactgggacaatgacggggagagtgttcttaacagggatggaggccggtggggctcactcagcctcacctgatgactgctgctgttacctgttaagaatcaccaatagtaaaatgttgggggtatggtgaaacagaaggggagaatattggggcctctcctcctttgaaaagtctcctcctagagctaacctttgagatttgaggttctgggtcataccaaggaggccctgccattttcagggtcaggatgtggttggtgaaggagtggaggttgcaggagtctagtagatggtgacttacattcaattccaccttctcttcctggggctgctgcacaaggtggcatccccacccccttgccccacaatcttcactgccagaaatcctcccatactctggagagagataagggggtgggtgcagctgctatcaagtcccagcctacacccctgccatttctttctttcttcctctcaagaactgcatgtttctcttagttcctcctatttctcttttaaaactaagctaatttaaacacactcaaagatgcagggagcattagataatgttcttgatataccacatcctgtgcacaccaagaagttggtcacataccaaacccacatgctgagccgctttcccaggaggagaggagaagacaggaagagccacgagaggaggatccatccctacctggcaatcataaaaagggtgtccccgccagcacatcacatccagaacgtagtaggtctggtttacctcattgtaaatgcaatctagaatggtgtagtctgaggacacaaagcagaaagtcagcacagagttcttcttccaaccaggttccctccaccacaacctagggagccccatcccagaggcttgagtccaacaatcctcagtgcttgcagcagtcactggcactaaggactaaggattcactggggagagaaccctgcctggctaccagctacagcttcatggtgactcagggtaagacagcacaagacgcatcaaggcaaaccttaagcaaagtgagaattctgaagttttagataaactggcacatttactcacctcaacgaggtttaaaagcaagtcatcttccattttagtttacaactgctttttgagttcctatcataggcactgtgttatgtggggaatattaactataaatattccctgcctttaaggaagttaccatttggttaaggggataagatgatcacagaagaactaagagctaaattacagagctcatactaagagcaacaggagttcccgaaagagaaggctggagcagcaggaaatgcttcaagggagagatgccatacaaatagtcttctgggaccagccgggtttaaacaacagggcagaggggagaagagagggcatttcagacccaagtactgatgtggcatgagcaaagccccagaggcagaatgaactgggcacatgtggggagataagtcagctgaacagaaggtgggtataaggagtaggggaaagacatgggatgggtgggacaaagcctgcatgtgaaaggtactaaacgccaacagagaagtcagagcaaggccaggtgcagtggctcacacctatactcccagcactttgggaggccaaggcaggcagatggctttgagcccaggagtttcagaccagcctgggcaacatggcaaaaccccatctctaccaaaaatacaaaaaattagctgggcatggtggcacactcctgtagtctcagttactcaggaaattgaggtgggaggatcacttgagcctgagaaataaaggctgcagtgagctgtgatcatgcccttgaacccgagcctgggccacagagtgagaccgtgtcaaaaaataaaaaagagaagtctgggctcagtacagaggacatgaggaaccaccaaaggagcctgagcaggtagagaagaaagcaagcccagctctgccaattccttactgaataactgtgggtaagttatttctcccccacgaccttagtctactcagctaggcccagtggggaggaagaacctaaggttacaacaatgagaaaggagaaaagggagtttggcagggaagccccagcatcagctggctgtaccattatgcttagtattctctcagagacgtttccccccaaatctgtatctgttgtcccgtaatagaagtccaaagatatgttgaccttaattcaggaatttacggaccatcaggcctcatggggctgcatttattctgcaactggggacgcttgaccttgaaggggaggtccttggtccaggggccaggatggtgtctacatgcagtttcaaagataagctttcaggccgggtgcagtggcttatgcctgtaatcccagcaatttgggaggccaaggtgggtggatcactttgaggccaggagttcaagaccagcctggccaaaatggtgaaatccagtctctactaaaagtacaaaaattagccgggtgcagcctataatcccagctactcaggaggctgaggcaggagaatcacttgaacccaggaggcggaagttgcagtgagccaatatggtgccactgcactccagcttgggtgacaaagtgagactctgtctcaaaaaacaaaaaaaaaaaacaaagataagctatcaaagtgggtcttttttttttttttttttttttttttgagacggagtctcgctctgtcgcccaggccggactgcggactgcagtggtgcaatctcggctcactgcaagctccgcttcctgggttcacgccattctcctgcctcagcctcccgagtagctgggactacaggtgcccaccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcccaaagtgggtctttaaagcaaattacactgtcttttactgatcaataagtagacactctatgtaggtaccttttgctgttgagtttcgcctgttgcctcctggcagaagtgaagaaaacctgttgacacagtagccactcttggtgtaggcactggtagaaccctgcatggagagaaagttaccattcttattagacctcaaggtctcctcgccctcttgcctcctcattctgcaggaatgttactcgaccaaagatggctctcaacaaaccttcctgcaggaaagtgtttcaagctccactccaggcacagctgttgtggcgtatgaggaaaatggagcacaaagaatccctcccactacagaccaggcctactggcatagggggcaggcagctactcaccctggaggccacgataagggctctttttccaacagggcacacgaccacaatccattcctgccccaaatctgaaggaacgtcaattaaccactcagaaagcatcaactggaaatgcaaaaaatagtgttaaagatcagcaggggtgtgctactcgaaagtctgcaatgacaaggcattaatatcctgtgtgtatattaaaaacctgagtgaaagaatgagggcagagagccgggcacgggggctcatgcttgtaatcccagcactttgggaggctgtggcaggtggatcacctgaggtcaggagttcaagaccagcctggccaacatagtgaaatctcgtctctactaaaaaatataaaaaattagctgggtgtggtggcaggcacctgtaatcccagctactaggaaggctgagccacgagaattgcttgaacctgggaggcagaggttgcagtgagccgagatggtgccattgcactccagcctgggcaccaagagcgaaactctgtctcaaaaaaaaaaaaaaaaaagaatgagggcagaaaaggctgacagtggcacctccaccccatgtgctctagggagttggctgtgtctcctgcacagctgacaggatgatgggggccactgactatgaactttggcttctctcctccatctccacctgcaaccacaccatgcttactgcctcacctcccgggtcagggtgatgaaccctcttcctttccttactttgtccatctgctcctatcatcattactattatgtttgccacaactcagagatgaataagatccctgaccttgagatgctcttagactagaccagcatttctcaaaccgatgccccaaatactatactacaggatgttaggaaatctgtcttaaaaaacgaaacaacgccaaaccaaaccaacaaaaacagtgatgtggtgaaattaatttgggaagacaaactcttccactcagtctcttccatctgtaaagactttgtcccatgggctgggcgaggtggctcacgcctgtagtcccagcactttgggagaccaaggcgggcggatcacgaggtcaagagattgagaccatcctggccaacatggtgaaaccccgtctctaccaaaaatacaaaaattagctgggcgtgttggcgggcacctataatcccagctactcaggaggctgaggcaggaaaatcgtttgaacccaggaggcgcaggttgcaataagccaagatcacgccactgcactccagcctggtgacagagtgagacttcgtctcaaaaagaaaaaaaaaaaaagactttgtcccatcaattaatctctctcattgaatctttcatttctccttccctttaggcactcactcccaatctttttttttttgagatggagtctcgctctgtcgcccaggctggagtgcagtggcgctatctcagctcactgcaagctgcgcctcccgggttcacgccattctcctgcctcagcctcccgagtagctgggactacagtcacccgccactgtgcccagctaattttttgtatttttagtagagacggggtttcaccgtgttagccaggatggtctcgatctcctgacctcgtgatccgcccgcctcggccccccaaagtgctgggattacaggcatgagccaccacgcccggctcactttaaaaaaaaactttttgtggccaggaacggtggctcacgcctataatcccagcactttgagaggctgtggcgggcagatcatgaggccaagaaatcgagaccatcctggccaacatggtgacaagccgtctctactaaaaatacaaaaattagccaggcgtggtggcatgcacccgtagtcccagctactcgggaggttgaggcgggagaatcacttgaagctgggagatggaggttgcagtgagccgagatagcaccactgcactccagcctggcgacagagcgagaccccgtctcaaaaaaaaactttttgtcactcagcatttctgttgagctactccactttctcctagtttaaaaactacttaatacttcttgatgctgccttcttgctcaatctgacagccacagtccagatttcctaccccacagtcctactgaaggccctctgacctcttctcataactcttcctttttttcctttttttttttttgaactggagtcttactctgtcacccaagctgaagtgcagtggcacaatctcggttcactgcaacctccacctcccgggttcaagcgatcctcccattttagcctccctagtagccgggactacaggcacacgccactacgcccggctcatttttgtatttttagtagagacagggtttcaccattttggccaggctggtctcgaactcctgacctcaggtgatccacccacctcggcctcccaaagtgctgggattacaggtatgagccactgtgcctggcctcccatacctctttcttatcctccccactctactcctcgccttacgtaatgctaccagccacatctcccttcctgacatccgttcccttggcaccatgacatagcactactctgtttttccctctaaacattcctccacacactcccccaaaatatgtaatcttcagggggctgttttaggtcccccttttctcttagatgctgttcccattaggggtggatctcatctatttctatagcttcacttgtgcctcctaatgctccttcatctccagacttctttcctccacactcatctatattgcgagatgtctgcttggtatctctttctgtttgtctcctctgcaccgaaaactcagtatatccagagtggaattaactgccttctgttgcctaagtacttcccacccctgaaacacctacccttcccttctgcgtctcataaccttgttaatggcatcaccactccgttactgaatcttagagtttaagcataatctaggcaaattagactacatcaaaatttaaaaattctgtgctgccaacaatatcaccaagaagacaaaaagacaacccacagaatgaaagaaaatatgtgcaaatcatgtatctgataagaaacttgtatctagaatatattaaaaactcttataattcaataataaaaagataaataactcaattaaaaaacaaggagggcagatcatgaggtcaggagatcgagaccatcctggctaacacagtgaaacctcgtctctactgaaaatacaaaaaaaattagccgggcgcggtggcgggcacctgtagtcccagctgttcgggaggctgaggcaggagaatggcgtgaacccgggaggcggagcttgtagtgagccaagatcgcgtcactgcactccagcctgggcgacagagcaagactccatctcaaaaaaaaaaaaaaaaaaaaaaaagagcaaaggatttgaatagacatttctccaaagaagatatacaaatgaccaatacgcacaagaaaagatgtttaacatcaggccaggtgcagtggctcacacctgtaatcccagcactttgggaggccgaggtgggcggatcacaaaatcaggagttcgagaccagcctggtcaatacgctgaaaccccgtctctactaaaaatacaaaaattagccggaagtggtggcgggtgcctgtagtcccagctactcgggaggctaaggcaggagaatcgcttgaacctgggaggcagaggttgtagtgagctaagatcgtgctattgcactccagcctgggcaagagagggagactccaactcaaaaaaaaaaaaaaagaaaagaaaagaaaagatgtttaacatcattagtcactagggaaatagggaaatacaaatcaaaaccacaagaaaccacttcacacccactaggatggctatatttaaaaggatggacaataacaagtgttggcaaagctgtggagaaattggaacacttatatgttgctggtgggaatgtaaagtagtggagtcactttggagaacagtctagcacttcctcaaaaggttaaacagagttatcatatatagacccagcaattccacttctaggtatatacacaagagaaatgaaaacatatgctcacacaaaaacttgtagtacaagaatattaataatggcattatttggctgggtgcagtggctcacacctgtaatcccagcacattgggaggccaaggcaggtggatcagctcaggtcacaagttcgagaccagcctggccaacatggtgaaactcccgtctctactaaaaatataaaaattagctgggtgtgatggcacacacctgtagtcccagctactagggaggctgaggcaggaagatcacttaaactcaggagatggaggttgcagtaagccaagaacatgccactgtactccagcctgggtgagagagtgagacttcatctcgaaaaaagtaaataaataaaattaattaaaaaacaaataaaaatggcattattcataatagccaaaaagtaggagcaactcaaatagccataaactgaagaataaataaacaaaatgtagtctatccatacagtggaatattatttggcaataaaaaggagtgaagtactgatacatggtacaatatgatgaacgttggaaacctcatgctaagtaaaagaagccagtcacaaaagtccacatattatatgattccctttctatgaaatgtgcaaaataggaacagaaagtagattaatgattaggggctacagggaagaatggagagtgacactaattagtatggggtttcttttggggataaggaaaatgttctagaattaaatagtcgtgatggttgcacagtcttgtgactacactaaaaaaaaagaaaccattaaactatacaataaaaataggcaaattgtatggtatgtgaattatatctcaatataactgtctaaaaaatagtagtagcagctaatacttgtggggcacttccagactctgggctaggtatttaaggcatattatttcatttaatccttctaccaatcctatgagataagtactattactatccccattttacagataagaaaccaaagacttagagtggctaaaataccttgcttaaggtcaacacagagcctagctttgagatcagatctgtgtgacctcaaagcttacatcctttcccacttcttatactgcctctcatatccagtccactgctaagttcttccattctatctggcaacatttcttttttatttgttttatttattttttattttttatagaaatgggatcttcctatgctgtccagctgggattacagacacccatcacacctggctaatttttgtatttttaatagatggggtttcaccatgttggccaggctggtcttgaactcctggccttagcctcccaaagtgctgggattacaggcatgagccactgtgcccagcctctgcacatatttttgaggccctttacatctcttctgccatactccttctcccaactctatgccactctaccctaactggcctgcaaactgctcccgggcacaccatatactcctttctggcttctgggcctcgtgctcagcctgtttgttcccactgcctggaatgccctaaaatgcactgcacttctatctattaatgtcctacttacccttcaaggctgcctcttccttcattaacccttctctgatttcacaccccctccttcctccttggttggaaggaatctcatttttttttttttttttttttttttgagacggagtctcgctctgtcgcccaggctggagtgcagtggtgtgatctcggctcactgcaagctccgcctcccaggttcacaccattctcctgcctcagcctcccaagtagctgggactacaggcgcctgccaccaccacgcctggctaattttttttttgtatttttagtagagacggggtttcaccatgttagccaggatggtctcgatctcctgacctcgtgatccacccgccttggcctcccaaagtgctgggattacaggcgtgagccactgcacctggccagcatctcacttttttatagcacaaaacatcttctacacctattctaggagcacaggggctatttctgctccacatctatcttcccatgtcatagcctagtttaacacagagcaggtctttcaataatgcttactgaacaaaattgaattgtactttgtcacagaggatgttatctgtactgtatttggggtaaagaaaggggctgtgggagtgcatccaataaccatattctattgtgtttttttttttctttagagatggggtctctccgggtgcagtggctcactcttgtaatcccagcactttgggaggccgaggggggtggatcacctgaggtcgggagttcgagaccaacctgtccaccatggtgaaaccctgtctctactaaaaatacaaaaacttagccgggtgtggtggcaggcatctgtaatcccagctactcgggaggctgaaacaggagaactgcttgaacccgggaggcagaggttgcagtgagccacgatcgtaccactgcactccagcctgggcaacaagagcaaaactctgtctcaaaaaagaaaaaaaaagagatggggtctcactatgttagccaggttggtcttgaactcctggcttcaagtaatcctcccaccttggcctcccaaattgctgggattacaggtatgagccaccacactcaggcccaggaaccatattctaaaggcaggggagaattctgagatgacaagatacttgggttctagacacaagtatatgatagcagggtagacctccatcccaacttggacccataccctgctttctgaaatacctgagctgcctggaacacaagaacagtctctctccatacctctttccctatggtaccacagccatgttggtttcctctctggatctaaaagggcactgagtcaggtttattatagtgatctgctgcttcatggcctgaacctcaccttggccagctggctggtctggggtggctgggcaggctcactttattcaagggcagctgtacttcccacttgccaccacctgagtgtgaaatttcaagactggcctcatagtacactgcctgggaaagactctaccacccagggaagtggaaggagtcagtggtaggctgggcaggcccaatccagaacagctgtgcagtgacaactaaaaaaaatgacaaggatatggagtgtgttactatatcaatagctcaggggctttctgcagtgggctggcagcctttggtaacagcacaggctaatagttcccaaaccccactacccacagattccatcagtgattcctagtcagtccatagcacagtaagccatctctacttatcatcccatatgatctacgtacactggcatgttctttgcagttcctattcctttttcctgcctcattctcctctctttatgacagcatttatttcagtgggctttgactgcatagtaaagggagtgagattagctgggtctcatcttctctggaccacttacttgattagcatagtgttttggtaacttcttgacagtgtcaatgtccatttcttcatcatctttcttattttcttcctcactctccatccctgtccagtcatcttcagccagtcttctggcatggttcacataatccagccgcttgctggaaggaaaaaaaaggcataaggacatatcttttcttctttttttttttttagacagggtctcgctctgttgcccaggctggaatggtgcaatctcagctcactgcagcctcaacctcctgggctcaagtgatcttcccacctcagcttccacagtaggtgggactacaggcacacaccaccacccctggctaatttttgtattttttgtagagatggggtttcaccatgttgcccaggctggtctcaaactcctggcctcaagtgatctgcctgcctcagcctcccaaagtgctgggattattaggcatgaaccaccgcatctggccagggcaggtctttatgtcttttaggaagatgccctataatgcgacacatttaattcaaaagctccaaatttgggagcaacttggggattctggtggaagtaagaaatgatggaatctcctttgcaaggctaaaacagtgaccgccccctcaaaatcctaaatagcgaaaccccctctgaatacactcagccttcctcagagtttcctaagaatgcaaaataaaatatctaaagaaatttccaaggttcactagatggaaaggctagcttcacccctaccccatcccaccccagatgagagctgacaccttcctgcctagcagacatctcatccaaagaccccaggggtggaagagaagagccactgagatgcagtgagaagtctaaagcaaggacagcttctggagatttctgccttatacaccttttttgtttttaaagagaacttttttttttacggaccgtaggtgtatgccactgtgcccagcttatacagctttctcagaagccaggcctttctccagttcctgtctaactttcaaaaaaggtcacttagtttacaatttaatatattttatttatttgtttccctttatcgttatcttgttttaaaacaacacatgctagaaagtttgggaaactgaaaagaaaaaaaaagaatcttttggaacctaattgtttcaaagtgatttggaaataccacataacctcccacatttgatttcttcaatgctaaggcaggaattcaaccactgaggcagtgaaaccaacacagctggtttctcttaaacacatacatgttcatgctcattataaaaaggcacacaccagagagaacatatgaaagcacaatggtcttttatctcgagaataaaagagctggtatatttgtacatgtgtgaaagaaagtctgtctgtggttatttcctgaacattgtttgtaatcacaagagaagaaaactgcccagatgcccatcaggagggactggcttgatggcattatgaagtatccattccacggaatacctagcaccacgaaaaaggaatgatgtggtactttatgaactgatatagaatttctcccccaaaacaccactaaataaatgtgcagaacagtatatagtatactgctacttgtgttaaaaaaaaaaaaaaaaaaaaaaaaaaaagccaggtgcagtggctcctgcctgtaatcccagccctctgggagggtgaattggccagatcacttgagctcaggagttcaagaccagcttgggcaacatggtgaaattgtgtttctaccaaaaataaaaaaattagctgggtgtggtggcctgcaccagtggtcccagctacttgaggggctgaggttgcagtgagccaagatcatgccacagtactcagcctgggagatagagtcaaaaaaaaaaaaagcttttgtacacatactaccacacacacttgctcatatatgtatagaatatcttcggaagggccaggcgtagtggctgacgtctgaaatcccagcactttgggaggtcaaggtgggaggatcagttgagcctaggagttcaagatcagcctgagcaatatagggagaccctgttcctacaaaatataaaaaaattagccaggtgctatggagtgtgcctgtagtcccacctacttcagaggctgaggtgggaggatcacctgagcctgagaggttgaggctgcagtgagccgggatctgcacactccagcccgaacaacacagtgacaccctgtctaaaatatatatatatttggaaggatacaccagaaactaataatataggagaggaactggatagctaggggacagaaatgggaagacctcaccatatactcttctatttattttatttatttatttatttattggagagagtctagctgtgttgcccaggctggagtgcaatggcgcgatttcggctcactgcaacctccacctcccgggttcaagtgattctcctgtctcagcctcccgagtagctgggactacaggcacgcaccaccatgtcgggctaatttttgtatttttagtagagacaagttttcgccatgttggtcaggccagtctcgaactcctgacctcaggtgatccacccacctcggccacccaaagtgctgggattacaggcgtcagccaccatgcccggcctcttatgtatattttaaattttcaaccatacaaatgtattacctattcaaagataactacatttttaaaaatggggagaggaatgatctgggaatgtattctgcaagccacccagagccacagggaaccatctctgccaaacacaaccagtgatgcaacactgggcaaaatgcagactgtatggaaactatgcagctgttagtagtttcttctgatccctaattccttaatttatgacccagaagaggcccatgctgcattgagaatacaaggatcggccctgccttcagagtagctcagcctcaaacactcttatcctgccctctttccctgtttgcacatcttggcacttagaattaagtatatggaagacatttcctcagattcccttaggaattatttgtcttgaactcccaagagtgccacagaaacatttgggctgaaggcagatgggaagaccacaccaataccagcattcagagtgcagaagccaaacacaagcatcccaggaaatgtggggagtgaaagtctgggcgtggctttcgcaagttcctaaaccacagagctcagtacagctgccaggaaaaaaagaaaaacttaaccaaataattgagcttttggtttcaaacttcggtgtctccctaattcctcatcttctcctaagctctgggtataaaagaaacctacctctgccaggatttacccctcccaacctgtgggcaagaagatcagcctacaaagagtctactttgaagggagagtctgtagagacaagcctagagccttcggaatggttcatagctcctagcccagagaaagaagacaaggagttaaagcttccttacgatttctgcagttccagtaacctccggcggcgctcactctgctccaaggaactgtacttggacttgtactgggataggcgggggtgtggggcagctgtgctgttcagatcttgagacacagaaaagctactagccagggcctgactcaactcttccatcttccctacaaaggaaaacgtaagaaaatggttcattcatttcatatcatctcctgtatacagacagttatgcagttatgatatgatggccacattcctgaaaaaaaattaacttaatgcaaaatcacaagtgtttccatgagacaaaaggaagttaaagggtaaatgagtcatatattagcaataacattattttcctacagatatttccttttttttttttttttgagacagggtctctctctatcacccaggtcggagtgtagtggtgcaatcacagctcactgttgcctcaatctactggacccaagcaatcctcccacctcagcttccccagtaactgagactacaggtatacaccaccacacccagccaattttaaaatttattggtacagacgggatctccctatgttgcctaggctagtcttgaactcttgggctcaagcaatcttccctcctcagcctctcaaagtgctggcattataggtgtgagccactgcgcccggccttttctgagcagttcctctacagtttcctgaatagccatcactcattaaccaatataactctccatgcagtttattcaattggttatttaattctcaactaagtgccaactcatattatgaaaatttaattccagaggaaacactggttctagggtccctggaggaagacaaaagcaatcaaaaaccccaaactcgccaggcacgatggctcatgcctgtaatcccagcactttgggaggccgaggtgggtggatcacaaggtcaggagttcgaaaccagcctgaccaacatggtgaaaccccgtctctactaaaaatacaaaaactagctggatgtggtggcaggcgcctgtaatcccagctactcgggaggctgaggcagaagaatcgcttgaacctgggaggcggaggttgcagtgagccgagatcgtgccactgcactccagcctgggcgacacagcaagacttcatctcaaaaaacaaacaaacaaacaaacaaaaaaacaaactctagcgacctgggattacaggtggctcatgcctgtaatcccagcactttgggaggccaaggcaggaggatcacttgaggccagtagttcaagaccaacctggacaatgtagtgagactatgtctctactttttaaataaaaaagtaaaaaattattttaaattataatttattttttaaaaaatctgattgttacttcctcatattctagttgtgttttgtttttgggtgggcagaaagaaggtttcagggctacttatgtgggactcacttggaaaagagctaggatgtggaaggctgcttaacaagtaacgtcaatgctccagtagtgtgaagaacttccataaagtacattagggaaacaagacaggcatggagtagatgtcattttgaaaacagacttcccactttaggtggaccctaaagaatgggagtggggagaaaggtgaattcacacttcattcaagcgcctgtgagccttagattataagaaaacaggaacatttgggagaaatctgacttgcactgctgggctggcccagccctttggttctagtgtaaaccagagggcacctccagtgcttaacctccatcccaggccaggtccagtgctctgagcatcaaaatcaacaggttcattccagagcctctacagtgaaaaatacaactccataggcctctacttggccagtgagttactttccattgcacaagtgaagtcagatatttttcttgatttgaaacattagattttgtttaatttaaaaggaacttaaaaatcgtggtttgccaggtgcagttgtgcttgcctttagtcccagctactctggaggctgaggcaggaggtatgcttgagcccaggagttcgaagccagcctgggcaatatagcaagaccttgtctgtaaaaagaaaaaaaaattgtggctaaatacacatatcatgaaattcatcatcttaaccatttgtaggtgtacagttctgtaaagttaagtatgttcaacactgctgtgcagaactctccagaactccttttatcttgaataactgaacctctgtaacctttaaacataaaagaaacttttttttttttgagacagagtttcactcttgttgcccaggctggagcacaatggcacgatcttggctcaccacaacctccgcctcccaggttcaagtgattctcctgcctcagcctcccgcgtagctgggattacaggcgcccgccaccacgcccggctaattttgtttttgtattttttagtagagacggggtttcaccgtgttagccaggatggtctcgatctcccgacctcctgatctgcccaccttggcctcccaaagtgctgggattacaggtgtgagccaccacgcccggccttttttttttttttgagacagggtctcactttgtctcccaggctggactacagtggtgtgatctcggctcactgcagcctccacctcctgggttcaagtaactctcctgcctcagcctcctgagtagctgggattatagacatgcaccaccatgctcggctaatttttgtatttttagtagagaagaggtttcattatgttggcgtggctggtctgaaactcctgacctgaagtgatctgcctgcctcagcctcccaaagtgctggaattacaagcatgagccactgcacccggcttgaggtgtgccttaatatctttgcaatgcaaccaagggttgccattcctgagtgactgaggcctcatgatgagtgcttgggatccatatggtatgttattcaaatcatccataatggtatgtatgctattgtctctacttttctgtacttttgtgtaagtttgaaagctttcatgataaaattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttcagtagagacggggtttcaccgttttagccgggatggtctcgatctcctgacctcgtgatccgcccgcctcggcctcccaaagtgctgggattacaggcgtgagccaccgcgcccggccgataaaaatttttaaaaagtcattatgttttcagttcatcaccaaagtaatgaccaaatccaaagcacctttattaggcctatcatgcactatcttggtgtgggctcccgctctgccaagaaccacacaacctttgaaactgatgtcctgggcctggcgcggtggctcacgcctgtaatcccagcactttgggaggttgaagcgggcagatcacctgaggttaggagatcgagaccatcctggctaacacagtgaaaccccgtctctactaaaaaaaaaaaaaaaaatacaaaaaaattagccaggcatggtgacgggcgcctgtagtcccagatgctcgggaggctgaggcaggagaatggcttgaacccgtaaggcggagcttgcagtgagtcgagatcgtgccactgcactccagcctggacttcgtctcaaaaagaaaaaaaaaagaaaaactgatgtcctggatactggggcggttcctttaccttccttcaaggctgttcttggcgggttcctgctgtttcgttttgttttttctttgttgttgttgttttttttttgagacagagtttcgctcttgttgcccaggctggagtgcagtggcatgatctcggctcactgcaacctccatctcccggattcaagcgattctcctgcctcagcctcccgagtagctgggattacaggcacgcgccacaacgcccggctaattttttttgtatttttagtacagatggggtttcaccatgttggtcaggctggtctcaaactcctgacctcaggtgatccgcccacctcggcctcccaaagtgctgggattacaggcgtgagccactgcgccccgccgggctcctgctgtttcaacccattccttggatggtgctgcctccaagtgttcggaccttagccccaggtggtcttagcaccagtaacccccgctccaactccctaaagtccgacccgccccaggccccgcccacgctccaccctccctccctgtctagccccctcccccatccccttccccctccttcgcgtctccccatccggcgcccccgcctcgcgtcccctgggtccgcatcctggcagcctccgcgtttccctacccctgctaccgggctccagccccggggacgctatctgcttcactcggccgtgcgcgccgccaccgccccgcactgcctttttctaggcatggggtcatctaggccatgcatgattcgcccctgccccacagaagtccctgaggggtcctggccggacagcacggaatagaagaacggaaactctcccaaaaggagtcccaggcctggctctatccctccagatgacgtcccaggaggccagagtgcagggccggccagagggagtcacagtccggcaccgagaggcaactcggcagctggcggggcccgggctcgaacccagggactcacccaaaccgaggtgaccgtcgcacgcgccgccgccaccggggccgacgaatcacctgccctgggaagctaggtccgccctccccccgcccccagctgctgcctcaccgctgggcccacaggcctcgcgccctgagtttccggctcctccctcctttgcgaacgctgggagttccgttgcctacaggccgttatttccgccttcaacggctggggcatttcccatcggctagggagggggtcttcttgcatttgctttgcactgtccgggactcttcctgctagatgacttgaccaggccgaggcctccctcctgaacacaagctcttcggggctcctttcgccaatgggaggaggctgatcttgtggccgggcattcaacgccctgggccctgccgcctcccgcagatcttcccgggccttagggcttcacctggagtccccttcccctcttgggcccgtgctcttaaacgggcagtgccaattgcctggattactccaactaacccctcacacccaagtttcagacacagaccttcgctcccccacttgcccttaacaaaagcagatacatacctcgattactgcctgtttgctgcttttgcgagcttctttcccactcggctgcgggctgagcaatggtagggacctggcttgattcctatttaagtagccagagtccagcacaagggatggcgctcagtagaccctgcgtgaaggaatgattaaattggtgcaaaagactagggtaagcggcagagatttaggagattaagtcctgccagggtgtagcctctgcagggcgggaaggctgagattacaattttaaaactgaatatttattgaatgcttacattcagccaatccctgcttcacacccatcatctcatttaatttttttccttttttttcttttttaagccagtagatattaactcttaatcatgacatgaggaagtagacacactgaagctcagagaggttaagtaatttggccaaagtaacacagctttcaaggaaaatgtttgaatttgctgaaagtttgatgtatagggaagttgactaccgatgtatgacagaagcaaagtatccacctttggcacattttgcgtccacggaatgctaaaatttggacttgtgtattttatgcacattacaccatacattcagactaaaaagaataggaaattaggctgatgaaaggctattactagactggtaaaaagggttctggggccctggaaggccaatttttctggacgtgagatttttttttatttttttgagatggagtctcgctctgtcgcccaggctctggagtgcagtggcgcaatctccgctcactgcaagctccgcctcccgggttcacgccattctcctgcctcagcctactgagtagctgggactacaggcgcctgccaccatgcccggctaatttttttgtatttttagtagagacggggtttcactgtgttagccaggatggtctcgatctcctgacctcatgatctgcccgcctcggcctcccaaagtgctgggattaaaggcgtgagccaccgcacccggcctggacctgagattttatttaggtggctctttcagtggccaggctgagcaaagctgtccactagggtatttatttggtgcatccacaaataaaagctcatgtctgcctgatttatgagactgacaaaaaagagaagtccagggcctgacttcactagggaattttgacacccaggatattaggtattttgtgtccaaacaaccatcccttacaaccacggaggtcacatctaatggtcgggctgcatagaaaagaataaagaccttaaacattttaggaaaatagactgagactgagaaagaagttcccaaattcatgcctggaggtccaggagaaatgttctagttcctcactcacacctagctgaataacttcccatatcactgaaaaaacaaaacaaaaccaggtcaggcactgtggctcatgcctgtaatcccaccactttgagaggccaaggtggaagtagcccatgagtttgagaccagcctgggcaacatgacaaaaacccatctccacaaaaaaaaaattagctaggtgtagtggtatgagtcatgatcccaactacttggaaggctgaggtgggaggatcacttgagcccaggaagtcatggctgcagtgagctgtgatcctgccactgcactcagcctggagactctgtctcaaaacaaacaaaaaccagagcacctggcccaggggttcatttagagccagtgggtgtttcagaaggggctacctctggaatctcagcttcagaatgttggccacatgcacacactgtgctttatgtctttaaatcaattaatttaagaaaaaagcctgactacatttatttaaaagggcaacattggccaggtgtggtggctcatgcctgtaatcctagcactttgggaggccaaggcgggcagatcacaaggtcaagagatccagaccatcctggccaacatggtgaaaccccatctctactaaaaatacaaaaattatctgggcatggtggcgcatgcctgtagtcccagctgctcgggaggctgaggcaggagaatcacttgaacctgggaggcggaggttgcagtgagccgagatcgcgctactgcactccagcctggtgtcagagcaagactctgtctcaaaaaaaaaaaaaaaaagggcaacatcatagcattaccttacatcaatcacttcccactttattagaaggtatctataaaataaatacattgctcatgcctataatcctagcactttgggaggctgaggcagacagatcacctgaggtcaggagttcgagaccagcctgaccaacatggagaaaccctgtctctactaaaaatacaaaattagctgggcatggtggtgcatgcctgtaatcccagctactcgggaggctgaggcaagagaattgcttgaacccaggaagcggtggttgcagtgagccgagatcgcgccattgcactccagcctgggcaacaagagcgaaactccatctcaaaaataagtaaataaataaatacgtgaaaataatgttataggctggtgcaaaagtaattgcagtttttggccgggcgcagtgactcacgcctgtaatcccagcactttgggaggccgaggcgggcaaatcacctgaggtcgggagtttgagaccagcctgaccaacatggagaaaccccgtctctactaaaaatataaaattagccgggcgtggtggcacatgcctgtaatctcaggtactcaggaggctgaggcaggagaatcgcttgaacccaggaggcagaggttgtggtgagccaagatggcgccattgcactctagcctgggcaacaagagtgaaactacttctcaaaaaaaaaaaaaaagtaattgcagtttttgccattaaaattaatggcaccaacctaatataatcttgctagatagatatggatgtctgcagaaagctgtaagtctggggactttgtaaaaatcagagattagcaagtgttgaagtgataaggagtcacactaacagaatttttctttgacgtaatcagaaaaattcaaagaggacagaagagggaagaaccactttctcactctattattcaatgtcattaaagtggaatctgtgtaccccttaaaatcttctggttgcccatgggcaggagaatccttacttagaaaagagaaggttgagagcaggaaggtgtccagcccagaggggaaatggagggaggtaagatcacagaggctgctgggacacaggggcaggtaagggcctcaggccacggtggggagtttggattttacctccactgctgaagagggtttatttttttggggggtgcgtgggggttgtttttgtttttgagacatatcttgctctgtcgcccaggccggagtgcagtggtgcgatctctgctcactccaacctccgtctcccaggttcaagcaatcctgcctcagcctcccaagtagctgggattacaggcatgcgccaccatgcctggctaatttttatatttttagtagacacggggtttcaccatgttggccaggctggtctcgaattcctgacctcaggtgatccgcccaccttggcctcccaaagtgctgggattacaggtgtgagccaccatgcctgtctgcagatgagggtttttaaacagttatgagatagcagattccagctttagtgagctcccgctggctacttggtagacaactgaatgtaggcaaccaagtgtggaggcgtggaagccagtgagcagaccttgcatgaaagtatgtcgggggatgtgataggattaagatataatctaaaaataaaacctggacagtttgttactctttttattgagatggagtcttactctgttgctcaggctagagtgcaatggtttgatcacaactcactgcagcctcaatcacctgggctcaagtgatccttccacctcagcctctcaagtagctggaactacaggtgcatgccaccacacccagctaatttatttatttatcttatttatttatttatttgagatggagtttcgcccttgttgcccaggctggagtgcaatggtgctatctcggctcaccgcaacctccacctcccgggttcaagcaattctcctgccgccgggcgcagtggctcacgcctgtaatcccagcactttgggaggccgaggcgagtggatcacaaggtcaggagatcgagaccatcccggctaacacggtgaaaccccatctctactagaaatacaaaaaattagctgggcgtggtggcacgcgcctgtagtcccagctactcgggaggctgaggcaggagaatggcgtgaacctgggaggcggagcttgcagtgagccgagatcgcaccactgcactccagcttgggcgacagagcgagacgactctgtctcaaaaaaaaaaaaaagcaattctcctgccttagcctcccaagtagctgggattacaggcatgagccaccatgcctggctaattttgtatttttcagtagagacgggatttctccacattggtcaggctggtcttgaactcctgacctcaggtgatccgcctacctctgcctcccaaagtgctgggattacaggcctgagccaccacgcctggcctaatttatttttttagagacgaggtttagctatattgcccaagctggttttgaaaaactgggctcaagagatcttcctgccttggcttctcaaagtgctgggattacaggtgtaagccaccatgcctggccagtttattactcataaaataggggaaattagcacgaattatacatgcgtcctagtctagtccccagccaaaactttccccctgaggtttattagatctgagagaaaataggaaagggaacaacttcctccctaaatcgatgttgttaaaggccaaggccatgcaccatctaagccattttgaggaccagtgcttctcattggccacctggagacaccttgtaggacagtaaagaagtcagttatgggccgggtgcagtggctcacgcctgtaatcccagcactttgggaggccgaggcgggggaatcacgaggtcaggagattgagaccatcctggctaacacggtgaaacaccgtctctactaaaaaatataaaaatttagccgggtatggtggcaggcgcctgtagtcccagctactcgggaggctgaggcaggagaatggcgtgaatccgggaggcagtgcttgcagtgagccaagattgtgccactgcactccagcctgggcgacagagcgagactcagtctaaaaaaaaaaaagtcagttatggctggtcgcagtggctcacacctgtaatcccagcactttgggaggccaaggcaggtggattacgaggtcaggagtttgagaccagcctggccaatatggtgaaaccccgtctctactaaaaatacaaaaattagccaggcatggtggcacgcacctgtaatcgcaggtactggggaggctggggcagaagaatcgcttgaacccaggaggcagagtttgcagtgagccaagattatgcccctgcactccagcctgggcaacagaatgagactccatctcaaaaaaaaaaaaaaaaaaaaagaagccagttatgctaggagggagaagcagacgtgaaagggtggcaaagtcaggcatcaaagggggtcacaggagccagggtacagaaactgcagccacaggggaccctaaagctccagggagccaaacctcttccctactcccaccccaccccaacccacccccatcccaaggtccctgagccccagtcctgggtgagagaaatcatgaaagtggttaaggattaaggtcttgggccctggagctagatggcctagatccaaatccagactcaggtacctgttggcacagtggcctgggtttgttatttcaccttctgtgctcaattaccctctctgtaaaatgtggttaacaacagcacctagctcataaggttgttatacagtttcattgagctaatctaggtgaggtgattagaatagtacctggcacagagtaagtctttaaaagtgctgttttgttagtctttaacttgttataaaataacccctccatgactgatttacttatatctacaataaataaattgacacctacttaggtgagcccaagagaatctcttctctgcagacaaaagtgcttgcccagacttgaggtgacatagtttgcccaggttaggtacaggcagagggtgactgggtgagaattttaatccagactttcagcccttacggactccaaaattcctgactttttttttttttttttttagacagagttttgctcgttgccaaggctggagtgcagtagcatgatctcagctcactgcaacctctgcctccagggttcaagtgattcttttgccctagcctcctgagtagctgtgattacaggcgcgcaccaccatgcctggctaattttttttatttttagtagaaatggggtttcaccatgttggccaggctggtcttgaactcctgacctcacgtgatccatctgcctcggcctcccaaagtgctgggattacaggcgtgagccaccgggcctggcttttttttttttttttttttgagacagggtctcactctgtcacccaggctggagtgcggtactgtgatcttggctcactgtaacctccacctcccgggctcaagcaatcccctgatctcagcctcccaagtagctgagactacaggtgcttgcccccacacccagttgattttttttttttttttagagacagagtcttgctctgttgcccaggctggagtgcagtggcgcgatctcggctcactgcaacctccacctcccgggttctagcaattctcctgcctcaggctcccaagtagctgggattacaggtgcacaccgtcacacccggccaattttttgtagagacagggtttcactgtgttgcccaggctggtctcgaactcctgagctcaggcaatccaccagcctcagcctcccaaagtgctaggattacagcactttgggcgtttacagcactttcagccaccgcgccaggcctgatttttatatttttagtagagatggggttttgccatgttgactaggctggtcttgaactcttgactcaagcaatccacccaccttggcttcccaaagtgttgggattataggcataaacctggccaaaacccctgatttttatcccatggacccatggaatgttgcctgccctgtattttttttttttttttgagacagggtcttgctgtgttccccaggctggagtgtagtggtgtgatcacagctcatagcagcttctacctcttaggctcaagtgatcctcccacctcagcctccctgagtagctgggaccataggtgaatgccaccatgcccagctactttttttttttttttttttttcctgtaaagacaaggtctggttatgttgcccaggctggtctcaaactcctgggctcaatcctcccacctcagcttcccaaagtgctgggattacaggcataaaccactgcacctgggccctgcctcatattttaaggggtctactttcactcctgagtttcagctcatgagctgaatgaatgagtgatttggttcatctctgctgagattctgcccttccatgcagggaaccagcctggccccaggtaggggggaaatgtcctttacaaactgcccaggggcttcaaagttgggacccattcttggattttttttggtttttctttgagatgaagtttcgctcttgttgcccaggctggagtgcaatggcctgatctggattcactgcaacctccacctcctgggtttgagcgattctcctgtctcagcctcctgagtagctgggattataggggcctgccacgacaccaggctaattttttgtatgtttagtagagataaggtttctccatgttgtccaggctggtcttgaactcctgacctcaggtgatccacccgcctcggcttcccaaagtgctgggaatatagacatgagccaccgcacccggcctttcttggatgttaaaaccaaggtttgtcctaaagattgcacagctttctggagccagggctggggattgttggggcagtgaagcacgtctaaattcttctctactttgcaagtgttgacagcactcttttatatccttttctctaaatcagaaacagagcagaaactagagccatctcgtcctgcctcttcctatcatagaaaggagatggagggaggcctagagagagaaggagaagcttatgcccccagtcccgcagcaagtcagaggcggacaagacccctcttccctgaagcccctgcagcctctctgcccctctgctgctggaataggatgcagcatctgcatgatgtttgctctgtgccaagcactgggctaggaacaaggcctgtgcttttccaagtgtggtcccctgactagcagcaccaaaatcacctgggaacctgttagaaatgcaaattctcaggcccgccccagacctcctgaatcagaaacatgaagggggctgggcgcgttggctcacgcctgtagtcctaacactttgggaggccgaggtgggcgcatcacggggtcaggagattgagaccatcctggctaacacggtgaaactccgtctctactaaaaatacaaaaaagtagctgggcgtggtggcgggcgcctgtagtcccagctactcggaaggctgaggcaggagaatggtgtgaacccgggaggcggaacttgtagtgagccaagatcgcgccactgcactccagcctgggcaacagagcaagactccatctcaaaaaaaaaaaaaaaaaaaaaaaaaaaagaaacatgaatggagtggagacagcatctgttttcacaatccttccccaaggttcaaatgtggcatggtcaagtttgagaaccactgctccaagccatagtaggctcagtcccggtgtatctgagtggctaaaattgtggaacctggagtcagagagaactaggtgcaaacctgcctccattgctaactctgtgactcaggtaagctattgtctttgagctttagttctgtcagtgataaaatggccataataatagtgcccataaggttgttgtgaggactacatgagacagcacaaagcctggggcgtggtaagcactgctggggtagccattattagctagctgagtgattattttttatttttttgagacagtcttgctctgttgcccaggctggagtgcagtggcacgatcttggctcactgcaacctctgcctcctgggttcaagcaattttcctgcctcagcctcccgagcagctgggattacaagcgtgcagcaccacgcccgtatttttagtagagatgaggtttcaccatgttggccaggctagtctcgaactcctgacctcatgtgatccacctgccttggtctcccaaagtgctgggaatgcaggcgtgagccaccgcgccgacctcctctctacaatttttaatgtcagtactattttttacccccaccttttcacattaaaaaatgtggtaaaatatacataacatagaatttaccattgtagccacttttaagtgttaattcagtggtattaattacactcgcaatgtagtacaacagtcaccactattgtactataccacattgtactacattgtgaatgtgaaatgtgttgttctacattgtgaaagtttttccaaaactttttttttctttttgagactgggtctcactctgttctgtcacccaggctggagcgtgatcatggctcactgcaccctcaacctccctgggctcaggtgaccctcccacctcagcctcccaagtagctgggactacacgcacacatcaccacacccaactaatttctgtggtttttttttttttttttttttccacgctgcccaggtcttgaactcctgggctcaagcaatccacctgcatcggcctcccaaagtgctaggattacaagagtgagccaccacgcccagccttcaaaacattatcatcacccaaaacagaaactctgtaccattaaacagtaattccacacccccctccaatattaccacatttttatgatgaggaaaacggaggcacagagaggctcggtaaaacaatcaatgttacacagctagctaagcataggggtcaggactcagactaggctatttggctccagagcttgctttctgaatcactgtcttacattttttttcttttcttttttttttttcagacagagtctcactctgtcccctaggctggagtgcagtggtgcgatcttggctcactgcaacctccgcctcctgggttcaagagattcttgtgcctcagcctcctgagtagctgggattacaggtggctactaccatgcccgcctaatttttgtatttttagtacagacggggtttcgccacatgggccaggctgatctccaactcctgaactcaggtgatctgcccacctcagcctcccaaggtgctgggattacaggcatgagccgccatgcctagcagattttttttcttaaatctaaagcttttattcttgtttatttatttatttacttatttatttactctgtcgcccaggctggagtgcagtggcatgatctcggctcactgcaacctctgcctcccaggttcaagctattcttctgcctcagcctcagctttgcaaacctagcccaagtagctgggtttacaaacatgtgccatcacgcccgactaatttttatatttttgctagagatggggtttcaccatgttggacaggctggtcttgaactcctggcctcaagtgatctgcccacctcagcctcccagagtgctgggattacaggcatgagccaccgcgcctggcctgaattttgaggtttttatctgcttgggccatgggtgcaggctccaattactccaaaggggctgatctatctgccatgccttgtggggtctggtgggagctggagggccacaggggtcctgccctgtagagccactttgtttttcctccatgagatccacaatcttgggagccctgaggatgttcctccaaatgggcagactatgcccagccaccagagctggagagcaggattctctctccttccacttataaagggacagcactgaaacaaacatggcctctggagtcacatgagactggactcgaaacctagccttggacaggttgctattccaattgtttcccaaactgaagttacagataccaccacctaccttgcagagttgttggtaagagtaaatggcagcctagaactagcagggcctagatgagagttagttcccttcctaacttgaatatcaccttttccttaatgccttcccagttcaatgtttgctccctcctcacacctttatacagcatcctgtggagaccgatcgaattgcctagtgctgctgcttttccctgctggtttgtaaattcaagttcagagactctttctaaactctgacacacatcaagggctgggtgtgctgacactgacacagtcccagtccattgcttactggctacgtaatctttggtaatttgacccatctctgcctccatttcctcatctgaaaagtagagaattggattctccacttcataggattgctgggaggttgaaatgggctaatataggtggtgcacttaaaaatggagctgacatatagtagaagtacttggtattatatgatcccatgatataataagtccccttctctaaatcatttcttcacctaatgctgcctcacacctggggaagcgaacaaggcaccactaaaagccaatccactgatctcggcatcctatttattctccttttagaaggcttggccaggcacggtggctcacacctgtaatcccagcactttgggaggctgaggcaggattgcttgaacttaggagtttgagatcagcctaggtaacatgccaaaaccctgtgtctacaaaaattaaaaactagccaggggtggtggtacatgcctataatcccagctactggggaggctgaggtgggaggactgcttgagcccaggagatcgaggctgcagtgagctgtgacagctccactgcactccagcttgggccttgtgtgaaaaaaaaaacaaaaagaaaaaagaataaagaaatcttgagtaaaacttggtagtctcccttcttattctctatcactgctatcatctaaatttccaggaacctcctgggccacttctaaccgctagatggccaagctacagagtgattatttccttaggcaagcaaacatcccagccctctaatacggtatttcctggggctggaatatcaacaggaagttatgtgaggaagagctctgccaaaacactcattccaaggaagggactggtaaagtgacaaatttgcccaatcctgtacaacatcctgcatcctccacatgtggccctgttgcacatctaatccacaggcaggtcactcgctgctgactctattcttctctgggctcctgggacgtataaatatgactctatgtaagaaaaccagaggctgggcgcagtttgctcatgcctgtaatcccagcactttgggaggccgaggcgggcggatcacgagttcaggagttccagaccagcctggccaacatggtgaaaccctgactctactaaaaccacaaaaattagccgggcgcggtggcgggcgcctatactcctagctactcgggaggctgaggcaggaaaattgcttgaacccgggaggcggaggttgcagtgagccgagatcgcgccactgcactccagcctgggtgacagagcaagactccgtctctagagaaaaaaagaaaaccagacagattaaaaagttgcacttacaaagcagttggggcatttattgacatttaaacaagggaggagatcctgaacactagtctcgctcagtttataaaaacttgaggccaaactctccatcatctgtacacagcttaaccacggccaggagcaagaattcgagttaaacgaattgaaccagtccaaccacaagacgataaagggaaacagggcgtggggatttccagtttttccttttacattacaaagtttccaacacaagaagccaacaataccccagtgctgcaccaagttacttcccactgtttcccaaggcacagtcaattaataatcagtagtccaagttctaagaacattccctggaaaacaaggacgcacctcccgtggctctatgcatggcctgccactgatgaatcaaattcttaagaacctacgaccgtctgatacccttgaggagagcaccctcatagaatctccagcatcaggcctcagttttcccatctgtaaaagacagccatgcaaagtgggagatccgctaggcttccagatcgaagtcatcgcgctcctcattgtactctagcacgtgccgcttgatcttggacgagtccacccaagtgacaaagtcctccatgctgcgcgtgacaaggaaggcggggtcggtaaccacgtcagggcccacgcgtacgtgcccttgctccacaaaggccacggcagcctgaaggtgctgcgccatgcgcagcttgaggagcacggtggggaggcggcggcggcagaaggacgaggccgtgacgaagtcgcagagctccagcgaaccgcgcgtgggcaccaagccgagagcatacagcttgtccagcagcgcggccgaagcgcgcacgcggaactggtcgcgttcgggcaggtcgcgcaggcgccgcgccagctcacgcacggcacggctcagctggttgtagcgcgtgtagtcctcccgccgctgcagccggtaacgccgcagcacgcgcagctcgtgcaggttgtggtcggtgacctcccagttcaggaagtccacctgcttcagcagcttctgctcgtggaacttaagcttccgcaccatgatggcggcagccgcagccgcaggacccgaagctgagagcgcgttctggcatccgcgcgatttccgccgcggcgccccaagacctggacggcctgggaccctgggccaatgaaagaaagacttaaagtcacgccctcacttcccattggccagggtgggaccacgcctctgcactgggatctcgcgtttcttcttttcttcgcgtttgcgagggagggggtagaagcaccggaggtgggtggttgggagcgggtccctaggcggttccgcgcggtttttagtagccaagactgtatccctttctgcggcaatcatttcctcctagacttctgtcctttggggactttcagagtctcccccgcaagagctgaagaggccatttctggggaagaggggtgactgcggcttgttgattgggtttactgtgctaacttgcactgggctcctgccatgccttgggggagcttgccggagccggctctcctggggctgacctggtagtccccgccgcccgccagcgtcaggtccttcacctggcatgcagagcgatctctcattgtcaagttgggataggtggcaccgaacccatgaaatactgattggctgcttcctaggcccacagaaaagggatctataagggagtcgcctggaaatctgtattattaactaaagtgtcagatgattcataaaacccagcaagtttgagaaacttggactataactacaagtccaaaccctttagtctgtgctcaaatgaattatcctgacatgaatttctggccaccaagcattgagttaacaaatttaatgctgtttccgctagttgcatctgtaagttacatctgagtatagcgctgcagacctaacccctttttgcccgggcatttgacgccacctagcttctcactgatcatttttgttttgtatgcttttcattgtcttttacaatacaatatttgagggttgggcgcggtggcacatgcctgtaatcccagcactttgggaggctgaggtgggaggatcatttgaggccaggagttcaagaccaacctaggcaaaaaaaaaaagaaaaaagaagcgagatcccacctctgtaaaaaatcttaaagaattagccaagcatggtggtgcgcacctgtagtcctgactacctgggaggctgagggggaaggatcatttgagcccaggacttgtaggctgcattgagctacaatggtgccaccgcaccccagcttgcacaacagagccagaccctgtctcaaaaagatatatatatatatataaaatattcgatatctggaaaataatataatatgtaaattataaagtataataaatactcataaacttagccagtttaagaaaacatcaccaggctaggcatggtggctcatgcctgtaatcccaacactgggaggccaaggtgggaggatcactggaagccaggagttcaagaccagcctgggcaacatagtaagactcagtccctatggacaaaaaaaaaaaaaaaaaattagccaggcatggtggcagcacctatagtcccagctactggtgagggtttcggggtaagaggggggaggatcccttgaagccggaagttcaaggatgcagtgagccatgatcacactactgcactccagcttgggcaacagaacaacatcctgtctctaaaacaaacagaaagctaatacagattgtttgcttttttaatctaattgattttttctttttttttttttggagatcgagtcttgctctctcgcccaggctggagtgcagtggtgtgatcttggctcactgcaacctccgcctcctgggttcaagctattctcctgcctcagcctcctgagtagctgggactgcaggcacctgccaccacacctggctaattttttgtatttttagtagagacgaggtttcaccgtgttagccaggatggtctccatctcctgaccttgtgatccacccactttggcctcccaaagtgctgggattacaggcatgagccactgcacccagccccagagtaggtcttattgagaaggtgatattttataggggttaagccatgtgtggatatctagggggagaacatttcaggaagaggaaacagtggaaatgccttaaggcaggaatgtgcctggcatgtcagaagagtaagaaagctatcttggctggagcagagtgggcaaggaggagaggaagaggttaaagagcttgtagtcccttgaaaagactttggcttttatgttgagaggcatatacttcggggttttgagcaaaggattgacacttatgttttttgtttgtttttgtttttgagatagggtctcacactgttgcccaggctggagtgcagtggtacgaccaaggctcactgcagcctcaaccttccagcctcaagcaatcctcttgagtagctaggactacaggcacatgccaccatgcccagctaatttttattttttattttattattattattatttgagacagagtcttgcccaggctggagtgcaatggcacgatgtcagctcactgcaacctccgcctctcaggttcaagcaattatccctgcctcagcctctcaagtagctgggattacaggcgcctgccaccacacccagctaatttttgtatttttagtagagacggggttttgccatgttggctaggctggtctcgaacttctgacctcaggtgatccgcccaccctcggcctcccaaagtgctgggattatagacgtgagccactgcacctggctactaatttttaaattttttgtagagatggggtctcactatgttgtcatggctggtgttgaactcctgggctcaagcgatcctgctacctcaggctcccaaagtgctgggattacaagcataagccaccatgcccggctcagaaattcaattttggacatttttggttggaggcatccattagacttctgaggggagatgtcaaggagaaatagatatatgagttaagagtttttttaaaaagggctggagatttaaaaaattgggcattactagaatgagtggtatttgaagtcattcggctggatgagatcatcaaaggagtgcctatggatacaaaagacaagaggacaactctactgtggttactctaacgttaagaattattggaggcttgctgggcgctgtggctcatgcctgtaatcccagcactttgggaggctgaggcaggtggatcatgaggtcaggagatcgagaccagcctggttaacacggtgaaatcccatctctactaaaaatacaaaaagttagccaggcgtggtggcgggcgcctgtaatcccagctacttgggaggctgaggcaggagaattgcttgaacctgggaggcggaggttgcagtgagccgagatcgcaccactgtactccagcctgggtgacagagcaagactgtctcaaaaaagaaaaaaaaaaaagaattattggagagaagaggatgaaccagtgaggtggaagaaataccaggagagtatgttctctccaatgcaaatgaagaaaatgtatccaggaggaaggagtgatcaaccaggtcaaatgctaccaaaaggctaaataagagaaggactgagaataaccattagggtccagcaacaccaaggctattgatgaccttgacaagaatagttcagtggagtgtgggagtaaaagattggccagagggatttaaagagagaacaggagaaaaaaaattggacgcacttagtatagacagctatttcaaggaattttgctgcaaaggtgagcagaggaatggggcaatagctggtggggaaagtggagtcaaaaaaaattttgagatggagtcttgctctgtcgctaggctggagcgcagtggcgggtgcaatctcggctcactgcaacctttgcctcccaggttcaagcgattctcctgcctcagcctcctgagtagctgggactacaggcacacgccaccatgcctagctaatttttgtatttttagtagagacggggtttcaccatgttgcccaggatggtctcgacctcttgacctcgtgatccgcccacctcagcctcccaaagtgctgggattacaggcagtagccaccatgcccggcctcaaaaaaaatcttttttaacatgtgggttgatacttcactcaatagctgcagcttattggttgctttcccagtctattctacctccaaaagctctcccagatttttgtctctccagcctgttacccctgccctatgtcaggccctcatcatcttttgtctgcattcctacagtaatagtccagtgtgtcctgcaggctgccaccagcagagtcagcctgaaaaccactgggcacagttctcccttgctgtttcctttcctaaaggatggaaattggatgcctggatgagggatggatgctgtttcctgtgtatgaatcagggtcccagcaggaaagacagaacacaccccagtgagaataacgtgagaggctgggggtggtggctcatgcttgtaatcccagcactttgagagaccgaggcagaaggattgcttgagcccaggagtttgagatcagcctgggcaacatagtgaaaagccccctatacaaaaatacaaaagttggctggatgtggtggcgggtgcctgtagttccagctacttgggaggctgaggtggggaggatcacctgagcccagggaggttgaagctgcagtgagctgtgattgtgccactgtattccagcctgggcaacagagtgagaccctgtctcaaaaaaaaaaaaaaaaaaaacagaaaagaaaaaaagaataatgtgagacttgactaaagggactgtttccataggaatgggcagggtatagggagatcacaagggttagtgcagtttcctgagactgctaacatggcctgtttcccctaggactgaagaaggtccctggaggggagggaatgggaagatacaggttctggaaatctcagtgaggctgaggagtgagttcctcccaagaacctggaaataagggtggctcctgagagttacaaaaaaacccgtctagaacacatgtgggagtaaatccaaaatggctggtctgtaaatgtgtgactgagtgtttgggaaccaactaaagtctgtcaagggtggtggctgaggacgcctcggggaggttgggctggagggggaccctattgggtgaacagaaatcccaattgtattaagtaaactaataaaggtaaagcgtttactgtagtgtccatcactcagcaagcactaaggaagtagatgcttttttttgctttttttttttttttgtgagacagcgtctcgatctgtcccccaggctggagtataatgacatatacaatggcaccatcttggctcactgcagcctctcactcctggccacctcacctggctgatgctatctttttttttttttttttgagattggagtcttgctctatcaccaggctagagtgcagtggcacaatctcggctcactgcaacctctgcctcctgggttcaagcaattcttctacctcagcctcctgagtagctgggattacaggcatgcgccatcacgcccagctaattttttgtatttttagtagagatggggtttcgccatgttggccaagctggtctcgaactcctgagctcaagtaatccacctgccttggcctcccaaagtgctgggattacaggtgtgagccactgcacccagccctgatgctattgttaaactcagtttggagaaaggctatgtggacagaagatagatcacagggaaggggggggtcctaaaagcacgtggggaaaacgtatattctgtcttagagatgctaggacgaactgtctttagaatgaaggctgccccatgacaggaagcaaggttttaaggttacttgactgagagactcctcataccctttcccctcttgggggttccagactcactgagctaactttctggtaactgggcttcccaaggggtagcccaaactgccttgatctattgatgcagaaattcagttctgcttgacagttttatttctctgtgcaaattgatacctagccttctggggtttgtacataggcctttattctggtcaaatgccagacctgcgaagggagtcggatccactcactgaaccagtgaaactgggttttggagccagaggtctgggaaccatgtccctcaaaacagccaaaggtatccatctttagcagaactaccttgtaccagttaatctgcaataagtgactagggagagaatgaagggaagatctagctagacagggtagacaagactccagggtatagccaggaaagggagtcctcctgaagcctttgcctcatcttaggcacttcctccttcaggaagctttccttgatccttgctctacccaggctggggtaggtaccctcatgtgcacttttcatggcactaactagtcacactgggcagggagcatttgtctacttgtcacaacatatctgagcttttggaaaataaggataatgtcttatttgtctttgtagctcaggggcctggtgcagagtaggtactcagttaatgtttcttgagtgcatgacttggctgaatgaatgactgagacagaatggattgattaaagacaagagagggtggactgtaagccccccaggatagaaaccccgactgccttgtggtgtactactccccagtgcccagcacagtgcctagcagaatcaatgcccaaagtgttcccgatatgctgaccgagggtcagatcccacttgcctcttctcgaagattctctacctgaccacttctctccttgctgccgctggctagcacagaacatccagtccccgctgctgtactaagcaacacggaaccgggtggcacctagacttgttccctgtcgctgcagatgtagagtagtgtctttccctccttccaagctagtcgcccagggcagggtcgccctgtctggctagggtgctgcacccgcagctctcggtatcttaggtcagacgcctggaacgcgcaggccgtttctgttcctccggaaaacaatctctgagctgcgccacgacccgtccctgcggagcaggagtggggaatgggaaggtgggaaggcgagtccgcgactctgctccccaaccccagctggcgcggcggctttccacgcacccccctccccccaccccgatctcccgatcctggctctggcgcggtgctccttgcagccccacgctttgcaaactttcggagttttactccatttgcgtcacggaaaaggcaggaggatgacggagtccaggaagcgaggcagcggcagctggcaagctcccccgccgggcgctccaaccacgggggcgtgaggtgtctcccggcgagggcggacaggcggagggagaggaggggaggtggcggtcccagggaccagccccggaggctctcgggccccctcgttcccgggtcgtttcctccctctcgcctcccggactgagcgccagcgagcgagggcgctggccagctgggaagccgcgcggaggagtaggcgggggctcggctgcagcgccccgggcccgcgggagggcggagctggccgtccctgccccgccgggacgcacggaagtgcagcggagtttgcccgattctccagcctgcttccccctccctcctccctctccccacccctcacctcccctttggcgatcccctccttcctcaggacgccacctcccggaatcgcctttttgttttggagctgccttctcgctggcggagcggagggtctgcgagcgccggggaaggcaggctgggggcgcagcccgccccccactggccgggccccgcagggcggagaggaggacggacggacagacggctggccgcgccatctgctcgccggagctcactctccaaactccaaactgttgagtgtgtgcgtgcacgcgagggtggtgatcgggggtcgtaagtcccgggtgaggaaccggtttctgctggggttacctttggacggggttcctgggattcagagcagggtcagcgtcaggctcagaaactgctgaggaattaggcaaacaaaagagaccactcagcgagtggctagaagtcgcccgacagcctcgtcgcgccccctccttcctccggggttggggctggccacttctggggcggggagagggcgcccgagccggcgggggctccggctgcgcagccggggtcgaagagttggcggcctgttgtgtaagcctcagtccttgttttcccggcctggctcgttgtgaagccggacacatccacccttggactcgattcaggcggctgctgcttttctccttgcccctcttggattttccggatttttgaaaacccagtggcccaggagcaagaggaggaaggaggaaggggcagatctgcagaggaatgtgagagcctcccaaagcgagagccgccaaaagaatctgggagccagagggacagccgagccctgcccgggtttctggaatggtggtttcagagtgagtctcttctattttagaacgttgttccagtggaaagtgtcgaatttttcccctcgcagggcagatttctccaggtcacttgacttttcttctgggagtaggagttaggagagattcccctctaaccccccagaggctgctaagggaggaggagactgtggacatgagccctccctgctcacaagcatatgcccggagacctgatagggcagtttctgggccatggacattgctttgaagagggggagactggacagcatctgtgggtgctgagaccccaccttaggacctgagagattgaactgtgtaagcgccattcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctaggagtggtgggggcagtggcttcctctcaaaccagggtagctttgaggaggatgatgatgatgactgggatgactgggacgacggatgcacagtggtggaggagccacgggctggtgggctgggcaccaacgggcaccctcccctcaacctctcctaccctggtgcctaccccagccagcacatggccttccggcccaagccaccactggagcggcaggacagcctggcatctgccaagcgaggcagtgtggtgggccgtaacctcaaccgtttctcatgctttgtgcgttctggagtggaggccttcatcctgggtgatgtgcccatgatggccaagatcgctgagacatactccattgaaatgggccctcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggtaaggcccagtgcaggcaggaaactcgtcctgagtctggctctctgctgggccctggggagatggggatggcctggatagaatggagcaacttgtctttatttctctgtctcaatcattcatttaacaaatgtgttgggctgggcacggtggcttacgcttgtaatctcagcactttgggaggttgaagtaggaggatcacttgggcccaggaggttgagactacagtgagcccgattgtgccactgcactccagcctgggtgacagagtgagaccctgtctctaaaacaaacaaacaaacaaacaaacaaacaaatgtgttgaatatcaactctgtgtctgtggcaaatgtgcttctaggtgcagggatattgttgtgcacaggcccggtctctgtcctcatggagcttgatatttaccttcttgtcagttcattcattttctctgtttgcatctcgtttacccatcatgcatggtgtcatgctgggttctgagaacacatagatgaccaggccccaggccttgcccttgaggagccggtaggcccttgggagacacagacccaacccagataacaagagctcagagtgggggcctgtcttgtgctccttgcaagttaacctccccacctttgcagctttggaagctactctcaccactgtgtattctctttatgagcgtcttgtctgtgtgcaggaagatccctgtccccattttgcagatgaaggagctagtgtccacagaagagtggttgcacagcctgtggcccggctgggactgtcccttcctcctgccacctccccaaggacacgtccatgttggccacttcccaagcctagccatgttttcagttctcatgaccccctctgtgggggagggacaggatgggcctctgcctgttactgctggggctgtccatgaactgccggggaaatgactcatcctgggtcacacaggggcactctggctgggccaggggtgcagaatcaggggtccagggcactgtccacatggcctatccaactcctgcttcccaagcctggcttctcttcttgcctgaggagagagccagtggctgccccagcaggtgcctgagtcctgggcacagctgggagggcagatgtcaggagagaggtgtgatcctccctggggctgcttggtaactcgtctgcagggcgtggagctggctccctggcccttgggccctgaggttagacctggcttggtggggagtttgactctgggtggggccagggggcagacctctgcactgagcctggggaacaggaaacatgtcacccaccaccaccagggagggcctggggtaagctggccttgctttcctttaccaagaggttgacttctataacttctccagctcccagcctcctttctccccttgctatatcctcttcctcttcctttctttctgtttttttttttttttctctcatctctacctttcttcctcctcctctgaactccaggaaacacaaacctgagtgctagtcttggctctgcccctagattgctgtgcgtccccggggagtgcctttgcccctctgggccttagtttcctgatctgtaaaacaagggaatggggtcccagtgagccatcaggccttcaagggagtgggtgggaagggactcctggggagggtatggctcagaaacagaatgacaccttagctctggctctgagcactggggcaggagtagggcaggggaggtggccaggcctgctgggggcccactggggcaggtgtctccctgagcacaagtgggaaggctggttcaaccagctccttagatggcttgttcctgtgcaggcagcaggagggggaatgcaatgattaaacagatgctcccatgcagtggctggggaccccccacccagagcagagctgaggacattagggcagccccacacctaggaaggacaccagggcctcccaggctggggggaagccagaccagcctttctgaccctgggcagagagacagagctgagataggccatttctgagtttctacttgaggtgtttctaagagtcagaggccactgtcctctgtgctggtgcatttgacctgaaacagaggccagcccactgccttccctccccgggaggacccctcccaatgggccaagccctctctggcttactctaagttctgggctctgcactgctcctcccaggcctgtggtgtggggcaagttagggagggggtactgagacagaactggacaggctttggggaccacagcccaatgggagtgataaggagggggtcctaatgctggccttaggggtggagcccttctcaaagaaaagagaagaacagttgggtcctgggcccccaggattctgtccagcctgtctggacatctgaatgggtggtgagtgtgtgggaggaaggacagtggaggcctaggtgggagtcaggagaccaggatttggacaaactttgcatctgacatgactttgggagagatttctcccctcagtctctaggtgagtaaaatgggacccgagggtcttcatttccttaggagggctccatgtcatgtgaaacttacattaaacaaatttgtatgcttttcagaaaaataataaaatgaaataaaatgggacataaaccctggctggagctgagaggagcctggtcctcccacgggcctagtccctgtagcccaatccaggggtctcctaagagaagggtaaccatataattaaccagggcagtttggggcataaaagggggccctagcaatagtgatcccgggacaacaggggaaagtaactgtccagggcaagctgggacgtatggacccccaacttgacagccagcaagagcggggctggtcctaaggctcacgacaggtcaggagggcgatgtggtcacttccgttttacagacgaggtgcagcgatgcagatgagcctcagagcaggagctggagtccagtgtgtctggctccgcagcccaggctgtttccactgtgccctcccagatgggggaggggatccccagggatggagagctgagccagaaggcgaaagaggagggaggaaggcttgggtgctccttcactggtcctgtgggctagagagaggcccaggaccacagagcttccatggaggggccatagggacagcgtggccaaggcaaagtggcgactgtagggacaagttcttgcctgggggatgggtgggttcagcctctgggttctgagccatcatctagccttccctctaccgctcatcctgtaatctcagcactttgggaggccgaagtgggcggatcacaggagttcgacaccagcctggctaacatagtgaaaccctgtctctactaaaaatacaaaaaaatagccaggcatggtggcaggtgcctgtaatcccagctacttggaaggctgaggcagaagaattgcttgaacccagcaggcggaggttgcagtgagccgagatcaagccactgcactccagcttgggcagcagaacaagactccatctcaaattaaaaaaaaaaaaaaaaaagaaaagaaaagcagttttcaagccataacatgtagcatctggagcttctattgtatctcaggtgcgctcctttgaactgtgtacatattagttcagttaagcctcaactatactatagggcaggtactattattatcccattttacagatgtggaaactccttaaagcactataccgtgtgagaggttgtcaacagcatcacatctagtgcaacctgtcccactgggcagtggggagacctggagcccaggcaagagcagtggcttgctggagaggatacagctaggactaggactcagacctcctgctccctcctgcccccaacctggggtggatgttaactgtctccaagaggcaggggcaagatggattgaggtgggagcttagggaatatccctgggacttgcagctggtgggctccaaccctcctttctgcatttttgggacccagcctgtaagaggagtgctgaggcaggaggtccccctgggtcctcagctctcaggttaagtcttaagtagaatgtcggggggatgctggacaggcctgagccctgactcccagcctgtggggtggggtgcattagcattagctggtcctggccccagagctgagtcacagggtggaggggtaacggagaacagggtggggcctctgtttccccccgacctctgcagcctttgctccccatccctggcctcctgcctgtctgtggatacctaaccattgcaatgggttcattcttactctttgggctcctcatcagcaaaagaggcctttccttcctctaaggccatggacaggaaaagtctatagatgcacttccactgtgccaactttctcggcaggtggaatccaggctagttcagtatctcctctttagctaggttccttctgcggaagtttaactccagtttcttcaccctgctgttttctacctttcttcttacggttcttcctactccttgggaccttcttgaatccctgtgtccaacgtctgggggccccacacatatgcctgaaggacctggcatgggctccctgcagcagaagtggtgtccgacccccagctgtggaggaccaggcaggaaagaggctgggagtcctgggcaagttcctgcccctcagggccttggcctcctctgtacagtagtaggatggaggtggaatcgagggttggacacctgatcttttgggcctttctagctctgaagtctcttactgggtcctatcctgggccttggggtgatcccccttctgctgcccagggctgggctgttgagatggtgcaggaggtggtccagggaaggtggcagaaggactgagtgggctgggagctggggaatgcagatttcttttgggcgctgtgtgagcagccctggagactctctgaacttgagtctgtttgcctgaaatgctactattagccgattagccatgcacttatcaactaacatggatgttgccccttctaaaggcatccagagttattcccagcatgtagagccctgggcctgatatacagtaagtgctcaatgaatgcatttagaatgcactggacaatttgagccagggagtgaagagaatattatctagacagccctcaagagccctccttaaaggagaagtgggaaagcatgggtattgagcatgctatctgtgtgtagtgggtgcgtttgcagtgctcaggggtgtgctgtcctctatgccaacccttccctgctcctaatcttctttgtatggtggattctctgcagccctcggcgactgagtgccaggcacaggcaaacttccttctcttcccagcaactgtccccactggcttaaaggcagaattcgtcaagtcccttttaattcagaactgaaattcattcaccagctgcttgttcattcattcagattcttctaaattgggtcctctgcccaggttcatctccaccccccatctgtcacctggttattacacaacctcctcgagttccctgggggctgggatgaggagggaacagggcgtgcatgtctgggagatacaccaggtggcctttgaagagttgttttagaatcagcagtgtgatgggggtgggggtggggagccagggcacaggtgacatgggagagacattctgtcaggggaactgggagaggctccagtgtagaagtggcacctgatcggggccatgaattatgaataggaatccagggggcagaggtaggaaggtaggaaagagccaggtgagtttgacgaacatgggggtcagtgtggaatgcgtgcaggggccaactcccagaggtgagggccccccaggccaggcagattggtgtggaccttgatctgtaggtagtggagagctaggaaaggtgcccagcttgggatacctctttagatgctgcagagaacctgtcagaggctggggcggagggcagggagacgtggcggggctgttgtagcagtccagtgagggacagggttgaatcagttcagcaggcctatatcaggatctgctgtgggccaggccttgttctgggtaccagagacacagagaggttgaggacaggctctatcctcattgaattcatagtccatcaagcagggctgtgactggtcacatgtgggctactggtggcactgcacatttggagagaagatgatgtgcttggtttaggaggtgctgagggtgatggcttgggtaacatcctggcagagacacccaggtggctggaatgtgggtctggggctcaggaatgacgtccgagttgagctgatgagggtgctgtctgccctcaagggtacagggagcacatggagatcagagccctcacacgctgtcctctgctctgcctatgccaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagataacacaagcatgactttttctgtttggatcccagaaaggcggagggcaggagaaggatagagccctaattgctcctgagagccattggatgagattctgaggtcgtggtgggcacaaattttccacagaacctcaaaagttcaggggagggctatgctggtggaaggtgccagcaggcaggaggagctagaggcggctgtggacccctgggtggatccatccctccctagaacgcactcttgtctctaaaacaggtggagtgctgcccaggggactggctgtactgccttgtgatctggggctgagggttgtatgaggaagggacaggacgctgtgccctaggacaattaatagatggtggctcctctccccaaggagccatgccctggccttgcccttgaaaagccctagtccaggggagggaagtgggggactcagaagctgtgtctcttccccaaaccgtcctgggtacccagccctgcggaggctcccacattggaaactgaagaggacgctggctgttgggggtgccctgatcaggatgagcggaccttgctcttggatctgttcatccacagatgagaggagggtactggttgagacttggctctcctttggaggcaatggggacttggtggagggagggcttccagggtcaaggccgtcagggaaggttggctagaccagggaccagggagcttgtgcaggaagatggagaagggccagcaggtgcggtgggggaaggggcgggcaggactccctgttcagggcatagcgtcctcagaggaacttctggaatgggtccccctggcccttggtcaacattaggtcagatttgggactttctgaggaattttcccctctctccaccctgccccattttctaacccatccgaggaacttcccgcccttaacctcttctcagctctgccatccatgtagccatctgcagaaggggctctgagcagtgggggctgggccaggccgaggcagggctggtgggaatgctcctcctaacccatggtgcctggaaagtcccctgctcatgcttcctgctctgggaacagtgttgtcctctgtgtgccttccttgagaggggaccacctcccaggccttccatcctcagggtgaggccatcagtctgatacttttctcaggagggacttggatccaggagaagcatcaggaagtggagtcttgggataatgccaggcctgctcctggtatcctgaggtctctgggctggggcaggtgtgtgtgtggcagggagggaggctgtcctggccctcctctctcttttctttctgcctctatgggggtgggggtattgggggaacttggggccgttctggggtagctaagcccctttcagcaggagattgggggaccagtgttgggggcatcctggtgatggccgattcctgcctcgtcacatgccaggcagatgttcccgactcggctggacccagctgcctcgtttcctcccttactttgctctgagggggtggaaaacaaggcttctctttctgccctggacagctaccagcacccggggtaggggatcccctggtcaccagtcttggcccagtacaggaaaaggaatccgctttgtggccacagatgggggctggggatggaagcagacctcagatcctgcatctcttcacccgctggacacaggagggctatgaaccactgtgccgtggctgcaccactggctggagcagagccaggcctgggagaggcaggtggccccatcggcccctgctctgcaccacccctcccagatgacagagccatatgtcttccacgtgtctacacactcacagactcacgaatgtaatcgctcagtctcacaacaagcacacgcagtcacacacctgcccacaggcacatacgccacataagcatgcctgtatgctcacacagtcatactgccacacgctattacacattcacagccacagccacacatgccttgccatccattcaaagcaccagtggctactttgtcagacacagccacaccacagtcctatgcacatggtcatagcctcacacagtgacacatactcgggcacacaccgccacaaagccatgcttgcacagagcaaaggtgtcataagcatctctgtgcctggactgcacctgcatgacctcccagggtccccacctcatcagagattaaggagagctttgcttggagacaccacccctggagggggtgtctccaagggggagtagagccagtcacaagcaccacatacaggcacacagcctgaggtctagggatgcaattgggatgactggataccaccaagttcagctccttattgaacagatgggcgcctgaggcccagggagcagtggtggctggccttatcacccagcagggcaggggatactctggggccagagcctggctctgggcagactctgtttcctggccctgccctcccctgggccaatcctctgggccaggctgcctctgaaggcccctggctgaaccgatccagcagagctccaggcagctcccttctcaagctagagctgagctgcagtggccacgggagccggagccaggatgcggtgggcagggcctaggcctgggcgggaggaacattcctgcaccatctcctccccaagcatgtgaggacccagcccgccctgcccgcctgcccgctgactcaggcctccaggagccaagcctgctcagctcccccacccaccctaacctgcttccccactagttcggctctggttcccctctccactggctggggcaggagaagacggtgagccctggtaggaagaccatggggaaaaatcaaacctcaccaccccccgacatagctcagaagggctgattgtgaaacccagctctgttcaacatagttgaacacaaactttttttttcttttggtttggttttgttttgttggtcaaaccccagtgcagtgcagtctgtttaagaagtagtgtcgcatagctgtggcctggatctgctcagcagccccagtaggcagcatttattccctttcgcaacaaagagactgagacttggccagagggaagatgggacctgcctaggttcacacagggaatctctggcggggctggactcaaacccagctccctgccatcactccttagagtcacactgatgaactcatttagggccaaaggaagaaggggaggcagatttcccctctagatgagtgaagggataggaggctggtgaacccaacggctgaaatgtgaagggtgagagggtagggtgagtccccccagccctgagggatgaagggtctgaagatggcactgcacggtgacagctgcagtgactcaggagctccgtttacaaaggaacatgagtgaggaacataacttaatttttttttatatctgacctgaatttctgttttcctcccccattccccacatggtagaagtgtaatctcacatcaatttggggaccctttctttccccagggatgtgtagaacttttggggatggcacatttgaagaccttagggagctttgcattttaaaggctgaatcccacactctatcatacatattaatatttacctgcattccacattaaagggttcagtttatgacttgtgtcctgtcttgtagatacttaattaaacggtattaattttgattttgcccctttctgttggtgctctgctctcttccctcctccccgccctgcccacccagcagcacacattgttacgggttgcttcttgcagaactcctggacctggatgctgccattgggcctgcgatgcccgccatggtcctggtcagcattgggccctccgatcatcttgccctgcctcctgcctttcccctgcatgctcccttgatgcccatcctgagtctctgtgtgtctggctcttctctgctcttgggcactcagggctccttccatttgccctgtactaaggggctgatagaggtcctttctgtggcctgtggccccctctggggcctgtggtcatcattccacagctcccacttcgcagtcaagcacagggagctctggggtgccgcttagacaccccatgccaccctgtttcttctgggatctggctcctttcttggggttctacctgggatgggggtatgagtcccactgcttcggaatctcccagcctctggggattctactatctcccagtgcaggcagcactgtgatgggcactggatggtcgttattttacaaccaccccatgtgcaagagattattactgtcattttacacaccaggaaatggggtccagcgaggggggtgctggagtagccaaggctggtgcgaaacagtacccaggcctgggctacctgtgctgagaggcagatggccagtgccagggccgggtgttacaggctggcggaagcctggaggcacctggagcctcttctgggctgacccgcaccccttgctgccatttggcaggagtgctctggggttggagcaagggagtatgaggctcctccatatagccctgctgcccccagatagcagcagcccccaccccaaccccattcctttccctctaccgcccagaggcaagtgcagatcctgaccagtgtggccttgctgtagggatgtttcttaactgcttcatgcttctgtttctccactgagaggggagttccagatggctgttaggagggtgacgtgagcagaacacatcatctgggcagtgcctgcacagccagcgccactgaggagcaggtggggtcatcagcctgagtagagctggagcagccctggggagagagagtgctaagaatattggtacccccacttcataggttggaaaactgactgggcaagccctttaaagccacacagtgggtagatggcagagctgggcctggaaccaggcccccaaccacccccagacctttagccttgccccgtgttgccacactgcctccgtggggagcagattccttggggtccttggctgtcattgtacttgtcatccagggcaggaggggtccgctgggccactaacagttacatataccaacatatacaggatagcacagcccaaggttaagagccccagtctcatacccaatgcctcccataaacagattcactgggtgacctcatgtaaggtcatcattcagtctcagtttcctccagcatcactcaagcgatggttaccacgattatacatggccacgagttcacgagtgtggatgctgtcactgcctcaggccggctgcatcctcaaagccacacaggtcagccaggttgggtgggcctgagtgcacaagagctaccattttttcagtcctctgtgctggtaccacgactgtttggaaggtaggaactcctattgtcaacattttccagcagacggtggctcagaggcattgagtcactgcgagattgcgcacctgccccatggcaggcctgggctgaggtctgcctgcacttggagccgtgcccttcccaccgcaccaggctgccttttgaaggctggggggctaggcgtggcgggggccactgtcctgctgcagtgtgaacacaagggtgctgggaatcgaagggaatggggagggagaggggcaggtggccgtgaggggcaggtggtgggtattgggtggaggtggctgtgttccttcaagtcagtgggtgaaaggtcagagggcttggcccacagagagtgctgagcaaatatttgtggagagataattttctggaaggcccgaggctggggcatggggtcaggttctggctgtggaggagggggctagacaggtgaggccatgggcagcgagctgggggcaggagcaggactctggtctctgagaagaactcaggagcctccttactccaggagacaatatgggggcagtgagagctggcaggaaaatgtcgagactcggggaagggggcttgtgagtgctgagccaaaaagggctctggccctggggctgggctggggtgtcaggtggggcaggcagaggtggggtgatggagtctctgcctgcatctggtacctggagtgtgtggacccacctgtgtggttgcaggtgcctgtcagtgtgtgcacctgtacctacctgcgtgtatgtccctgtggtggcgctggcgcttggtatctatagtcattcagccacacgagcttttccctgtgtttctcagcctggaaaagacaattcctctccccctgaacctcaggcccaccttgggctcatgcctggctcctctctttctctcattccacatcccatccacaagcacagccttgttagtccatcaaatgagaccccaaatgtaatgctctcaccacctgggtccaaaccactaggcttacctggactattgcagcagcctccaagctgcccttctgctgcctctcctgctccttaatggtctaacaggggccagagtgatcttttacaaaaacatgtgaatgtatatatatatatttatacatatacacacacgtgcatatacacatatataaaaatatgtatttttttttagagacagggtcttgctatattgtccagtctggtctcaaactcctggcctcaagtgattctcctgcctcaggttcctgcatagctgggattataggcataagccactgtgcacagctcagagtgaacttttaaaaccatattctttttttttttttaaagacgatgtctcactgtgttgcccaggctggagtgcaatggtttgatcttggctcactgcaacctccgcctcctgggttcaagcgattcttctgcctcagcctcccgagtagctgggattacaggcattcaccaccttgcctggctaatttttttttgtatttttagtagagatggggtttcaccatgttggccaggctagttttgaactcctgacctcaagtaattcacccgcctcggcctcccaaagtgctgggattacaggtgtgagtaccacacccagccttaaaaccatattctaaatcaaatcatgtctctcccctgctttcaacctcagggcttcctgccatacttaggaaagtttccaaactcctagcacaacccacaaggctccttcctggtcttgcgtcagacccctctgcacttcggtcatggaactccagactcattggtcggctggtttcctcttctgcgtttgctcagacctcagggcctttgcatttgctctcttctctgtcttgcatgttcttcctcccagataaacatgtggttctcacctcaattaattcagatctctacataaatgtcacctccttggagaaggcttccctgaccctgaaatctaatgaaacttcctcgtccctctgtttccttaccctgccttattttttcttcattttacttattaccagctgccaattataaatgtgtatgtatttagctcttatttatttatttttgtcacccaggctggagtgcattggcgtgatctcggctcactgcaacctctgcctcctgggctcaagcgattctcctgcctcagtctcccaagcaaatacaggcctggcacggaggctcatacccaccactttgggaggctgaagtgggcggatcacctgaggtcaggagtttgagaccagtctagccaacattacaaaaccccatctctactaaaaatacaaaaattagctgagcgtggtggtgcatacctgtaatcccacttactcaagaggctgaggcaggagaatcgcttgagcctgggaggcggaagttacagtgagccaagattgcacaacttcactccagcctgggcaaaggagtgggactatgtctcagaaaaaaagaaaagtttcaaacatacacaaaagtagagaaacgaatataacagaaccccacatgcccacctcttggctccaacaattctcaacactgggtccctattttactcccccacaccctttgccttccggtggactccagcatcacacagtctcatgtgtggatacttcagttcaaaggttatattttaaatgtagctgtttctggtctgtctccctcagtagaaagcagctttctggggagttggtgtctgtctgtcttgctcactgctgtatctccagctccggcacagtgcctggctcccagtaggtgactgaggaggtctgcatggctgtgtctgcaggtctctggggagggcatgtgtgtaggtgctggtttgcacatgtccaccaccgtgtcagcgagtgtctgcacatgcctttatgcgcagctgcatgtggcagtcctgtggatacgtgtgcatgtgtacgttgccacagcagctgatggctaaatgcgtgcctactccctgatgtcatttcccacacccctggggacccaatgactcgttctgggaagtatttccctctttctcagcaagggatggggtgtgaaggggtggaagaggggtgtgcaccagtctgctcagccctctggaggacccagagagccccttcttgaccttccttactagcagggcgccgtgctgtccccaccagtagagcaggcagcctctttcttccctggcattgaaacccagccagttgggccggcatcagctgggtggggtgtggagtgtgtgtgtatgaggcgtggtggtggcccatcctggccagctccaaaggctcctagggtgactgctgtgtaattgggcaactgaggccatttaagctggggacaattgggtgtagacatctggtccagtgccccagcagtgccccctctcccccctgcaagttctgcatcttaaagggctggccctggaaggcgggcagtggcgtaagacctcgctctcagcccagcaccgggttcattccaggggctccttgctgtcgggccaggagctccacagtggcttctcagcctgctctccagggccccttcttaccctggaggccagggtccgcgtcctctggctctgcattgtccttcccacctcccaccctgccttaggctcagctctcctccttcttcagggcccagcccagacagcccctgtgttccaggaggggcctgccccttccacctgggcagtcaggttctttggggctcctccctcttggatccctgaggccaagacctccccaccatgtaggccagatggtccccactcactccacccccaacctcagggagagccttccgaatcagtgaggtgggtgtgcagcaaggaagggcagagtggcactgccagctgctcctacccagaactggatcccttgctgcacacctcacttcactccctgccacagcccagtgaagaatggccctgcgtctctctttgccagatggggaacacatgcattcggccatccaaaagaaggactgagcatttgttcggcacctactatgtgtcgggcactgagatagctgccataaattatgataataacaataacatcagcttctaccatttgtcaagcacctacaacatgccagacccatatgctgggccattcaataggaggaaccatcataacaccaataataagaatggtcggcctggcatggtggcttttgcctgtgatcccagcactttggaaagcagatgcgggcatatcacttgaggtcaggagttcgagaccagcctggccaacatggtgaaaccgtgcctctactaaaaatacaaaaattagccgggcatggtggtatgcgcctgtagtcccagctactcgggaggctgaggcaggagaatcgcttgaacctgggaagcggaggttgcagtgagccgagatcacgccactgcactccagcctgggcggcagagcgagactccgtattttaaaaaaaaaagccggtcacggtgtctcacgcctgtaatcccagccctttgggaggccgaggtgggtggatcacgaggtcaggagatcgagaccatcctggctaacacggcgaaaacccgtctctaccaaaaaacagaaaaaaaaattagccaggcgtggtggcggacgcctgaagtcccagctactcgggaggctgaggcaggagaacggcgtgaatctcggaggcggagcttgcagcgagccgagatcgtgccactgcacatctgcctgggcgacagagtgagactctgtctcaaaacaaaacaaaacgaacaaaaaaaaaacaaaaaaacgaacaacaacaaaaaaaaggccaacatttattgagcatttactgtgtgtgaggggctgttctaagagctttgccttaacactgaccctttggaaagaaaccttggtcagttatactgttttggtagatcttcattcagagagagggcagaagctgggctggggccctctggccagacacatagcatgaatgctggaagggacaggaggagggcttctaggcagaaagcaggcactgagctcccaggcctggctcaatactctctcgaaccagtggtcccttcttgagttagaacaggtgggtggacttgtacaagctcaccaagtggacagtcactgcctctgccctccttccttcagttcatgtgttctgcccccagactctgagcttctcagggcagattagggagcagaggtcctggggccttgaaccttcatggagtccctgggccttgccccagttgcttgtccaggtgcagtactcacaaggcaaccttttagcagggctgactcagaaggggcctttctacctgagtcactgacttccaggagcgctcaggctctgccagcctcgcccacctgcccagcagctctttaggtcaccccagcacaggcgccaccttccccaacaagactcaacaaggctcccctgccgcagtctggttcttgaaggtctctgccctggccagcatgtctggcatccctggcccattgcctggccccgatgcctctccaggtgttgggcatcccactgctgagagacatatctttggcatctggaagtgtttcaagcctctaggaggcctagctctgccggtgaattgctttgtgactatggttgagtcacacctcttctctgggccccctgattgaatgcacggtcgtctgggtgggggagaggtgagggcatccgtggctctgctctgccccttgcccccgaaggttgtgatcaagtgagccctgtgagtggttagcccggctggcacagcgccccatgagcctggatgttctcaggagggctgttgggcagggggaggctgagtgtaagggggtttggggtcatctcctcctcctgccccacttaactttgcttctttctgtggtgagcccccacgtgtgatttggtgaacgtgttctgcccatagcgttctgagatagaccctataggcagaacacgttcaggcagaatgacctcaggtgtctgggtgggagggagccacgggcgagtctgaaggaggtgtgcagtgagctctgaagcatctgggagggaaagattaaatccacccgacagaaactcagggcctggggtcaggtcagcctgggccctagcagagatctggggccagagcagccatcgagagcccagccagcaaccctgggggtgagaggagcaggggagccagagtgggaacccaggagaggtctgggtaggatgggtggtcagaggcctcttggcttgagggcatgtctgagggaagggggtgctgtgttctggcagtagatgtttgctggacatctactgtgtacccagcatgggcacagcagtggctaggccaggctacacactgccttagtggagtgtatagaattgaacgatgcctactgcagggtgtgggggtctggggccttcacctgggctttggctcaacaacccaggaggggagtggagttggtgggggtcccaaaggcactcccagcaccaggatagcccacaggctgggggccatagaccagcattccttctgtggacaggagagacagtggggcacctctgcgggacagagagctctgggtgtcccatgccctccttctgaccaggcctggctggcagtgtgacaggtggcttctttcccctctcctgctggctgccctgctcctccatgggggaggccctgtgcatgacacaggcactgactggtgacattggccggacacttcccttcatctcttcccctgacaggtgagaccagatgggcagggaagggacaggaagggaaggagcagccagattacagaaggtggggtggtggggctactgtacttcccagggccccatctttgggaggtaaggatgggagtaggctgtttcctgcagagcctccccattggatcagatctggctgctggtcttaccctcctctgcttccctctcttgtcctcactggagtcccctggggaaggaacccatgtcagaacccatccctccaaacctgcagcggatgtgggggtctttgcaagagtgagagctgaagtggaatagaaaaccctgggacagggctcgaggtctgacccctcttccagctcagccaccagctcactgtatgatcttggtctgggccctgcctctcccattttagtgtcccctaattaaagggtgaggggaagacttcagtcaggacttacactgtgtcatgtgtcttctaatcaccagggaccttgttaaaacacagtctgattcagctactctggggtagggcctgagagtcttcatttccaacaagctcccaggtaatgccggtgctgccagttcatggactccactttgagcagcaaagacttaggcaactcattgcatttgagtctgcaagacccagagactgtgtctcttgggtcctttgcaatctcacgaggcatcagaaggaagccttgggattagctccaggctctggactaacagagcacggatctcaggttggcaggcaggggaactatcctagtcccctgctgaggctgtgtttgggtaaaaaagtccttcttggcaactgggcgatttaatccagggttgcttctgtctctaggggctcacaggacatctggaacatgaaggaacacaacacaacccaccaattatcttggtggccacagagggccctccaaggagctgatgccctttgtgaggctagtagccatcagttaaatactgtaatccattacactgagaatagaaatgtaaccaggatgtagctgaacatgcccagctttagctgccatgtggctgggccttccatggaaaggaccagccttctctaaggagaggaggaagcagacagaggcagtgagccctcccactctgcgcttcccctcactggcctgctcacaccgctgggtgaaggcacatgtcagggttaggtagttattcaatggtatgcctgcggctcttcaggaagggctgattggattcctatctacatcttccactgcatttttggcacaaaatgctctggctattgcctgaccaatcttagcggtaactccacagggatggcgttacctatgagaggccctagggtcggagtggagctgtgtagaggagcccagcgggtctggttctctaccttggtcccaactatttaccagggcttcccgacatcttacggccaggaatgggagatccaaccagagaggtctggagttctgcccaggaagaacctccacctctttgagatctggaatcttcagggcctggaggaagatgccagcagccctggcagttctcattggtcaggggaggtcggtgtggggtggcagaagcacttctctggcttcctattgggggatgagtgtgcaagctcagtgggctccctggctgccagagcaatctgcttaaaggactggcttctaggatgcagggaagggctcagagggagccccttctctagcacctgagagactaagccacttagggtggtgggcagggtttctaagctggggtcctggggatctgggcccctctggcaactcctaccctgtccccttcccccaccagtgggctcactttgcaattctgctgatgtcagcttgagtgccttaatgggcagaaaatcctgactcctttgcccgactaggctagctgggactgcagggggccccaggtaaggagcatatacttctgaaatttgtgtgtgcccccgcgtatgcgtttgtgtcttaggtaggtaggtatttatctctgtgttgtgtgtctgaaggtcatgcatgagcctgtgttcatatacacaatggcgtgcacaaaggcacattatggatttgtgtatgtttgtttgtgtggagagggtcaggagctcccagacattcctgaacacttgcacatgggttggctgttatctccagcgcctgggaggaactggctccttaaaggagggggatggtgagttactttgtaaagtggagacaagccccttaagccctggggaaagggatttacataaaccaaggtcccacgtttaggttgggttctcagctctggtgtgcccatgaaagaccctctcccaggtcctagcagagctgctggcacagtgccctgggtgccagcccactgtcctgcatgggctcagaggagctggaacggtgtcagctggtgccagctccctgggggcagggcaggccgggccaggctatgtgaacagagtgtgtcctcagtcctctgggggaaatcggagaccaggccagatcctgcctgctgggtctctcaccctcttctcagcttacacttccagggaaactggtcaccctgggtagagacttgctccagatatcagggccctgaggctccagcctgagctcctgggaggggatgtggtgtagagacacccttggccaggcccctgcctcaggctggcctggggcgccagagagaccaggcttgtagaaggaacggagcaggctcacgcggagccctgtgcacggtgagctcagggtgcagagggatctctggggccctggtcaccctccctggggagtcctgcttttcagtgtggcaagaagcgccttgctgtgtgacagccctcttcccctccctgactcttagtctcccctgggtcctctgggggccctaacagcaggatgtacctggcctcctgcccgaagcctctcagagtggaggaggacctaggaggctggacactgagatgcgagaggcgtcataggaggggcggtccaggggcagggtggggaggagacttctcttgctcattcctggttcaaatgtttcagatgttgggatgcagggaagaggtgactctggtccccagatgcaggtcagctgccagaggctggccagggcttcccacccactgaccctggctgcactcagaggcctctcacatttctcttcctctcttcagtctactgtcagggccaggcatatcccctgggacccagaatctgtctccattgcccccaaccctgcgacaccctcaagagaggtctagagggtggtgactcagtaactcagagagggccttctggagatgccgcggcctcagaacccctctgtaacccaatgctggcctctcaggccacgtgcggggatgcctggcttttctgaatccttgctgcttcctctggctttgagaagcagcacacttggtcctcctgttgggagggtggacaccagcagaagccttccttgtaaaagtttctaggaggcacctgtggtggttctcctccccctcccccttggtaccatgtcccagccttgggatccccaagtccccccactcccttcactttgctgctgcaaccccttgagaggtggctggggaaggacaggggtatggaggtcgaaactcaggctaataaatctagggtggggagcatttattttaatttttgtcttgcagctctttgtagaggacctagcctttctctactgaactgaaggggtttggtcccatcacccgaagactggcccacctgcccacacaggtgggggcacaggaggtctgggaggccccaggaggtggaagttcagaggcctgcctggccctgtccatcccactggctgaggccaggccggagggccgaccccaggggccctctgtatgcaagccgacgcagacaagggcccagtgcatagttaagacacaaacaccacacagctgtccagagcctccaaagcactgtttatccaggctccatggaaccaagtgcccccagctgcctgccctagtcctcaggggggcactggcaccgcagtggcctcggcctgagaccctcgatgagccccagcctaacctgctccaaagccactgacacatgcatgtttagcccttggcccatcaagatggggccctgggaatgaactggctgcagaccctcctccatcccacacccccaggggctccatcagtcctggctagctcagcaccatgttaaatagcttccttgcaatctcccttaaataaacccatccccagagcaacctacccaccctgcaccctgaatatattatcctattggcttatgccttctagactggaggcgctctctcctcttgccctctactccaggggataccatctccctaaaaaaccaggggaggaagtttttttctcaactctggggcagagacaaagggtggcctgggttggagtggaaaagccaggaatagcttcctctgtcccttccctccccagggtacttccttctccttgccctcttagcagcctgggtcaggcgcgacttacccaaggtcacagacccaggacccagagtcatgacccatgtaggaggttaccctggttttgacagcccaaaccagctccagggcaggaggactgaacttaagcctgcctccaccttggcccctgcagttctccaggctcggagtgagctgagggaggttccagctcttgactccactctgtcccggacccctgggactatctcccaggaccctccacccctggtgtctccaggtctctcttgctctggggatactcagacagcaccaggcatggaagcaatggggcccgggacatgggcaagcctgtccctggcccgatcagcatctgggcccaggccaggcctcacacccagtactggccattcttaagggcagggttgggtgtccggcagaactgcagcagctctgggtcaggctggcctcctggagggggcccctggccaggcacagctgtgagcgggatggcctggcctggctccaccttgcgaaaggtctcggtgtcaccagccaggccgttgcggggcttggcagtcaggacctggacgtcatgcttgcccgtcttgttgcgttttcggaggtagaagagcaggggcaggatgagcgccaggagcagaagtaccaggcacatggggatgatgacgctgaacatgttggcctcaaggaagctcaggaagcctcccttggccacagcgggctcagggctggatgccatggggcctggctcgcctgtgggggtgctgctctctggcttccctgcttccgtccgggcggcctcggggacactgagcagggccacgctgtagggccgggcagcattgtaaggctcagtggcaaagtccagggaggccacagcaggcgggacgccctgtgcccacagctccagagtgagactgtcacctgcggggccgggggccctcccctctggcctgcccacctccagccccagcctcccgtcctcaaggtcctgctgagtgaactgctccaccagctggctgcccccgggctccgtcctggctcggggcacgcggaccacgcggccatgccggggtccctccaggaggcggaagcgcggcacactgcctgtgcggttggccagctcgccagcatctaggacggtggggtccaggcgcagggtggcaccctggggccatggcccacctgcccacacatgcagcagagccctcacagtgacgttcactacggctgatgcattgacacccctagccagtgccaggactctgaagtggtcatgagaggaggagaagttggtgaaggcaaagaccacctcgccctggtctatctggaattggctgaaggccgaggtgggccgcccgcccaccaggagatgcccatactggggtccctggatgaggcggtatgctgcctctggctcctcccgatctgaaaccacccggagctgctgctggctcagtgaggagcgccccaaagcttggggcacctccaggggtgcccgcagctgcacctcgatggcggatggtaggatgtccacagccagggacatgggcaggggtgggctggccccatcagacatgctcagctggaagatgcctgccacgctgctcccgttggccacgaaggccagccgccctgaatccacatcggcttgcgtgaagcgggtcacgggccccaggccaccacccaccaggctgaggaagccgttgtggggtgcccgctggacctcgtactcaatctccccaggagctgagtctgggtccaccacactcagctgggcccgggagatgggggcacgagagcctcgggtgagccggagtgggacagaggcctgtggctgagggggccgctcatttacatccctcaccgtgatggcaaaggcctctgaggtttggggtccagccacggaggcccctgctggcccctggaggtgggcacgaaagtggaagccatcctgctgggtgcccccaccgccgtgggcatacactagctgccctgcagccagctgggactgcaggaagtggggctgcccagcatggaggggctcctcggacaccaacagctggccccggctggggaactgtgtgacctggaagagcacatcatgctctgagcgctggggtgatggaacgctggccaagagattggaggcatccagagcagccacggtgatcctggcccgctggccctcggggacccagagacctgggggtgggacataggctatgagggtccagcccactgaggggagagtgatggaccctcagctgggggtgcctcagggcaaggatgtgcctccccccaaccatcaagccaggtcctccagggtggggctcagggttcccaggaggataaggactatgtccccgctgtgatgtcaaagcttccccactcaccctccctgtgacttcccaggtcctgggggctgagacaggagctgctgaccctggcctcgtgtcccctcctcctgggcctctcccattgtccctccccacaatcttgccagcttatcatgctgttcacctttgttcttccagaggtggctggggcgctggggacaggcagcctcaaaagacacagccacagcaagggtggcggccacgtcccgggcaggcggcgaggacagctggagctctagggtatcatgggcctcccaaaagggctcggggggcatctcatgctcatacagaatattcccagcgtagacctaggggagacaccatcgtggggtgagaggcaggtccagcctgtgttgtccagacactgagcacttttgtctcctcaggccccactctgggctctcctgggtgtgcccaggtctgtgcgtgtgacccgctgtctccctcactaactcactgggtcacatcaggcaatgcagtgcagagctgggctctggagccggagcctgggctcaaaccccaactctgccaccctggggaaatcgcctaatttctctgacctctggggaatgcaatgatctgtctgtgctgctctctaaagcgagtacttcctcttgtgcacaggatcctatcccctcttgccttctgaagacaccacttctactgtctcttggctttctcctatggtgtcagttccccccagatgcatcattcccttcattatgcaactatgctattcttttgtctcacttacattaaagctatttaattaattattattattattattttgagacagggtcttgctctgttgcccagactggactgcagtggcgtgatcatggctcactgcagcctcgacctccagggctcaagcgatcctcccacctcagcttcccaagtagcggggactgcaggcacatgccaccacacccagctatttttttttattgtttgttgagacagggtctcactatgttgcccaggctggtcttgaacttctgggctcaagcggtccacttgcctcggcctcccagagtgctaggattacaggcaggaggcactgcacctggccagaaaaaactattcttgacttcacattttccaccagcttcacccctgcccctttgcttctctttgcagcaaaacttcaaaaagcatagtccacgctctcccccaggcattcttgggtctctctacccaggattttgctcccccatcgccacatctccttttgccaagggcaccagaggcctccgtgttgttggatccagcggtcggctctcagcctcctcttaactgctcagtggcactggtgccgccaagcaacccttcctccaagagagccacaggctctgggatacttcactctggggttcctcctacctcacagactctcctggctggtcctcctcttctccccaacatcttatggccaggtctccaggctcttttctgtctacaggcactctccatgagtccttattcagtctcctggcctcaaatgccagctgtgctgagacccccttatttgtagctccagcctagcctgctctcccctgaaccccagactcatgtttccagctacctctgccgatatctaatagacacctcaaactcaacctgccccggctgcactcccgatcggcccccacctcctacagtcatcctgcttcagagactatagctccgttttcaagggctcaggccacacccttggaaccacccttgcatcctctctttccctcaaaccaccgcatctctcacctggattatcgtaacagcttcctgtgtcccagctgcagtcccccgcccattacattttgttcctaacacagcagccagagtgagccttttgaaagggaagattatggggctctttggctcacatagtgcagtgtctccccatctgaccactaaggcctggctgtgaccatatcacccctgcgacctcaactcccctcacctccactccagacacacctgctgttctatggtgctgcctgcagttcaacaccaaagaatattcttcgctccaggaagaaaaacggttttctccacctccaatcacaatgtgttcttttggcctatcttttgctccccacccacccttttttttgagacggagtcttgctctgtcgcccaggctggaatgcagtggcacgatcttggctcactgcaacctccacctccacctcccgggttcaagcgattcccctgcctcagcctcctgagtagctgggactataaatgcgtgccaccacgcccagctcattttttgtattttagtagagatggggtttcaccatgttagccaggatagtttcgatctcttgacctcgtgatccacccgccttggcctcccaaagtgctgggattacagctgtgagccaccgcgcccggccttattttccccttttaggaaacactgggaactattttcttctcagagaaaaacaggacttgcccaatagtaacatggaaacttaacagggtcttaacctgtgaagactctaggagcagaacccggagtaagggggagcaggggccggagtaaggggagcagggccccgtctaagatggggcagggcctgggctaagggagagcagggccgggctaaggggaggcagggcccagtctgaggtgggggcagggcctggtctaaggggagcagagcctgggctaaagggcagctgagcccagtctgaaggagagccgagctatctgaataggggctagcacctgttctaaaggaagtggctgctcccctgctttcgctgtaagagggaacacaggccttttaagaaaat

SEQ ID NO: 716 - DNA, 456002 bp, Homo sapiens
tatgagaaacacgtgtttttttaggcattctggggaaatttgactattacagggagaaaaaacactcccacctttgccctcccattctagaagagccttacaactcctgctcatttaattaagatggtcagttttctgtacaatccatcccaagtgatgcccagagcaagaaaagctgggggagaggataataatccagcctctccaggcacttcagtctcttgggaatgaagacagtgagcatttgtagtttacaggcaaatgcacgtgtgtagagagctgctacatgccctgcgtgactgtgtgcaggcgagaaaccattccttcataagcttctacgctggctccaagatgccgacatgggtgaagtgccgagagaccctccgtctgtcatcttaaccccaagttttattttctttcatctttaagagagaatccttagttaattaatttcaggcaagagggtcctcttttgcgtcagtggtggtgggcacgagccccgaagaacatgccaggcaggcgaaggactgagcaggggtgtccacacgctgctgaatggagcggctagagccgggtgcctcgctgggagccggtgaggacggtgtgcaggctggaaatgtcccagctgctgaatcatggctcagcagtttgtctcctagtttggcttaacttctgccttttccatcctaagcttttcaaatcggccaacacaaaaggtaaaagaaacagtggatctgaaatcttctccgtgacactttttactagctttaaattcctactttaaaaatagtgctttcctagtctgactccaaggcctgacgctggaaggacgtgctgtttctctctcatccagtgctaatgataatcgccgtgatgatatcaatatgactggcaacaacacgcgctgagtgctcacttcgggactggcattattgcaaacattcagttgttggaggtgcttctaactgccattttttttgaagaaagagctgaaccattccaactcagggatcaaacgtcccttgttttgtacacaggaggtgaggtactgtgctggctgccagaacaaggcaggcgaattatgcctgttcacatattttaccatagttaatatattttatttcaccaatgtctcttaaagcacattaaacatttaattagttttatttccttttacaacaatgacatcttatttatctgtctttataatgtaattagtgtaatatctgtatgtgttttccccttgagtcagcttaacactttctccttttcattatgaaatattttgtttccttccaagttttctgctaaccaagtccttactttatttaattcactttccccatacactgtgctgtaagattattttatttcagaaaaatgtcacatcttcctcttggtactaagattctcttctcattttaccatttttccctattttagtttaatgtcctttcatttctattatgtgttatgtgttccaagttttacatccctccggcattcattttaatagaattaggagaatctataaataaaagtagctccttagaataatgctttcattcttctcttctctccccacccccacttctccaacgtgccctaaatttaccagcagcttctcctaggccggggttctcccacaaggagtctgaccgctgtgtctttgctgcatttgccctggtacatccccggggttacacaggatcaggattccgacataggacgcctgtccgttaggactctgtagggaatggctgtggtgctgcccttcaattcaacaactcgagaggctgaaaattctacacaaagtcagcaattcaaattctgaaactagagaaacactgcggagcaagaccgagaagataattagcaggcaagcaacccagcctaccttgccgtgccaggggtgtctgcggcttatctctcctccttctctctcctccgcaggaaggtccttaaaccacggactctgctcatttacatttactgggaagcttctccctggggctgaaactctgcctggggaaagcctagcaagttagtggctcagagagccacagtaatcctttcagatgccagtgtagccccagaacatcctctacaaaagcaaatgcccctgaacccagattccaggagatttctttgatgacatcatttgccctactaaatccctagaaaggcttctaatcctcatctctaaacataaatttatgattatgtcttcaaagacaacatggggtctctcccacgtccacaaaaatacctttctcccaacatcttgctatgaaatttttcaaacatgcaccaatgttgaatgaattgtatggcagacatccatatgcccattaccttgattctaccattaacatattcactaaaatcacttgatcaaacttctctccatccatccatccttctatccatttgtcaacacatcttatttttggtgcattccaaagtaaactgcagtatcagtacacaacatacatctccctaaagacttcaacatacacatcattatttgcttatagatttatttcttttgagataaaatttagatatgatgaaacaagcaaaagtaaattacacatttgttgagtttggataaatgtacacacttgtataactcaaacccctactgagattcagaagacagccatcactccagaaagtctcgcatgtgccttcccggtcaacctccagctttcatgcccccacatttggttttgccagttctagaacctcctctgaatggagtcaggcaccctcatgtaaggtttctttcacttggcctgtctatgagacacatgcacgttgttatgcatgctggttgtctgttcctttctattgctgaataaaagagtgctcactgaatgaatgtatcacatttgtttttccattctcctatggatggacctaagaaacacgaaattgtgataaaaaaaagctaaatgacccagaaaactccataatcctctgaggaaaaaaaaatcgaacggaggcatcgccccagattgctgagaacccagcaaggggacacaggcagaccagagacatgctctgactgacggcacttgttggcttgagtctctcctcaaagccccacggccaggtggcctggccacagcagtcagcaggtcgtcttctgctatgaaggggccgacgcagaaatcaaactgggctcaacgttaacacagctccctgaagaggcctcaggacaaagtcatggcattgaaaacgggttgggcagcatggctgctcccttccggctctgtccagtgtttctaacgatgggacaatctgccaggcatcagtttcacacccacggtgcatgcagaaacatggcccaagctcgagacttgcaatctaattcatgcaacctgacagcacgattcaaacaaaactgacgctgtggggagaatgacagtggcaagtgcacaaacaggttccctcaaccttggagagacaaaaggatctctcaatggtggcgcctggtcactgagactccactgaggaggtcagttttcaggagagaccagggaggaggctgagcagctccctggcatgatgagatgcccaggctggcacagccatcagcacacaccaagcacaaagcaactacctccaggaaaggaaccaattgctggaaagtagaaccaacttggaataagaaaataaattgggttaagacaggattttctatagttctctgtagccattgaacttttgacagaagaaaatagaaaatacatccagggctctttatgagtaacaatcaaaagagaaagtggaaagatcctctggttaggtttgagagctgcccttccctggttggaaaaggaaggctgttaagacctggcttgtgatagtgtgggtctgttagttctggtccctcaatgtgagccttgtattgacagtctcccagagctaatgtgtccatacctacctctgaggtttcatttggattggtttttgttttgttttcttttcttttctagagacagagtctcgctctgtcacccaggctggagtgcagtggcatgatcatagctcactgcatagccctgacctcccaggctcaagcaatcctctggcctcagcctcctgagtagctgggactataggcacatgccaccatgactggctaatttttttattttttgtagagacagtgtctcactctgtcatccaggctggagtacagtggcatgatcatagctcactacagcctcgaacttctgggctcagaggatcctcccacctcggcctcccaaagtgttgggattacaagcataagccaccatgcctagccttcatttggattttaagattatttagtgtaagaaagaatcaatttggttttctaacgttttctgatttgaccaaatatcagaacaaggtagaatagcaaattccttgaaaaagcaggcaagcaaacaaaaatcctagaaagtactaatgagttcacagaactccatggggaagagaaagcatctattcccacagacaggcttttgcatcttgtgctaaaatgaatggttgtaggccgaggtgggtggatcacctgaggtcaggagttcaagaccagcctggccaacatggtgaaaccccatctctattaaaaatataaaaattagctggaggtggtggcgtgcgcctgtaatcctagctaatagagaggctgaggcagaattccttgaacctgggaggcagaggttgcggtaagctgagatcgcaccattgcactccaccctgagtgacagagtgagactcatgtctcaaataaataagtaaataaataaataaataatgaatgaatgaatgaatgaatggttgtgagggtcttagattatcaaagtcatgatacataaagttgtctaagcctctgaaacaaatctaacttcttgttcttggctaacggcatcatattcctgcaaatgagaaacagaaccgtgtataagactgttaatgagctcagtcataaatggttactttgataggacagcaataaggtttcttttctttctatagaaattgggctttatcaagaggaacacaaattgggatttctgtttgtttgtttaagttggaaaaaaacagcagaagatcaagatgtatgttagactgaattcaatggcggccaaaaatggacttatttttccatgttaaaatctgtcctcagacagacacacctaaataaactccaactgggacaaggaggcacagatccaggtacatggggtctaacagacataaaaccacaggcctctgctgtgaccctcggagaggacacgtggaaagctaaaactggcgccacggcggtgatcactggggtgcgcagcctgcctgacccatctttataacttagcacctcgtccggggccaggctttgagccagcatccaataaatgtttgctaagtaaaaccagcagcaaatgaacccccctaccctctaatggcatcgaggattgctgaggccttcacacatctggaacttctatctctgcttttatccttactgagctgatttttctccctccacctcccctgacacctctgacccactctccaccattctctgccctgctcagtgctgcagaagactaagccctccaggcaatactgcccaggccaatggaggcaccagaaggaggctgcaccctactcagctccagctcccacaggatctgctaacactgttttgcctccatccctgcagcagctccccaccactgcctacccagtccccgggtacctcaacaccctctgttggttcccttgtccccatgcacaccctgtaagtagcctcttcatgagactcttttccagtgggtcattgaaggtgagttgttttcggatgggatgcagattaaagcactcacgatccatctgcccaaacacacccccacttcccattcctctgtgaacattctatggacccctccaggtctggccctagcgccactggtcacaaaggcttccctgaatccccagttgagaggctgccccattctcctcacttatcctaaaacatttggactccgcccctatattccgttcactactcctctcgcaagagttacgtgctgtctattttaggtggggactttgtcttactcatctctgaattacactgagtgacgagcccaaagcctggcaaacaaatggtgctgcagattttacttcaaacaacaacaggcaaagccaacaaacactctgaacagtgttcaatgaaaagcaacgtacttaaaaacaagggatgaatatctacaacacagagaaagcaatcattaaaagacaaacagccccactgaaaaaatgggcaaagaatataaataagcaattcagagaaggattaaaatgcctaataaataaagagacacttaactttatttactcatttattttgagacagggtctcgctctgtcgtccaggctggagtgcggtgatgtggtcttggctcactgactcctcaacctcctgggctcaaggaattctcccacctcatcctccccagtagctgggaccacaggcgtacaccaccacacttggctaatttttttttttttttttttgtagagtcaggaacttgccatcttgcccaggctggtctcgaactcctgggctgaaatgatcctccagcctcagcctcccaaagtgctgggactacaagtgtgagccactgtgctggccaagcaacatttaacttgaataacaatgagggaaaagaagcatattaaaacaaccaccagatctcatttgtcacctataagaactggcaaatatgacaattggtcatcactacacaaaatcggtggggcccacacacacttctgggggcagtgtcaactggcactatctgttgggagagccatggccaacatctaacacaatgtaacttgcacacatacattgactcagcaggtcccctctctggagtcagactattcgggttcaaatcttggctctggcacctacaagttgtgtaactgggaaaaagttacttaacctctctgtgcttttgtttccacatctgtaaaatgagggtaataataacacctaccccatagagtttctaagattaaatgagtcaatacaaggaaagcacatgaaaagttacttggtacacagtaagggccagcaatcaccatttattattataactagtatttgttttgttcttatggatcctacagaaattctcacaagtgcagagtcatgaataaggataaccactgcaacactgcttataacagaaaaaaactggaggcaaatcaaaggaacattcacaggtgtggtataacaaaacatgttgcatctctaaaatgccataaaactatttaaaaagaatgaggtaggtctctatgtacgagcatgggaagattcccaagacgtcccactgttagtgaagaaaacctaggtaggtccaaaaaaaaaaacatgtttagtgtgattccatttatattaaaaaaaaaaaaaacaacaaaaattctttttgtgtgtatatgcgcacgtatctgtctgttaaggcacagaaacaggacacatatactaatgtgtgaacagtggtgacatctcagggaaggagtaaatcagggatcggatgaggggaggaaggagattttggattttgctttgtacacctgcactgtgtgaattctttacaatgggggagcatttatataatactctaaatttataaatttatatgcaatgtataattttttaaataaaaatgctcgataaaatcctaatgagttgaactgaacagatgttaccaagtgtggaccctctgcaaggctggtgatgccggacgggagatgcaggtaggtgggatgagacgccataaccagggacccagggcatgtggggcggggaagcagcgcagtggcagagcctcttccacctccctgcacggtcctgaccttccacagcagctgcagcactatccacctccccacgcagtgataaagaactcactgacctaaacgtcaggaaagaatgacacaaatgatgggccagctacgccaaggtacactgagcagccattacaagttacgccatagaagacttattgacgtgggaggtacaagttgcaaaagtagacaatcctatttgtataagacattggtgaatatatgtgtgtgcgtgtgtgtgtgtgtctgtgtgtctgtgtgtgtgtgcatgcatacctacacaggttgaatatccctaacctgaaaatctaaaatactccaaaatccaacaggacactcaaagcatttccaatttcagattttcaggttagagatgctcaacaagtgaacataacacaaatatttcaaaatctaaaataattggaactccaaaacatttcttttcccaagcatctcagatacaggatattcaacctgcatatgagtgtgcacgcacacactcagacacagaatcacaaaacaaaaagtcatggcccaaagtgtcaacagtgattattttggggtggtgggactatgggtgatttttatggttttcttgttcttttctgtattgcaaaaatattctgtatccacatatcctttctgtattatactgagaggaatcaagtagtgtaaacagtcttataaccaggccatgctaccctctatgcaactgtgggtccccctccagcctcttctctcctcttgggatctggttctactgtgttccacttgcctcccagcaggcaggaaacacagggttctggtaggcagaaaggagggtatccaagaaaggttccctgaccttcagactcttagactctacatcaagaatgttgccttcattcctgcatagataagcctttgaactgagctccaggccagagccctgataaggaggggaggatcccatagtacaggaggacttcttcacaggtcccttctgccccaaccctccatctgcctggactgcacccctctgccctagccacttagaaagccccaagccaagctccgtggcggctcacatgccacctgctccttgtagcctttcctaatagacacagactctgtctatgaggaaggcctggaatgcaagttgcccaggttgaaagccttgctctgacccttactactatagcaggttactcagcctctgtgggtctcagtttgctcatctgtgtaatgggattaatagtacggttctgggggcaatcatcagcagtgcctggcagacagccaagactgacataggagtggctggcggcagtcatggtggggtactggaatccgaggacccagttgctattctaaggacagtcacgtgtggggacagagaggctgagtacaggcacgagccagactgcttctttacagaaaataaaccttccacaggacaggctccaccaaggccgcaggacacacccatgcctcctgtcctcagtcctccttcccactttccctccctccctcttctgtggcttccccggtcctctttttctggcttcctttcctcttgttcttctgcccaccaaggagcaagatgctcgttctgagcttcagagaacaccaggctaggatgctaggtgtgtccagacttgccggttctgcctcggagtagccacgtggcacagatgactgaacatctgccttggccttgagagcagagtccctgcaggtgacactggaatcactcagcaagactcagtcccaggaaacacagaacccaaaagcaaggtaccaagagatgtcaaagggtggaaagcataagcgatatttgactatacagaaacatcacaaatatttgctgctcacaaacctgctagagctcagcagaagtgaagataacaaggtcagcattttctccatactcacgcttaaggatgatttgcctttggtgaatggaatcaggacatcacaggtcctgatataaaaaattctaacaatttctcattcactaaaccttctcagtgccaggaactgcactagggcctcaggaagcaaaatgagtcacgtaaagacgcagactatgagacgctgtggtccagagggtctagcggggagagagacaccccgcacgccatggccgagcccctccgtggagctcggagaggacagggctgcaggcaggtcaggaagcagcactttggctaatgccaaagaagggcagggcccgggtagaccacacaaggaaggggcccccaggttaaaacgacagcaacagataggtgcagaagaaagaaaaagcatatggaaagtgtcctgaatgtcaaaggcccggacttcatgaagatgcgtgtggtaaaagtgaagggttctgggtgagcacagagcagtggggctctgaagaatcctacggatggccgtgtgggaaatggcctggaagggaggcagggaagccagtgaggcagtcaccaggacactcaccaccagtgagagtatgagtgagcaggcccggcctcggctgtggccatgggctgggtggcaggggagaaagacccagaggctggtcggacagggctgtggtcggtgcatgcagaggctggtgggaggaatccagagagacatctggtttcccatctggaggacggggtacaagataggtgagcagaacggtgtggggcacaggagcacctccatgcagccttctactagacagggaacagcaggcctgacctctggtgggagggcccttatccaacacgaggcagcccctcccttcccctccaccaccttcccagatctccacccagggaagagtccggcaatgatcagggaggtgaacttgggccttttgaaggcaagaaggaagctcttgtaagtgaccactgctggggtcctcccagggggacagtccaggaagggggacaggaccttcttagactgtccgcctgtggcaagcccagcagtggtcatctcaaggtgatctgcttaaatgatcacaggagatatgtctgagagttgtcatcagggtgtttgaaaccaaagcgggaaagtctggaagtccaggttccttgcaggaacgtgagtgatgccattacccactgatggattccccccagggcggtctggctgatcactcagagcttcggtagtctgctccatttgggctgtttctgcccactctcactgagaagatggattttcccaacaaggactctagaagtgatggatgctggccggtggcagaaatacaagagcccccgaggaagattagagaactaacagtgacagcctcttcccagcccaattcagtaaatgggtccatgtgcggctgggcagagccacaggtcgggcgtggctgcggggccctgtggagcgcagcttgtttatgcccaagcagccaaggcaagacaatgagactttcttcctttccacggtgcccctgtcttgacactgagggcattgatgggctggttgccatgggaaccctaggctgctgatcccatcccatggagcgtgaggctcctgacagctgatggctattcatcccccttccttgcaggactagacagggggccttgcgcctgctgctgggtcctccagatgctcaaagggcagaggcacaaggacatcaggaaaaaccacagcttgatgggatgatgggacccgcagggtgtgaagcatccacagtgagctccagggcaccagtggggcctccagggcactagtggggccttcaggggacacagggctctcagatcagtgtggagctgacctggccaagaggcaaactacagcatcacaaagagggtgtcctcatgtacaagtacgtacgtggcagggcctatcgagtgactccaaaaagcaaacgattgggatgagaaagcgatggtgggggtggttcaataaatgacacttaaacaaagcgcaggtgcctggccttggtccctcacaaagactcataaccaagagtctcttaagactcttgcaaggcaggggccacattttcttatctctaagtgcccaggccagtgagagcacacagcaatactcgctgaataaatgaacgcacgtctgccggccaccacagaggtggcagaatcggaactaaccttagagagcagccagaggcctaactttgggctgactcacccaggaagcccagagcccagtgtcagaaacaggcaagccagcaggcaacgtccaggtggcagggggcctgggggcccagacgaagggtacatccggcgggctggggaaatcggggtgagtcggctgatggaactgacagtgcagcagaacttggaaggctgaggggcgaatctggtgacgggtgggaaggctgaggggcgaacctggtgacgggtgggaaggctgaggggcgaacctggtgacgggtgggaaggctgaggggcgaacctggtgacaggtaaagccgttctgggcaggaagaacaacagaagcaaagcctgaaaggaagcaaaagcatgaagatgggggatgggcagagctgcagctacagccagggctcgaggcggtggggtggggcaggaggaggccctgaggcaggtagaggccacagaggccacagcctgtgctgggcggtggcaggggcaatgcagggagcctgagagccattcaggagacagtgagacaggcttgggggagcacgggagcaggaggaggcgatggtgacctctaggcctccagctctgccactaaggtagacaggggtctcttcttgtagacagggacccacacgaggaggaggtttcagcaaaagatgattagtccagctgataaatgtgcagcttgagtgactgaaatgtgagtgactcaaatgtgtagtttgagtggcttcctagaaggactggagggcttttctttttccctccaatagagagaggtgtgagtggttccaatgctgatgagcaggagccagtacagattccccgagacagagccatgctggtgtgcagccctttgagtctgtgcgcgttcacgcacacgcatgtgcacgcacccggtggacagagggagaaacggcggctggtggggtctccggaggttgctatgcctcttgtctgttcattctggcagaagccgaaaggcttttctgtctgatgatttacctttgtctgggaagcaggtacgaggtgacagcagtagaaggtgagtcagagggtgtggggtccggccctggcctgtcagtcactggtttgtcagaaggtacctgggtctaaggcctcatcaccattaaccaggcctggtgacacctccctgcagggctggtgagggccttcggagcaatagtcaggagaaacatcagctggtgggagcaagaccagggcttctggtcggtggcaaggccaagacccagtcccaggagccaggaggaggccagccacccagggcaagtacaacccggaagccctcccagggcagggtgaaaggaggaggagaggtgtcggcagcctggctgagctgcagaagatcagaggaactactttctagatgccacaatctgtgtagaggctcagagatccaaaaaagctcaggacgttcccagccggcatgcagttggcggacactggagaacagggtctggacagccctgagtgtccctgtcaccacccaaagctcaaagccggcaggagtatcaggcggtgtcccagcctcccccagcccatcgacagctccgtgtttctcatttgcttccctggtttccgcccagagaaactcaagcctttctaatggtccagtcagctgagccacctgctcagtcctgattctgagtctgctcctgattctgagtctgcccctgcacctgctcagtcctgattctgagtctgccctggatgctgccttctggagcttttctggctccagagatggcagctggctcggctttgatcaccactccccgcaccagctccaatgactcaggagggcagtccggtcaattaaactcctgcccacttaaaggcatcaccatccgggtgaagacgtcagataggagggttaagacaatgagcttcacaaccctcatcttgcctctgtccctcagttcacacccagaacctctcgcaggccagccgcgcacagccagtccagcttggctcagagcataaaaccaagacagccttagaccgaaaaccaatcccagagaactaggtcacaggtgactgctcttccgggtctccccttgtccctaccaaacccctgacgctgtggctggaacaagttctggcccatcattttaacacctggttaaggcttcggcttgtttttcattgcaagaacaagttgtctgcagcatgacaattttcctctgctgacaaatgaatcgtgcaggctcacctgaaattctgggccaggtatgtcctgctcagtagctattttaagtaaaactatttaaggcaagttcaagatcatttaaggctcttagatcttttagggccctggcagccagcctgcctttttatgttcagactcagaagcaacaaattagctcaataccccaggcaaagcaaaaacccaagggaaagcatggcatccaagaaccacccttaagataaacatcatttccaagagcagcagacgctgagctgttgtgatttggtatgtggagaataccttgctgccatcctctccacacaagcaacttgtcttttctgagtcacaatgtcaaaggtgacaatgcacacaggttagagcgagggtgactggaaggagaaagaagcaggggagaagggaagggttcctgggctccgtgtccagctctgtccaaacgcccatgcgacctgcagccagacattctgtttctctgtcaccatttccttgacaagtggatcggcccagtctggacatctaaagtagggacttcttaacatgggcctgcaggcacctgcctccagcggtgggcttcagatggtccagaagcaccatgcggtaggtgtaccatgtgcatctcccttttcttttttctctcttcaatgttttatgtgtatctgtgtatatgtctatgtatataggtatatgcgtcaatatacgtgtgtttatatattatacgtgtgtatatatacacacttgtacacatcaccacatgtaatataccctgatacaaagaaaaaaagtacaaaatgtctaggcacaattttgtatataatccacgtatgtttatacatacacacacccacacacataagcgtgtgttgtaaagcagtacactgcagataaagtttgaagttcctctcccctccctcccttcttggaggtcattgctaactagaatttgatgcagatccttacagcccacacttttatacttttactacatctataagcatccataattaatacagtattgctttgtgctttgtttttgcttgtttttgtttttgttttgagacagagtttcactctactcgtcggccagactggagtgcagtcctgttcatctcagctcactgcaacctccacctcccaggttcaagccattctcctgcctcagcctcctgagtagctggcattacaggcgtgcaccaccacgcccagctaattttcatatttttttagtagagacagggtttcaccatgttggccaggctggtctcgaactcctgacctcagatgatccacccgcctctgcctcccaaagtgctgggattacaggcgtgagccaccacgcccggcctgctttgtgtgtttcttaacgtttacatgaatatgatcacattggacacctacaatttgccttttttctctctcaacactatttgagagatgtatctgtgtagatatagatctggtttattcatttctaaccactgtagagtcttgcatggtgtgactattttgatttagttctctattctacttcagggaaggtgggttttccttcatttaaaaaaacgcctgcatggacattcttatacaagtctctttgtgcacacgtgggagagttcttccaggatatgtctggctgtggactagcaagtccagcctcaccgtgtatcgccaaattgctctccaaacgataccaatctccaccagcagcatctgaaagttcccattgctctatatccttgccagcacgtgatgctaacactcttccgtgtcgggaaatccaataggtgtgaaatggtatctcatcgttgcctaaattgcagtgctccaataacccccagcgaacttgagtgaagctgggcatcatttcttatgtttactggtcatttggatttctcttcattgacttctccattcataaacttccccatttttctacctggcgtgtatctttttttcttagtgatttatagttttcaaaataatctgtgtactaatgtatttgttatatattgtaaatactttcctggtctattcttgctttttaactctgttaggatgcctttgtttacatagaatttttatcttaatgtatcagtctcttcattttgaaatttattttcataacttgtgtagggactcctttcccggtgtgacaaaggtattccactgcagctctttctaaagttttatatacagtctttaatcccatctggaatgtactgttgtgtaatgtgaggatctaattgtttttccatggggagagcctgttctcccagcaccatttagtaaatagcccatccttccccatctatttgtaactcttcagctcacacatacaagttcccacacatgcttgggtttgagttgactctactgctggactgtcgttaccacaactcccctcctcctcttctttcccagagttgtctgaggtattcctggaccttactcttccatatgaattttataattcatttgtgtgatttcatattccacattaaatcttgtcacagcttaaactagattacattgaatttgcagattaaattggggcaactatgagagccagccctcccatgcatgaacacaacgcatctctccatttatttaaatttttttttttttttttttttttgagacggagtttcactcttgtcgcccaggctggagtgcaatggtgcggtctcggttcactgcaacctccgcctcccaggttcaagctattttcctgcctcaacctcccaagtagctgggattaccggcatgtgtcaccaagcccagctaatttttgtatttttagtagagacagggtttctccatgttggtctggctggtctcgaactcctgacctcaggtgatccgcctgcctcagcctcccaaagtgctgggatgagccaccatgcccagcctaaactttcttttctcagtccttcttctaaatattttatgtttctctataaaagtctcacctttttaaaagacctatttcaacgtatctaacagcttttatgcaagaatgaagaatggtttctttcgtcttctcagatgtgctgccatgcaggtggctgttgctgatcaactcccttattagctccaggggttaatctccaggctcttttggattatccatgtagttatgtcatctgccgataatgacattggacacttccacatttttattccctttgaaatcctgtggtgttacctggactgatgagtagagggacaaagagaggctgtcttgtcttgtccctggtgatgcatattttacaatggagaggatccacagcctttatcaggtgctgaaagggagccatgacacaagaaaggtgaataaccaccagtctaaattacctctgggccatgtgaaataaactgaatccagttattagttgtatggaagaaagtaaaacaagcaagaaccttgagcacagcgactatctgggagaaaaccagggctgcgattcaggcaagtacagaacataacactaattgcccattaagggcttggagaaagagtttcacaaaggagacctcagaacagagaatacggcagaagcaaatgagcagggatggaactgtcagaggtgacatatgcgtaccatgtgaacacaaacagcttccttcccttacttcacccccatttactcatctgtaagtcaaagctaataatatctacatcttatttatgagtcacaaattctcctggctgaaaaaaaggcaaataaggttttcaaagagttcttattgagtgggtagaggctcaaatgctccaggccttttccacattagcagtgcacttagaggggggaaagaaaagctcgttttggaataaagagtaataggccctccgtgagtaatcacacacaagcctctgagacagctcctatccccaaccagctaatctctgttagtgaatgtcaccgcagtgccactgccagcaccatgcctgagtgaccgggctgcgtggcattcatgctggctgcactagacagagctggggagaccccgattaactccccagaatatcctgggtacggagtgtgcatcggggcgaatcttctctcccatccgcaaaaccaggagagcagactgcactaagaactcagtgagcctgacagaggttgtctcaaaggggcggcatggccaagggttaggcatttttattcccacagatagaaatttccggggagagttacctgtgcctctctgcctctctcttgcagtgtgagctcacagctcaatttcagctccattctgctcatttaattttagaatcccaaaacccaggcactttgtaatttatcgcgtagtttaagagtcacttttagctgaagacaaattgctgggccacctgggcacagcagcgaagtgtggcaggagccaggggcactacgcaaacatgaggaacaccttcttcagcctggacaatcagccagggagagtcaagaactacagagacaaacgaagtcagtgctacccgacggcaaaatctgaaatcacaggatgtttggagggccttgagtggttaaaaaaactaaatatctatatggatatacatgtgcgtatatgtatgtgtgtatatgtgtatatatgtaacattttatatatatatatgcatatatttaaaaggtctccaaagatgtgctagcattctttcagtaaactcgaacctgccttgtgaagattccttcattcgaatggtggaatccacccctccagccacacacctaatagtacatcaacgtggggcttgggatgcagaactaatgtcatttctatcaatcagggacgccaccacaccttgctggcttctgccacggataacgatgaaactacatttaacactgcctggcactaaggtttagagttatgagtcggtgcttccctgtcacttcacttaaccctctgagtgtgtagtttgtagatttgttaactgcactgagaggtcccctggtgtgacctcaaaataacggcctctccaggagccataaacatggatcaaccccaactcaccgcccctcagcccggtagctggttgagagaggaaaaagggacccgccgggaggtcctttgagggtaatgccgcctttgtgcccagggcgtggcctgcttgctcactgacagaagaggggacagccgagggctgcggggctgggagggccccgtgggggccggtgagggtcaggccccggtccaggctctgtggcaacgcagcattagatctttccgacaacccagcggtgtagacattgccactgactgcaaaggagcttgtcaggggagcgacttgccaaaggtcacaccgctcggccatcagaaccgcggcagaagcccccacacaaagcgccctccctccgctcctggagaggttttaaacccaggacccccggccctgcgctgtcccaaggcctctccgacggcggccgggctccagggtgcaggctcccggccatctacccccgggagccgcggacaccgagggagcgcgagtccccgagacgccgggccacgctcatgtcacccaagcagcggccgcggccgccttggcgcgcgcaccgggtccggagctcgcgccgcccgtcgagggcagaggggccgctcccccgcgggggagagccgggtgggcgcccaggacccagcggcggacggcgcgcgacgcctgaggcagcccagactcccccggagcccggcaggtgtccgcgccgccccggcttctgaggccacacttccgagcgcggggttgggcggcactgccgggggacttgcggtcggcgcgccggacctgcgtgggcgcccacgcgggaccccagtcccccccaccccgccgagtgtcccgcgcgcgcccccccgggcgacacccccccccgcagggcgccccggccgcccgccgtccccaagcggtcccggagccttcccacgcgcgcgcggggccggggccgggcggacaggactgcggaggcgcccccctcgcgcgcgccggaggccgccgggaaagttttgggcgcgcggggccggccgcactcacctggcccaagttgaggtacccgtgcgccgccgccacgcggtccgcctcggccgggccgcccagcacttgcaccgcccagtggttggtgtagacggggcgcggcgggggcggagcaggcggcaggcagcgccagcagcagcagccagcgccagggacgcggcgcgagcggccggaacccgggcccgccggcgccccccgcgccccccgcgccccccgcgcccgcggcggtgtcggtggcggcggcggcccggggcggcggccggggcccgggcgcaggcggcgcgcgcggaggcatagcggcgacaggctcgcgcggcgcccgagctgcgagtgcgccggggggtggagtgccgccttttaaagccgctccgcgccggggaagcgccgccgccgccgccaccgccgccgccaacaccgccgcgggcgggagccggggaggaggaggcggccgcggcgcgttcccgcccccgggcccgcgctcctgcgaccgggctccggggccgagagccgtccgggaggcccgaaacgccccccaccgggggaacttccccgccgacttctggggctctcgggacgcggtgccgccccagaggcgtcctcggcccgcgagttctgctgggagcggggaggccccggcgtctcaggtgagtccccggttccctagaccggccggacacccgaaggccgcactcacctggcgggggcctcagacgcctggcggcctcgcccgcctccctagacggagggctcgcccgtgtgcggggtcccagggagaagaagctgcggggaagacagtgggtcgcccgggaccaagcctggctgaagggacacattgagcggggcaaaggcatgtggcgcatcagccgggctcacgagcgtgtacccgagaaaccaccgcacggagcccatggcggaggccgcggcccatgctgggaggcaggccgtgcaggtgaacccccaggccgcgcaggtgaacccccaggccgcgcaggtgaacccccaggccgtgcaggtgaacccccaggccgcgcaggtgaacccccaggccgtgcaggtgaacccccaggccgtccgcttagcctcgctgcgatcttgggcaaatgactgtggtggctgagggcaggcgccccacctgcaaaatgcggggaacagtggcatctaccccgtcgggctgatttgaggatgaggtcagcttttgctgtacaataagctgtccgtaaacgttcgtttttatgagcccagggcctgccgtgtggtaggtgttcactagacgatgtacactcttaaaagcacccactgagctgggaccagcagtagaaagtcagctgaatcatcctcacccctgcttcctggagcagcctggtatccagtggataatgatttgaagcaccctggagatggatggaaatgttcacaccataatcaaggaattatgaagggtaaggatcgctgctggatctcttctgtcatccctcccaggacccattggtcctactggcccacttccagaaagcaagccatcaacctgcttaatataggaagtaaaacaaaaaggtcgagaaggccttgaggtgggaaggaagctgcttctctgatggtcagttccaggagcggtctcttgttgagcgtgcaggattcacttggagtctgtggcttggcagctggaggtgagaggctggggcgagaggggatgggctgaggacaggatctgcatagatggtttccgaggtcctttccagcctcgctctcaggagccctttggttttgtaacccacgtgattcatcatttcttcaggtgtgagtcacccctaatggaggtgggagaacaggaggcgtggtgggaggccccatcccaacaggccacatccatgttcacaagggctcctgccaagggcccatcttggaacctggagatcaacgtcccacatggccttcgctttgctacactagatgtaacttcacctccctgcgttcccctggcaagtggggtcagctgcttgggccgtcactccaggcctgcccacactgcagaagacagccaccgtgtgtccctcctacagatggactggatgctcaccagcccctgccagtggagagacatgaggccctcatgcaaactggcagccctagaggagaaccggccatacttgttggacagaaacagtacccagaactctcagtctgcctctgcctgacatggccctggctgcctagccaactggcttgcagaagagggacattggcctgagtcaaggggacggggttggaggcattgcattgtcacctagcagcagtatgtctgggcagcatgtgttacctctcttccccttcccctgctggccggatgtccctcagattcatcctggatctggtgccgttcttcaaatatgtggcctgcttcaagataatgtaactgcacatcagctaaatgattataaagcagctggtgcctcccaagacggagcccccgcaacggcagtgattttgacaggcagagataagggtgtttccataataatgtggtagattaagggattcagcctgctgtactgaggggagactaaaatgcatctgaatttttatttggagagatctgaatgtattttactaacaagtctggtccttttgggctgaactttccatttgtcatggaagtgcccggcaatatcttgactccgatgttgtaggaagaccagcttcccaaaatgaacatcctgaatcgaatcgcctcctgtgggtttcctattgattcacacggtgacgggattagctcagtcacgggagtaccagcccttttcattgtgataggatctgtaataaaacttggctagtcgtcctgcagggaggggatttattactcaggctctggctctccacatggcccccgaggtccacacagctctgtggggagggagggggtgctgctttcctagattgaggtcttcgagcctcaggagggacaggacatggaccagaaaggtgattggagcctggtcatatttcggaagttttgtgatatttatactgacatcttctaaaatcagaaaagaggagaagacattgaatgatgtgttctcatgcccaccactgatccctttacagcaagcatgggattatccggccagagtccgggaatacccacgcagccaagaccacaggacagcaagagcctttgcacagccttctaggatgtgataagacatactttgatgcagaaattgcctctgtgtagggaatagacactttattgaacaattacatttttggcaatatgctaggttcagcaggccagactagcatcccttgaaaaatagctgatggacaccaccttcaggataccggagatgagcgtggactcaaagcccagctttgtcatttactcatgtgcagcctcagtaaagttgcttcagtttgccctactgaaaataatagtaacgctgctgtccccatacagaggggctatgaggatgacaggagctgatgtgagcagagcctggcacccagagcctggcatgaagtcagcactccataaatagtggcaacagtgaccactgctgaccaggcgctctccagtgggatagagtagttagggctgaatactctgaccttctctggataagggctcactgtcctcatctatgcctgggtgcacattttctcacatcttaacatccccaaatcaagaaacatctcacagttggtgttttgcaatcatcactggcctggactgaaattgagttcttccagagagggtttgtttttgcttctgccagtgatctggggacacagctcctgaaactccttggggatctgctgaatggtgtgaccccagtgtgagaaccagcttatggttctaatgatcagtgcagggcatctccctatttctccctcccctcgccagggccaagatagaaacctgatgattccttgctgttcctctccatggtgggtttatttctcattttcccctgtactgacagtagagtctttattttccctcccctcccctctctctcctctcctcctcctccttctctctcttccttccctcctttctttctctttctttctttctctttctcctttcccttcccttcccttcccttcttttctctttctttttctttttcttcttctttcctgagatggagtttcactcttgtcacccaggctggagtgcaatggtgcaatctcggctcactgcaacctctggcgtccgggttcaagtgattctcttgtctcaacctcccgagtagctgggattacaggtgcaagccaccatgcctggctaatttttgtatttttagtagagatggggtttcaccatgatagccaggctggtctcgaactcctgacctcaggtgatccacctgcctcagcctcccaaagtgctgagattacaggcgtgagccaccaggcccagccaacagtagagcctttcattgttccatctttagagaggcatctcctgtgagcctttcattgttccatctttagagaggcatctcctgtgagactttccatcttggatgttttttttttcttagtaatatgttaaataatgacacatcttccaattgagggtgtatcttagatttgatgacatatgatattaatgccttcaagacatattgcagtaaagaaacttgttgaattcttccaaatatatttgctgtgtctgtgtatgtgtgagtgtggcatctattgatatcctacagaaaaggtacagagagtacagcatttttcatgaaaatctgttgtgaatcctcagcaaggtaaaggctttttcaaagtaattgcctggctcagttgaattttcaaatacatttctatcgggagaatcctcggatactttgggccagacagcactcagaggtgagatactgttgggacgtacagtcattccttagacctgacagtgcttcttgagcccagataaacacccaaggtccccaggaacaggaggtgtgatgcaggtcgcacacagccagtgggcctgagacatggagaatccggggcagactacacctctgcctcccaccagcccctcccaccgtccccaacaaacctttacccaagcccaggtttctacaaaccggggatttccccagccaggtcctcttctctccctttcacgcttttcttttctctcctttttactcactccaaatcccactcacagctgctgcccatagcagtggtgggtcaggggcctttgctcccctgcagcttcaggctctgcgtccttctgggctctgccttctgctcggtgtacacagtttttcagcggtctcttcagtatctgctcattcatactgagctctactccctgctggggtggggggacatgtgactatcgggggtggggagggcatggagcagctcccactctactctcctctctgcttaaactctctttatatctagatcctagttttcttaagaaagagcccttgaaaactgcttctcctgtgaaacgattaccgtgggtctagcagttatgtatcccagtgttcctttcctaaactcccatgtggaaatttagtgtcaaacagggaatttaggggcaaaaaagctgaaactccctgagaagctcttcctgactaagaatgagagcttggcaattcatctcgtttcccttttcacctcagcatccaggaggctcagagccacatgtgatagaaaaattgtagttctttatttcttctttgttgcaataggtaagatgcctttggttacaaaatatgagagtgcccaactgaaatgagtgcagacaataaggacaattcattattttgcaaacaagaaactggtattagtggacccagggttgttaattcagcagctcagtgatgctgggactcaaggtagcttttctatactttacctgcctttctcctattcttatatgactgccacagatgggaggatcatatcctctcaagacagcctccagggaagaagcgcaggagcgactttccatctcttgaatgtcttcatctccctggggaggaagcacctaaccctccagtccacttcctctcaggccccacctaccagatctgggtcacaggcccaccctctgctgccaggtaatcgtagacaaggtgagcagggcggctcaggttgctttcgatcagtctttgctcttctcctggggaacgctccctgagcacattgctgccccagattgagcaaaaccaggatgctgttagcgaggggcggcactgtggaggctgctgggcgagttccttgggggtctacctcttgctctctgtttctgttggatcaccttcatatagattttctcaggcacacagcagactccaagcaaatatttatcgaaaagtggaaaggaagggaggtagggaaggagggaaagggggggaagggaagggaggaggggaagaacaagagggaaggggaaggaaggctcaagtattatttagaattaatgtgttccacaaattaaatacaacacaaatcagcctaagcagcggtgactctgactttccccaccttccctgtccccacgcccggcagcgcaaggatggcgttgcactgtccacaagcccagcagtggggtgtgcctttttcctgtgtgaagacaccccttggctccagggtgggtttcgggtttgtggcctaagtgttcttcccgagtgagagtgaattgggagctggggctccctccctagtcccggcaaagagagcagagcagaagacaggatgggagtggggtcctcgcggcgacaagcagaggagaagagctggcaggttatccctctctacaaaagtctggttttgagaagctgagcgcagaaatacatcatgggaaaataggcattgcgggggacctgctgggctgtggtgtacacgaagtggccgggctgggtggggctgaggaattgcagctgaagtcctcgccctttagctgctctctttcctcaagagcacagaaggcacaaacaccattgcttctgcaccccctgccctgtccctctccaaagctgcccctcccttggtgccctggtccccagggaatcctgccctctgcagggtcatgctctggcagttccccaaactcctaaccctctaatcttttcctgtccccagatccttccccttagttgcacgtgtgccagagctcccccacccggctctgagaaggcttcttacgccttcctgcccctgccgccccttcacatcacctctgacctcctgccttcacttccccggggttccaggaaaggtcacatgacgccgctcttcactctcgggcctctccatgccgtcctctccctctccctccactcggctggatgcaggtggagaagaaacacagccaccccggctgctgtcgcctggcagccatcattacacacctctggcagtctctcgaaacgcccacccctcctgtccaactggcgtcctccatactcaccctcagctgacagccttgcttccttcttacctcctttctcggaagagatcttcctcctccacccacacctgcgccgggctctgcctcacagcactgccgcaggtggtggggcccactgaggacctcccctccctcacctgctggatcccaagctaccccagctccccagagccgccgcttcacagtatcaccctttctcctgctgagttacctccatgcacgtacaagcatgtggttataccatctatctttaaaaacccacaggactctcgccagctactctcccattcttcccgttttagcaacacaaaactcctcaagcaagtctccccacccactatttcagtctctcctgcactcaagcccacccacgctgtcatcaccatcccccgcagcctgtccgctgctaactccagggggccgttctctgacctcctgttggaggccttcctgcacctttgacacggctgacaccccttgtcctggaagcacattccgcttgtggctgccaagcggcccctgctatcctagttctcctctcacctgtgtggccgcctctcctcagtctccatcgctggttcattcttagcatcggggtgccccgagccccgactcttgggtggcttcttttttgtacccaccctcactcccgcgacgctctcagtcattctctaactttaggtgcacgttacgtgtgggtgactctcggagcccgtcgctggcttggactcctaaactccaggcggccggcagcttctctccttggatgtctaaagcactttacaagctgagctcctggtcctccccgtccccaccacaaaacgcccccgccgccctgccctgtccccagctttctccattacggcaaatgccaactccacatttccactgctcaggctaaagcctgaggtcatggttaacccctcccttcaccccagcacacccgtgtctagactgtcattgagtctggttgtttctactttgaaatccgttcagagtccggccacttctcaccacgccccctgctacgtccctgggccgagccacccccacctgtcacctggtgaaactcaacagccttctaaatgccttccctgttctggccatgcctcctgccatcaatcctcaacacagaggatgtgtgaaaatagaagtcagatcaggccgttcctcagctctaaattcctccatggcttccaacctcacgcagagaaaaatccaagatttttctctaccctcccccaagcacacagtggaggctgtcagatacgagaagagcattgaacgagatggttagggcttcctggaagaagtgacttttaacctgaatttgaagatataaacaggagatagccagacgggtggaccatcagtcaggactaagcaagaaaacagagatcacactgaggatttgcaatgcagggagttggtgactcagggatgaaggagcacagtttctcccacccctgggtgcaggcctccctcccccagctccaggcagagggcccacttgagatcagcacgtgcaaaggccctggtgcaggaggaagcctggtgtggtggaggagctagagggcaggcagggcagcaggggcattggcagtgacaggagggtagtgggagaggggatgagaggcacggccagaggccaggctgtgacagcttcatcagccttggcaagaatttggactccatcccaagaagggtggaaagcggaggaggggcactcccacagctccaacccacctggcctccaaggccttctgacctgcacccgcagccccacgctgtcttcaagaggccgggaaccttgggtcccacatcttcacctccttactcaatatctccactctctgtggcctctgaaatccagagcagcctgttctaacctcctcacccccacccggaccagaccctggcctcaagggcatgctgtggccttcatgccctgacccagtgtgggctcggcctgactcccacctctcaccagttccctcacccgtccccaggcttcccaccctagccgagggccctgtcgcactgtctgtggtgttcacttcccaggtggtctctctagctccagccgctgcccctcatcaccctccctgccgtctccagagtcttggttcccaggcactcccatgagacgacttagaccatcagtgagtcttctcagccagcagggtggagatcaaactcaggggcacggcctttagcaagctggcactgtttttcttgctcttcctgtcccaccatagggccagttgctgctcccagacggactggcccttcaggcccgggcaccttagcttccactatttcttcctgactggattcttctcggtctccaggcagaatggctctccctggctgtaggaccttatgtttgggggcccaactgtgatttgtggcctcactgccagccctgtgtgtgactcacggtgaggcctcagcagctgttccctgcacccccatctaaaacagctccctgcacccccatttctcactggcaagatgaagcctcagacctggcaatctcgctccacccctatttaaacaaggcagaacctctgatctggaatgttcccactgcagcctctcccagagccttgggaaggagttggctaatacaatgctgggtggcagggctgtgccagcagtgcagtgatttttaaaatatgtgttagagccctgggtttttcctataaatgagatggtcggccatcatcctaaatgtcactccctcactattaggccacagtgatgttcctaaaagagtcaacagtaaagacctgtttgtaggtatctaggagccggcagcagaccctggggacacaggaccaaacgtagggaggtttcaactctggatctccatcgattctgagcacctcggtgaccggggtgggcttcaggcttcctgagctggggctacaggagtgcaaaggggttttatgatgagtccatgtattaaatgaaataagggcccacagaaaagagaaggctgggaccgcaggtgtccaagaagcaaggcacagaggcaagcaggttccttcccacacgcagctgaggtccactcaaaaggtgatcctgaagaaattatgctagaatcagcagagtgggcctcggctgagtgtggaatccagcccactacttgctggctgtgtgaccctggaccaggcacctaccctcctatgcttccgttttctctgctgcagaagaggctgccaatgatgccttcccttagggagtgagccaggccgtaattcaaggctaggcagcacctggcagctggcatgctggcagcagacctcctgacacacgtgcccttggtttggcagatgctggcaagggttgtggtgacagcggacacgtgaaccacgacagctggaagggaacagtggaggggagggcactatgctgagtcacatttagacctcactaaaaccgaagtggttcctgttaacttgctttggtctatgtggtggatttagggcttccaaaaatcctcttaaggctttttatatcctcctcactatttatagtctaaactcccccaaatccccaacccagacaaaatcattcctgctatgttttctttcgatgccaagctcaccagcagcagagaacatagctgcatgacatggggcccgataggctgctcatgcctgtgcccctccctccaggagtgagacttgggaaatcctttaccctctgcaggttctgtgtttatcctttgcagggtcacctgccacaatgtccaactcctgccacccacaggaactccagcaatgctactgattcccaccatccaatattgtgatttttcaaaggttgaaaatttgataagcaaacaacacatatgtggcccaaataattttgcatctgggtcttttcatctggactgaggccaatgcccttattcttcttccttctccttcggagccctttctccctccatcctgtaaaagtaatctttcattagaaatcagcaaagtggaacagtatactccctcctgagcatgtaccagtcacaggtcacaggtgatcaccactgtcaagaagaaagtctaattcagtcctcacctttgatagacgggaagtctggaaccttcttagtcacggcctctcaggcagaagataacagaagacttgccacagtgcatggcagggccacaagacagcaggaggggaagtgacactcaagtcctgtctcctggaataggcaggggatggtccaagtgaagtgggattgctcaggcaggaggagaagaggcagaggggcactgtggctagggaagaggctccagccctgaccacctgggttctcatcccagctcggccacctcccagctgcctgacctcagatgagtccattgacctctctgggcctcagttttcccagctgagcataaaatgggcatatttgtgtccaccttaaatgaattagtgtacagtgcctggacctgggcctggcactcagacagcattatgtgagagctgttctcatcaggccagaggtttagcaatacctcattgctacttgtaaacatgcctggttctggaagtgtctgtgtgggtgtgtctgagttaacacagacatgccccaggctggccaaccccacaggccggacttgtatctcccccagcagagacccccaggccagcctctcctctccctccacagcccagacctagaaggactgcacagcctggggacctcagctccttcccctacgtgcctggtgaaaggagggaaacaggcagtgaagaaagaaggagcagaggaggagacaaaaactcacctctcctgaaccctctgtaaggcttttgcatgcattcgtgtctgagctcctaaagtccgtgtcctgttttacaaacaagaaagccccgatcctccgagggagccagggctttgcctgaggtcttgtcaggtgaacagttagggttctggaatgggtggctgtgaaggcacaaggcaaaggcagagggaggagcctgggcagccacccggccccatctcttcctgccacgccgtgagggcatcctcagataaggacccaggcacaagaaccttgacgggaggggagaaggacaccccggctggcccatccccacgggtcggtagaaacaggagacaggcccgaggactccctggtgaccagggaccatctgtggcatccccctccaggactgtgccccggggagaaccgctcactggggatcagcaggctgcactgttgccccctggaggatgcagaaggagagagacacggtgcccggactcggcagccccatgatcccaagctgggaaccccccgggcaggcttcagactcctttactgtctgcctgtcacccccaggcccctcctgccagggggagctcaagggagtgagtccccctggtggcggggaagcccgtcctttgggatggaaaagcccgaggccgccccagctccctggccaccatcgtgcaaaggcagcaaggcggacagtcaaaggacgtgcatcctgcaggggcttgatccttttgatgcctactgatgaggggcaagtcactgtctatgaagggtctacaatgtccccaaattctgcccctaatgtcgctttagaagtcaagcctatccctgctagtggcatttaggagctgaattatatcttcttttaaaaaagaaaaaaaaaggcttctctccagagaagtattcagatgcccatgagctctgccatccaatatgaatattcccttaaaaatgaaaattatggcgcacttaaaaaggagcatgttatgtcagcaccggggataagacaatttattactgtctacaaaaggaaggctctaatgccgtggtagaggctggctcagcgggctgtaaattatgagccattctctggctggtggaaataaatcctcttgtcactcactgtgctctccccttgacaggccagcaggccgccgggagcaggcagagtcaggaattccatgtccgtgacctgagagccgcaccactccacctcctgggcctcactccgccctatacacgcgcacacttaatgacatctctgatcatgtcttcaggacgcataccctctttgacttgaaaaagtaacaactgtttgtggccttctcacaggccgaaaagaacaagcggggtccagtggagaaaggtgaggcatgggaaggcctggcccgagcactgtgacttcagcgaggcaccctccacccctctcagctttcctggtctgaaagtagaatttcgccagagggtgagccgacaggtagagctgtttccacctgcgtgtgctgcctgtgagctggggaactgcccacactgggaggggttgggaagcgtaggagggcacctgtcgcagacgttgaggaggggctgcctttcccctccaggggctgacctcccaggtgattcccagagccagaccacaattccagaattcagtgaaaacagcgccaaatcctattccctcccgatcccaccctgatccctgcctctggtaaaccggtaagtcttgttttccccaccaccacctcccactcaccaccttcctaaagcgatctgtgccatcagcccctactgtgagtacagccctctaagccactcagagggacttcctttggaagctcactgtcggagacatcctgcatgcatccaggtagagacatcatgaacaaagaatacgggccgggcacggtggctcatgcctgtaatcacagcactttgggaggctgagacgggcagatcatgaggtcaggagatcgagaccatcctggctaacacagtgaaaccccgtctctactaaaaatacaaaaaaattagtcgggcgtggtggcgggcgcctgtagtcccagctactcgggaggctgaggcaggagaatggcgtgaacctgggaggcggagttcccagtgagactcacccagttctcagtgagctgagatcgcgccactgcactccagcctgggtgacagagcaagactccgtctcaaaaaaaaaaaaaaaagtatgtatacttgctaggcagtaagtatgattaaatgtgtctgctgtgtaagaacttgggattaaatgtttccaaagaatggttgaggaatcagctggtatgattgccaaataaatactagatgcccagttaaatttgaatttcagataaacaatgaaaacacttttggtttaagcgtacctcacacaaaagttgggatacacttgcactcataaaattattttttatttatctgaaattcaaatttacctgagtgtctgtcctgtattattatttgctaaatctggcaactctgggtgggcaggagggtcaaatgctcaagctgggactggctagggaaatgcatccttaatattttaaaaagaagtggcaggcacaggttttggttgaaaaaatacagaacattttctcttggggcctggaatcatggcaacttaaaccattaaaagtatcctactgatctcaaatacagcccattaggcctccaggaagattaaaacaacaaaataaataaaagtgacaaaagagacagaggggagagagatcaagaactaaatggaacatctgatattcatggaagctgtgatagttccgaaactgcacattcgagaagttttgccagctggtatttcaggaagggtttgggggaatgggggaagagcccttctgctggcccatctctcttctcgtcccagcctcaatccgctccaagacaggaagagcaaaggcgagaaggagccacgccccaggaccgatgagggctagcaggaatatcacatcacccacaccattagttaggtatgcctggtcttccccgctcagctttcttccctcctcccgtggtcaaccccagacacctcagcaaaatggacagccatccaagccagaggcaccccctccaagcaattctcattcattctacttcatcattttctttagcatcttatttgtccttgaattttctattttacctttcctccactttctagttattttccccctcccccaaaaatgttttctggtggtcagtaagacacttgctctctctggaagaacagtgaaatccctgatgagacccagtgtgaattcacagtgtcgtcatgtctgtcctgtgagattaggcacccatgaaccttcccagctttgtgtggatcgagcaggtaagaacagaacaaccatttgctgctcccagtgcccacggtgagatacacttcagaggtgacaaatggatcgtgcggcagctcagaccccaggcgggaggccacggggacacccaccactcttggcaccgagggctccgcacggtggagaagatgtcgacaaccctgtcttctaggttcaaacatcatgtcatggaggtaaagggagaaggcgtgaggttaagggcctgcgaatctggcttatccaagaacctattaactgtagttcaatatttaccagcccttctgaagacatgtagaagaatgacaatgttcagactatcagtgtcaagattgtaaggagtctgcctgagtcatgggttaaatggtgcccatgaatattttattgaactgtttcctaattgtttacaagctggacatttttgtcagccatacacagcagtgttgtgtgctacccagaagttctgactcatcaacactttgtcgggttagcagagagcaggctgcacttgccatctcgaacccagagttctttctgtgctgtattattttgagatttggtccagagaaaaatgatggatcaaggcagaaaagcaggtaacgggctgtccccagatgcgcacattaaaaggcaaagagctatcgaaatgtcacaaactttcgttacagcccatcattggagagcttttccagccgagagcatccaccttgacatcctcccctccccagctccatcaggcacgaagaggctcctgctgacagacattagggacacgaagcaaactgacacagtggattaatcctggtgtctggggagcagttaggacgtgtcatgtcaataggtgtctgggcaccttttagaccaggccttaatggcccagcctggccctaatcgtccctcacatgccacggttctgctctttcatctttgctgtgtgtgtcccatgaagtctcattttaaacaaggcagcaaggcacagtgaccaccgcagaaatccacttccctcgaggccttgccacagatgccagcagcgccaccagcccccatccccaaaggaaaacacaaccaaacagtcattaaaacgaagaaaaccacgaccatggtaaatttgtcagtgttggcggagaagataatgatactgaaaatagcctgaaactctttgtcagatggcttgcatttttggtcacaggagaacgttttctatgtgacacgtgtaagtgacctgtgggaccttgtcatcagtgaggtcagagcactcactgatgctgaaatttggggggttccccaggctgccctcatcgttcttgcaacatggctgccagggtagtcggtgtgaaggatggggtaggctcaccctggatgtgaaggatggggtaggctcactcggagtgtgaaggatggggtaggctcaccctgggtgtgaaggcatggggtaggctcaccctgggtgtgaaggatggggtaggctcaccctggatgtgaaggatggggtaggctcaccctgggtgtgaaggatggggtaggctcaccctgggtgtgaaggcgtggggtaggctcaccctgggtgtgaaggatggggtaggctcaccctgggtgtttgcacctgcgtccttgctgcttccaggtccctgggacatggcctgtggtctgcactgcttgggtggtccgtggaacgttttgctcacaatgttcataagaagtaatacaaaatagtatccttctcccgcaagggtagggccgggagaactgggagaacaagaggctattggcacctgccaggtggaaagcaggtggacaactcaacagagggtctgtctgttggcacccagcggtgtcgaactggttatgtaaaagagaaagaaaaaggatactaagtctcttgaatgaaactgggccccatcacacgactctctcataagcccagcacagctcaccagggcctctcttgaccagaggcttctgcagaattccatcagaatggaggctcacacctgccagttggctctatggctaaaggtcataataatagaacatctcttatacctgatattttttagatcttctgaatcacattttacaaaaacaacttagcaattttgattcaaaattcagatgctttatttttcttgtaattttcctgcacacacacacacatacacagccatcaaactaatacttcacacacacacacgcacactgccatcacactaatacaacacacacacacacacgcacactgccatcaaactaatacttcatatccactgtaagcttatctttaattttggggctgaattttggggctggaagtactaatgaggaagggactgttcccaccctctggcaaggccaccattctggaacctgatgacaaatgcatgacagatgctgaatatcctcctgtcttgattgcctaaagacttgcttttcactatcagcatgttttcatatctggttttcagaacataaatgtattcacaattcaacattttagtttattcatttaaagcattaaaaatgtttctcagagtatgcatggtcgagaagggcatattattaaagcaaaaatcatccactccattcccttgtcctacccatagtcccagagaccaccacctttcagcgtttctgcattttgtgttcctagtggctagcatcctcagtctacatggcatcctgacatctctatgtctatattcaactcaggctctgttgacgccttgccatgaaacacaaggctttagctgacttacactacatcttcccctaaattttcacagttacattgttatttttagttttctgttgtttgcctttccaacttgcaatctcttatctatcacttcttgttctattgttttcagataatagatcagtttctcttagccataccttaacttttatactgtcagagttgatcattttatatactgtcttataaacataaggttttcatgttttgtccaccagttgattctaaaaatatattaaaaaaataaacactgtgtacataattatgactttgtaaatattgttccttcaaagtcaatcagtatgttaggattttatttatttttctctaggtccagtatcattaaccataagtgacatgaaaggttaattattaaattcatgtcacatctttatttcctttatatttagacacagacataaatctcctaaatagctttttgtttttcttgggattttaagttgcactacttgtgtttttgtcagatcctcagaattaccaaacctcttaatcatactgtttcttgaagctttttgctggactatattttgcagtaatagaaaggaaagggtgctttggaggcaaattctctgagtacttgtaaaactaaaactcctgctcacgtgcttaacgattttctacgtatggaattctgggttttaaatcatatttcccagaattttttttcttcttagtattcaatgttcctgacaagatgtctgaggtcagtattatttttggtcttttgagaatgacttttcttgtttcctggaagcttttaggaatttctctttatgttcaacgttctaaaatatcttgagtctgtgtcagggcataagtcttttgttctttattctacttggaacttggagcatcttttagtctagagataattatctttcttcatttctggaaaactttgttctatcatgtctctattcttttaattttaataaagtgtacatttatataatttaaaaaattaaacagttctataaatctgcaagtgatattagcagttctcctcccactctctggaagccatgactttcaatgcttttagttttgttgtatttgcctccaaatttctaaatagcaggtttaaattcctgtttattaatatttttagttttaaatatagtatgcttacttcaggcaatggacaataagggtttagctttctactctactcccacacccttaaatatatttcttttccatcccattcctctaatagagtggcacaattatagggcaaatcatatttagcatttattttattaggcccatggaaatacgatttgaggctgtagctatatgcattctaatttcctttattttctgatatggttttcgttttcactggagtcaacctttatcccatttgtttggtttcactatgtacctatcacaaatccatctccaaattcctcaacagaaaaaagtctccttcctgagaaaaaaaaaaaagcaggaacaatttttaaaagttgagacattgcattctgaaaacgcccagtagtctttattctagcccaagagcacgttactactttggctgaggatatagaattctaatttggaaatcattttcaataagaatgttgaaggccttgctctattatttagtgttcaccattgccgtagagatgcctaacgcagaactaattctagacctttgtatgcgacttgttctttctttcaaagagcattagtaccttctctttgttcccaatgtttcgaaacttcgtgtgaatgtgctttgtgtggctttgttttcattcattgtgctgagcacttggtgaacctctcagcctagaaattgatgtctttgggatccaggaactttttcttgaattgtttctttggtgaattgctcccttccattttttttctctgtgtttgaaagccctgttatttaagatgtatttcctgtttagtctaattttcttgctttttagcttatattttccatttctttgttgtaatcatttttattacttggaaatttcctcaagtttctatgtttctactaaatttttcttttctgcttttggattttaaaattccaaaatcatttttgttttctaaatgtccctttctacaacaatactccccttttcagcctcactgatgtatactaatatgttactctccacatttaactccccacaaaactttgctaagttttgacatattatatatatgtatatttatatattcccataaaaccatccctataatcagtgtaagcatattcatcatcccccaaagttttcttatgtgttttcataatccctctcacatcttcttccccaccccatcccccaccatcctatcctcaaataaccactgatttgctttctttcattgcagattagtttgcattttctagactttatataaatggaatcatatactatgtactctttattatttgacttctttcactgtgcctaataagtttgaaattatccatgctctacatatcaacatttcattcctttttattcctacatgatatttcactgtatattgtgtataccacgatttgtttaatccattcacttgttgattggcatttgagttgtttccagttttagactattacacataaagctgccatgaacatttgttcacaagagcttgtgtggacatatgttttcatttctcttgggtaaataccaagagtacaacggttatagcctatgataggtgtgtgtttgactttttaagaaattgcctatgttaattatctaatgctacataagcaattatccccaaaactccccagcttaaaataacacacatgcattatctcagaatttctgtggttcaggaatccaggcatagtttagcttagtaccgttaaggcattaggcagccctgaggtttgatctgaagactcaactgagcagagatctactttcaaagtcactcatgtggttgttggcaggattgagttccttgagggttgctgggctgagagccctagttctttctgtctgttggctggagacatccctcagttcctttccatgtaggcctctccaatacggtgacttgcttcgtgaaagctaggaggagagagtctgttaacaagacagaagtcacagtcttttgtaacctagacatggaagtgccatcccttcaatgttgttgtattacattggttaggagaaagttactcacggagaggggttacacaaagccatgaatactaggcactggggtcattgggagtcaagtcagaagacacctcccacactgccaacagttccccaaagtggttgcatcatttacactcccgccagaagctttccagatttccagttgctcttatcctcactgacattttgagtcatcagactatttaattttaatcattctaaaaagtgcatagtggtatctaatagggattttagcttgcatttccctaatgacgaatgatattgaacatatttttatgtgcttattttttttttctgtaacctccgcctcctggattcaagcaattctcatgcctcagtccccctgagtagctgagactacaggcacgcaccaccacacctggctaatttttatatttttagtagtagagatggggttttgccatgttggccaggctggctcaaactcctgggctcaagtgatctgcccacctctgcttcccaaagtgttgggattacaggcgtgagccatagcgcctggcctgaatattttctttggtggtctgtttaaagcctttgcccattaaaaaaaaaaaaaaaaaatatatatatatatatatatatatatacacatatatatatttatatatatatacacatatatatgtgtgtgtgtgtgtatatatatatatatataggtgggctgggcacagtggctcaggcctgtaatcccagcactttggaaggtcaagatgggaggatcgtttgggcccaggagttggagacccagactgagcaacagagtgagaccccatctctactaaaaataaaaaattagccaggtgtcatggtgcatgcctgtggtcccagctactccaggggctgaggtgggaggatcccttgagcctgagagattgaggctgcaatgagctgagattgcactactgcatcccagcctgagtgacaaagcaagacccagtctcaaataaataaataaataaataaataaataaataagtaaacaaataaataaaatgggtgggttgattattatcacattttgaaactgctttatatattctggatccaagcctttatcagatatgaatttgcaaatactttctccaagtctgtgccttgtatattctttcaacaacatcttttgaagaaaagttaagaacttttcttcaaaaaaaaaaaaaaaaccagaaaagtttaaaagtttaacattaacgcagtgcaaactatcaggttttttcttgtctgaattgtgctttcaatgccacagctgagaaatctttgcctgactcaagctcacaaaaattttctctgttttcttcatctagaagatttgcggttttatatttagatctatgatccaatatgaaccaacaatcaaggttcattattttttcacgtgtgtgtatccactgtttctatgaagtttgttgaatttttccctttgaataaccttggcacctttgtcaaaaatcagttgcccttataggcatgaatttatgtctggactctactctctgccattaatctgcttgtttgtcttcacgccaggaaccaaattgcttaattactggagctgtatagtaagttttaaaattgggtagggaaagtcctcacatttgttcttttcttccaaaatatgtttggctatactaggtcctttgcacttccgtataaatttcagaaatagcttatcaatttctacaaaacactctgctgggattttgattattttgatgctaaatgtatacatcagcttggggagaagtatcatcgtaataatattgagtcttctgattcatgaacatggcatgtctctccattgatttagatcttctttaatttctttctgcaatgttttgttgtttctagtggaaaggtcttatgcacctttggttagattttcccctaagtattttgtatttttcatgctattgtaaatggtattatttttaaaaatttcaatttttaattattaattgctaatgtatagaaacgcatttgagtttctgctgtgtgctaatcttatatcttacaaacttgttgtacttacttcttagttctagtagtttattttgtaggttctctcaggattttctacatagacgatcatgtctgcaaatgaagacagtttttcttctttatttccatttggatacaacttttcttcctttttcccatctatctttttcttgctttatttaatggtctagaactttcaggacaaggctgaataaaagaagcacagaagcttctattcacacagaagaagacaccctagtgtgcttctaatcttagaagaaaagcattcaagtttttttttcattcaaaagatcatttttattagaggtacaaagtcgtaatcataaaagaaatcttgtgagggagtggtgactttatttgatacaacacaatgtactgaaacatggttgctgcttttccttttttaaaaaaatagacttattttttaggaagtttttggttcacagacaaaattgagcagaaaatatagagactacccatatacctgcccccacaccacacacagtctcctccattatcaacagcccccaccatggtggtacatttgtcacaatccatgaacctgcattgacacatcattatcaccgaaagtccatagtttacattaggattcacccctgtacattctgtgggcttagacatgtgtatgatgacgtgtatctatcattataaaatcatacagagtagcttcaccatcctaaaaatcctcttttctcatattcgtccctctctccccgaactgctggcaaccactgatctttttgacggtctccatagttttgctttttccagaatgtcatatatttagaatcatacagtatgcagcttttccagatcgtcttctttcacttggtaacatgcatccaagtttccttcggtcaggtgtggtggcttgcatctgtcatcccagctactcaggaggttgaggcaggagagtcacatgagaccaggagtttgagaccaggccaggcaacatagcaagaccccatttctaaataaataaataaataaataaataaataaataagattagctgggcatggcggcccgtgtctgtagttgcaactactcaggaggccgaggtgggaggactgcttgagcttaggaattcaaggctgcaaaaagccatgattgcaccactgcactccagtggggtgacagagtgagacgctgtcaaaaaaaaaaaaaaaaaaaaaagaggttctgatagcttggtaactcatttctttttagtgctgaataatattccattgtataatgtaccacagtttatttgtccattcacctaccgagggacgtcttggttgcttctaacttgggaattatgaataaagccgctatgaacttgtgcacaggtttttatatcagcataagtattttcagctcatttgagtacctgcccagaagtgaaattgctgaattatgtggtaagaatgtggttagtttgtaagaaactgccaaattaccttccaaaatggctgtaccgttttgcatttccaccagcagtgagcgaggtcctcttgctctgcatcctcggcagtgtttggtggcgtcagtgccctggatctgcgccactcttctaggtgtgcagtgctatcttcttgtggtttcgaacagtctgttttcaccatgaagtatgatgttctagtttgctgagagtttttatcaggaattaaagtcggattttgttaaatacttttcctacatctatggagatggtcaagtgatttttcttttgtagtttgctaatatgattaattctttttctttttctttctttttttttttttttgagacagggtctcactctgtctcccagactggagtgcagcgctgtgatcatggctcactgcagccttgacctcccaggttcaagcaatcatttcacctcagcctcctgagtagctgggactacaggcacaagcctccacacccagtcaattttttttttttttaatttttggtagagacgaggtgtcgctatgttgccaaggctggtctcaaactcctaggctcaagtgatcctaccacctcagcctcccaaagtgctggaattacaggcttgagccactgtccctggccacatcaattgattttcaaatgttaaaccaatcttgcatttctgggttaaaccctacttggtaatgaagtattttcactctatttcttgttagattcagcttgttaagtttcattaagaaattttgcatctatgctcatgacaggtatttgcttgtctttttctgattttggtaacagggtaatcctggctccatagaatgagttggtattctgtcctctttgatttcctgaaagagtttgtgtggagctggtattatttattccctaaaatgtatggtagaattcactaggaaagtcatgtagagctggagttttctttcaggaaaggtttttacttgcaaattttattttttaatagatataggcctattcagatttttttattgtgataagatattcttaacacaaaattaccatttaagtgtataattcagtgacattaagtacattcacaatgttcattaccactattcccagaacttaaaaaaattattccaaacagaaattctgtattcattaaacaatatctccctcctcccagcccctagtgacctctgttcctctgtataaatttgtctattctaggtacctcatataattggaaccataccatatttgtccttttgtgtctggcttacttagcataaagttttcaaggtttatccacgttgcggcatgtatccaaactttattcctttttatggatcttgatttctttttgggtgagctttgatagcttgtgtcattcaagaaatctgtctaagttgctgaatttattggcataatgttatctataatattttcttatcttccttttcatatctgtagagtctgtaatgatgtcacatctcattcttgttgatagtttgtatcttctctcttttttctgattttcctgtcaagaagcttatcaattttaatgattttatcaaatagtaaagttggtttccttgatttttatattgtatttctgttttctattttatttatttatactcttaccttgtttcctttcttctgctttaagtttaatagtttaatttgctcctattttttcttatgttagaaactgaagttgcatatataaaacctttctttttttctaatatgagcctgtaggactatatattttcctctgcatactgctttagctgcatcccacgcattttggtaggctgaattttcattttgatttagttctctttcgatttagttctcttttgatttctttctgatccatgaattatttttaaacgtattacttaaattccaaatatttggggggatattcagatacttttgcaatactaacctttaatttacttccactgtggtcagagaacacttttttaatttcaagttttaattgacagattatagttgtatatatttatgggagaaaaagtggtgttattatcttttaatacaatgtgaaaagattaaattaagctagttaacatatccatcaactcaaatatttgatgtttttgtgataaaaacattagaaatgtactttcttagtgatattaaaatgtacaggacttaattatgggctatgtttcctatgctgtacaattgtttctatacacacaaatcaaatgtatttttcctgtctaactgaggctttgtaccttttgactattatcttcctattgcccccataccccaggctctgataaccaccatcctactaccttctatagttcaattgttttaaattccacatataagtaagcacatgtgacatttgtctttctgtgtttggcttacttagcataatgttttctgattctatccctgttatctcaaatgacagaatttcttcctttttaaaggttgaatagcattccattgtgtgtttctaccacatttttaaaaatccattcacctcctgatggacacttaagttcattccataacttggctattgtgaatagtgctgcaatgagcataggagggcaaacatgtcttcaacatactgatttcaaatctttcaggtaaatacccagacataggattgctaaatcatatgttaattctatttttagttttttgaggcacctctgaactgttttacctaattactgtataacttacattcccaccaacatgtacaagggttcccttttctccatgtccctgccaacacttttttgtctttttttttgagatggagtcttgctctgtcacctaggctggagtgcagtggcgtgatcttggctcactgtaacctctgcctcctggattcaagtgattctcctgcctcagcctcccatgtagctgggactacaggcatgtgccaccatgtccggctaattttttgtatttttagtggaggcggggtttcactgtgttagccgggatggtctcgatctcctgaccttgtgatccacctgccttgacctcccaaagtgctgggattgcaggtatgagccatcatgcccagccttttttgtctttttgataatagccattctaacaggtatgaggtaatagctcataaaggtgtatacctaatttattaagagtttttatcatgaaattacactgtgtttttctgaatgctttttctgcatctagtgagatgatcatatgatttttgtcctttattttgttaatatggtgtataacatttattgatttgcataagttgaaccatccttgcattccagaaataaattctacttgattgtggtaaatgaaccttttaatgtgttatttaattctgtttgctgcaactttgttgaggatttttgcaactatgttcactgaggatattggcctgtaattttcttttcttgtgatgtccttctctggtttggtatcaaagtaatggtgcccccataaaaagaatttgtaagtattctttcttcttaattttttggactagaaatcaataccaaaatagattttggaaatttcacaggtacatgaaaattggacaacatggtcctgaacaactaatgggtcaatgaagaacttaaaagggaaatttagaaatatcttaagcaaatgaaaatggaaacacaatataccaaaacttatgcgatgcagcatatgcagttctaagaggaaagtttttagcaataaatgcctacaccaaaaaagaaaaaatgtttgcaaattaaaaacttcatgttacacttcaagcaaatagaaaaagagcaaactaagcccaagattagaagaaagaaataatagagattagagcagaagtacataaaatagagactagaaaaccaaaaccaaagatcaacgaaatagttgttttttctcaaaaaaagataaacaattgacaaacctttagccagactaatcaagagaaaaagagaaaaactcaaatgaataaaatcagaaataaaagaagagacatcataactgacaccacagaaatacaaaagatcatgagactattatgaataattatatgccaaaaagtcacatacgctagaagaaatttataaatggataaattcctagacatgtacaacctaccaagactgaatcacaaagaaatagaaaatctgaacagactgatagtgagagaggagattaaagcagtaataaaaagtctctcaacaaagaaaagtccaggacctaatagcatcactgctgaattctaccaaacatttaataaagtactaaccaagcctgtaatcccagcactttgggatgccaaggtgggtggatcacctgaggtcaggagttcgagaccagcctggccaacatgggaaaccctgtctctactaaaaataccaaaattggctgggcgtggtggtacacacctgtagtcccagtactcaggaggctgaggcagaagaatcgcttgaacccagaaggcagaggttgcagtgagctgagattgtgccattgcactccaggcttggtgacagagcaaaactctgtctcaaaaaaaaaaaaaaaaaaaaagaaaagaagaaaaggactaacaccaattctccacaaactattccagataacatactttatttgatttaaatccttatacatttatagacggttttttttttctgctgagaatatagtctatcttagtaaatgctccatatgcactgcaaaagaacgtattcttatgttgttaggtaggatgttctataaatatcaattagatcatgttggttgaaagtattttgtaagtcttctgtatcttcactgatttttctatttatttgttctacagattattgagaataaaatgttgaaatctctaactacaatttggacttgctcatttctccttatagttctattcactcttgtttcatgtattttgaaactctgctatgatgtgcataaatgtttaggtttgtttcatatgttcttggtaaattgcctcttttatctttatgaaatttcccgatttacctctgctaatatcatttgctctgaaatttcatacctgttagcacctgctgctttctttgaatgagtgctcaaatagtatatatttttaaatctattttatgccttttctcaactcttattttaaacctgtttgtatctttgtattttaatgggtttattgtagcagatcccgggaggtctacctatttcttcttcagattttcagtcaatcttcctcttttgagcctcactcaaccccttcggtttcagttaactaacgcttccaacttttagggctcttccgtttttggattttcctcagagccagtgagagctccagctttcctggccctgttaacagtcaccactcatccgtctgcctcccagcttccaggtggatggtttcagactgtcctcccattctcattgtcgttacaagtttatcctctcattgccattttgctgaagtttttaaagggagcagtaaattgggcgttgtctttgccatgttaagccagaaggtagatttctttataaaaatctctgttttgtctttgataatagctttctctccattttctgcctctgaaactgttagttgggtgttgccccctcttggagtaatcctttgggtctcttatgttttctctcctatttgtatctctttgtataaatgttcccttgattacctttctttcctatggggtcagctattctgtttaatattcttggtctttttctatcggatggctcacttttcccgtgtgcctggtggtcctttgtcctttgttcatatgtgaggatgaaggatcacactcacggtagctggcatgctgtgtgtcttccatgggcctcaccgttgaggtaataaaacatttgaatgggagctcatgtgtggtgttggcgcttgcacaccagtagactttgtaggattttaatggtcttgggagcatcctttgatattagaataggagtgcaccaacccctccactagaaccttggatttccgtggtgtgtgtccttagagagagccttctagcttgttgctttgtttgcctgggggtgaagatctgattgtcagtctctctgtgaagtagggaggggtttagggaagggactgcctggcacaagtgttttgttgacaaccttttattagaaccttctgtgtgatcccttcccttactgccagctctagcctgcagcctctccgagctctgtggggagaattggccactgctgtgcccccgctgctcgtgtctctgacctggcaccctgtccttggctctgccacatctgtaacccacaccgtctgcgttccacctccctgtgcccgtgccttgattgcatgtaaccccttcttcacctctccttcctgttttgggaggttatttcattctgtacttctttagtgggatttggaaggaaaaagaaaaatccatgtgtaaaatccaccatcttaaaccagaactctttttacccctagttttacaagcccttaagctcctgcagaatcaacccgtagttgtttttttcttaacctagagagacatctaagtaggagtcaacaggctttccaagttcttgagtcagccagtgccatgggtctgtgatgcacagactctatgtccactagtttatggcagtaatatagtcacctgggatggatctaaggccaaatttgctgtagcgagatctgtgactccaaaggattacaaatgctgaattattgcagtgtggacccaataagcaacctgaagctgcatcatggaattaaactgagttagagcctgagtatattgctccttgggtgattctatcctgcaaataatacattatccaaggtctggtgctggagacagattgctgcaatacgcatccaagggacctgttgctgcctgagagcagctccatcccatcatcccagtgctgctgttttattgatgccagagagtccccacaggtgatgcattacacaccgaggaggtggcccccagaggaaatgagggatctgcaagagaactctgtaataattattgcagagaagacagctaccatgctacatagaaaaggtctttttttttccccatgtcaactaggagagaatatagatactgacttttcttctcccaagttatttcttctgctttcgtaaaataagttcagatataaccaaagtaattcttcagatccaccctgcaattaaacaaaacaacttccttattttctgagtatctctaaacctccacagattcaaggacagataagcattaaagtgtcacaacctcctgaacatggtgctttcaaatttcctgtttcacaacgactgagaggtaatttgaagtgcaaaaatgtgagtgagaatatcaactccacaccttcagccattccgtcttcagctatttacagatacgttttaaaagcataccatttaaatatgaccagcaacttcctgttaaactttggatgtagcaaccaacgagaaatatggccctcggtggtaagagaggaaaaaatagtttctgtatacaaagccctaacataataaacaagcagaagcacttcctgataaatagcgccaagcaaacattcacatccttgcctctgctatattcaaaatgtttttactagaccaagtgcaaagtattattatcattaatattaagtttatccttcttgcaactgagccaggctccagttctacaggaaggtctggtaggaaccaagggtatggccgtttatcgtggcagatactttggttttaattcccttcatataaatgttgtaaaggcatggatggatagaaacattactgcatttggtgaaacccacgcccaacggccccaggcctgcagcaaccaccccacagaatgatcaacacggaaactccagagcagtaaacaggccaatttcagatccagcgacaatcccagcaggcggccaggggaagaaaagcaaggacgacagcaaagacagacgggtgcccacaggttccctgtagctaccgccacggagtgggaaccccagccagggcacagacagaggcagggcccctgtgaaaaggggcaaggactcaacttgcagggaagcactgccttgtgctacctttgttcactaacgtgaaatgctactctgagtgttccttatttttaaatcaaaaatttaaaaaccacacacacacacagaaacctttccatctattgacatattacatacagcatcatatgagtacagttcgacgaattttgacaaaccgagcccacccctgtaaatcgcacccagaccaagacagaagacatcagcagctcccaggaggcgtccctgtgccccactgccatcaacacctgcccccacgcccaccctccagggcaaccaccatctgaacatccttgtttacacgtcttcccggactggaattggaatcccagaaatcaagtggagtaaatgaagtgcaactttgtgccagtgtgtttgagttgcggctgctgggcctgcaggtgacaaggcgctgcttccccagagacctctttcagcattcccgtggtattaggagaaggcactgcagcagagcagagagaggagcaaggcagggctggggaaactgctcacatggagagatgtgggaggcagtgtctccacgagatgtcagggccctggaagaaaggagaccctgttggaggggccaggcaggacgaggggacactaaataccagtggcagccatagaatgatgtgtgtgaagtgccaccagccacagggctcagccatgcagctgggtggggtgggggtgtgtgagagggtcctgcttagatagcagcatcaccacccctaggagctgggcttggatctgatgagagtctgtttcctcccctagatgatgagccgttcccagggctggccactgaggatctgggtcacacaggccactgtcctccccacatgaagtttgcagtcaagttagaaagatgacaggtaatgaggtccacaccacacagctttggtgtggcacgtgtcaacacattcgccgacagaaccagtgcatgaatgaaagcttgagggcacagagcacctctcctgtcttgcctgaggtgtccccaggagcaagcctgacagccagctgggccaccctgtgagaccggggcccgctggagcctttccatgaggaagactgagccgagcgcctgcactaggaggagccacggtaccgccaggctcctgggcccgctgggggagtgggctgccaagcacccagtgagctgcggctgaaacaatgatgacattttgtcatctctgtcaacacaacaagaacttgggaggcaggcagtcccccgccatgcacagtgcccagtactgtcaccagagcctctcctttatccttctcctctgtcccatcagctgctggtggctcctccctccctggcagtcacaacacagccacctcgttctgtgcatcatggcctcaaactgctcctccctgctcatcagggagggaacagccaatgttccctgtgtctcattggccataaggtcacctgccctgcagggtgctgagacagggactctggtcacaggtggctgttggaaccctccctcctcagagcttcgcaggtcaaagggatgcgattagactctgtcaacacctctaagagctccactgtgcgcaacagagaacgagattccgtctcaaaagaaaaaaaaatcaatctatccaccatcataactttagtcaatatgcttattccgtcacctcttcatttgtcatccttcaacagtatctactgattctgcactattaaaaaatgagaatttccctcatttaccctcccccacctcctctcagtcacgattgttagttttcacattcgttagattcgcacctgtcaatatagacttgggcatttactgcttttccatccagctgagactgctgaatcttcagcacaccgtggaggcctctgaagccctgtcctgtcctccgtctcccctcccctcttccccttctcttcctccatcccgtgggtttttcttttgcagcaccaaggatggcatcatattctgtttgatgagcataattaagttttctgttctttgttaagttttatctgtgttgaaaacaagtcaacggcattcgcgtttttacaactttgtaagtaccattcatagcagccaagtggcttccttctctgtggttggtggctttcccggggccacaggagagaatgacttcagcgtcaaggctgaatgcattctgtctctcataaactttcttcttgctcaaaaccataacgtggccgggcgcggtggctcacgcctgtaatcccagcactttgggaggccgaggcgggcggatcatgaggtcagaagatggagaccatcctggctaacacggtgaaaccccgtctctactaaaaacacaaaaaattagccgggcgtggtggcaggtgcctgtagttccagctactcaggaggctgaggcaggagaattgcttgaacctgggaggtggaggttgcagtgagccaagatcatgccactgcactccagcctgggtgacagagcgagactccgtctcaaaacagaaaaccataacatatttttagttttttcatgattagactgtggctttcacagacaactttttgatatcccccccatgtttgatttacctttcatttttctcatggacgaagaataactgcctcttgattgcgcttctctgtcttgcaatctgtgctgtttatttatctgtggacatagcttctaacttgtcactccatactcccatttgtaactgccagggctggaagcctatgaactatattcccagcttctcctgatgcaagtttccggccaatgagaggcactggaggctggaaggctggatcatgggagaaagcatgtccccttctccagctccgggagcagctggcagctgagagtgactgcaatctgcagattggtggtgggtgtcacaatagtggcggagctgttgatgtttaggctccgtagcagcggccagagggtaactcctggtttctggatgaggggcaatcgtgctcatgagctctcgtagcttcactttccatttcattctccagttctatagggggtcagtgacctcctgtagctgctgctctctgagtgctatggaatgaatgtttgcgtccttccagatttttatgtcaaagccctgccccccaatgcaactgtatttggagacaaggcccttaaaggtaattaaagttaaatgaggctggatgtggtggctcatgcctgtaatcctagcactttatgaggccgaggcagaaggatcacctgaggtcaggggtctgagaccagcctggccaacatggcgaaaccccgtttctactaaaaatactaaaattagccagtcatgctggcacatgcttgtaatcccagctactcgggaggctaaggcaggagaatcgcttgaatccaggaggccgaggttgcagtgagccaagatcacgccactgcactgcagcctgggtgacagagtgagactccgtctcaaaaaaaaaaaaaaaaaaaaaaattaaatgaggtttaaggatggggcccagtctggtagtttgttcaatttcttttcaaaagagcattgtttttgtttttgtttttgttttttggcatgaggttgtaatcgctgtgtgcctggggtcgggaggctgactgacaaggcagcttcctccacagacttccagcaacagtcctgccctggctgcgctcctctcccccaggcctccaggccaccagcttgcagcctgtgctcctctggggagggatcccccgctcccccactcccagcctcgccctgacagtgatccgagttgcggattttggctttctcctccatcctcacccgtccaattgccctccagctcacagaatcattttctcaaaattttcaactgctaatgaccctgtcaccaggccacctggcagggaagcccacttgtcccctaccaataggcccatggtgtcttggaggctttcctggtctcctgggacaagacagctgcccggcttgtagccaggactgtgcctgtagcccacctgctgtaaggtcacgcctgcaggccctgagttttaccggcaagatctaagtcagttctctaccaacaccctaaggcaggtactactactttctccgtttagaactggggagagtgagatgcagagagcccctcccccgaccctaggcagagcccgagactcgccgcaggctcatgcactgtgccacctgccctcctgaggccacgctcttctcacgggaggtggccctgtggcctcacctgggccggatgggaattgcaaacttgaaaccactacgtctttttccctgtttttattttaaaaaggatattaaacgaacatatcttttaaaaattaaagtgaattgaagttcattttcattttatcctgagaggttcacagtagctcttgaaataaatgaaagtgactttaaacgggctttgttttgaggtgatctcagcagctctgaggatacgcacagcagtcttggagtctcacaaaactcggctggaaatctctggccccagagggaggaagatgcttctctatttctacctgaggccttccttaggctcctggtcaggaagggagaagagaccccgggcaaggggtgagaagtgggggtgggggagtcttgccccttcctctggacgacagagcccattactagagggaatttcaatggtgtttccaaccccaggtctcacccaggaaggaggaatctaaacaaactcagctgccagtggctcccccatagcgacagtttgaggccggattcactgaagttttcacagatgagtctaggtaaagttgtgggggtttttgctgttgttttgttttgttttgtttctttgagacagggtctcagtctgtcgcccaggctggagtgcagttgagtgatcttggctcactgcagactccaactcctggattcaagtgattctcctgcctcagccacccaaggtgtgagccaccatgcccagctaatttttgtatttttagtagagacagggttttgccatgttgcccaggctggccttgaactcctgagcacaagcgatccgcccacctcagcctcacaaagtgctgggattacaggcatgagccaccgtgcccagccaaagttgtggttttaagcaggatgttccaaagtccagtggttatgaccaaacgccacacagagacagaagcctcccgcacagccccaactcccagcagccatggtgttccaggtcctccaaagtcagcttctcctccaggaggccactgagctccccagctgcggggctgaggccacacagccctgtgcggttcatctgccatccgggcccttcttcctcttctgagcttcacagttagcccagggaagaaaacaggcgtgtcttccacaaaccctgaagggaatgggaagtgccaacagtgagaaggacttagatgtaaaggatttacacacggtcacggcatttccacaaccctctgggcacctgagtacacgtgtgcagacacacccccagatgggggcgaggggtggggtgccccagctattcacacctaaccatgagcgtgtgaggcagcaacacttaaaggccacttgctttccgcagcatctcgatggagcaggagcctgcctggggcatctccaggcagcttggctgagcacccaggactgagtgcaaccctcagcgtttacattttttagtactattcactaagagagagagagacagagagacagtgatagagacagggaaggacagagacaaagagagcaatgggtgaagaaagagcaagcaagcagggatgtcggacatttcacacaacgcagtcaccagggaggcaagaacacttacagaacagtttgagccaaagagtcactcagggacaggaacagcaatttcttaaatatttaaagcagacaccctgtgagcggctgtggaggcggctctttgttaatatttaacacgagctgggcagttgccgggaaaacagctgtttacaggagagattaaccaatattcatcattgctcaaagctgtggggaggcttcaggggacaggcagctgccggtatttctagaatacagcagctcaaggccacagggctggggaggctcacggtgtccccagggtgcatgaaaactgtaaacaggcagttcggggtcacctaccctgctccagaatcacggtttgcaggaaacccagccctgcagctgggcctgggtggtggctgctggccggccagccagcacctcgctggacagctgcgtcccacagtcccaggctgggctgtccttcaggcccatccacagtcccaggcagactcctcgtgcactccctgcatgaagtcgggggcaggtgctcgaaagtagaggggttcccactgatggaaagtgtcaccagcctgcctgcgaatcccccagctcacacttgggcttgcagggacaccagccaggccgtcttgcagagaagacaagctgcctattttcaggggctatgagtcttgttcatgacagttttctcctctatgtgccaaacattcaagagcctggccattttcacacagccccatagcctgggtgaatcaggcctcactcccctgtacttccttccaaacattctatcactcccaacaccctccacccaggcctcatggaactacacacagatcacgcttgggcccaactggatgcggaatcccagctcaggaccaaggaatgctgctgctgtctccacaatgccctagacctgcaaccctgggcgcttcctggcataccactgcccactctgcccacaccacagctgactgactcctaatggctcttcaaacagttgtttgcacacctgaccatttattataaaggaagaagcgccgaacagcacgtgctgctctgaggaatctgtacaagaattggggctctgcgtattaatctttgctaaaatgaatttagtttgggtatttaggtttcacagcataaatatatttttctctactctgagaccaattggcacaggctgtctaaggcattagaagaacagtccttaatctttctgtgttcacagcatagttctgaataccagaaatctagaggaatgcttgaagaggtttttaaaaaattaaacaacattaaaggagtcagcaatgatttccatctcagcaaaacaggggccctcagggtccagaaacatccatggccattgagcagtcacttggtcattcttgtggatgctttttttgagatggagtcttgctctgccacccaggctggagtgcagtggcgtgatctcggctcactgcaacccctgcctcccaggttcaagtgagtctcccgcttcagcctcccaagtagctgggattacaggcattagccaccacgcctggttaatttttgtatgtttagtggagatggggtttcactatgttggcgaggctggtcacgaactcctgacctcaagtgatccacccgcctcggcctcccgaagtgctgggattacgggcgtgagccaccacgcctggccttctggatgctttttattttgtggttatgcagcatcaggacagccttttaacatttgagaagtgaaccgtcttagtgggaggcaaaaccctgcttccctctacagaagcctaaaaggccaagaacgtgcactccctgacaccggtggggggtagcagggctgtgcagccacatgcccaggaggcacggagacttcagggtccgtccccccattcccaggtggcagagcagtgccccagtgtcctgggtgcgaagagcagtggctagtgcatgctcagcaccagcagtgtcctagccacatgtcttggggctatagctgtggccacttggcacctccaggttcctgacccttccccacagtgactcagcagggagttgtctgtgagccacttgatacccttttacaatattccctttctgatgattaaccagaagtgctttgcaggcgggaagcctggtgcgcacagtcagggtctgccctgtgctgctgcttgaggactgtctcctgccctgacggtgctcttcaaagctgccgcgggcctgcttgatgtaatgctcacttctgacctctttgcccatgcaaggcacaccctgccctgccgtccctcccacccccttcctccttggcattctgatggactcagtggtccccaaaattgcacacatcaattaaaccagcagcacactcatggagggcgggtggcgccctgggtgctgctgtgtgccagctgtcaatcaccgtgggctggaatgtggattacaagcctggaaggggtatcgcgcactcagggtttagccacagtatacaaacggcttttccacctttcctgtcctgaaggccacagcagggcctgctctgctccctgcggcagtggtcctcatgcttggccaggtgactaggcatactcgcagttactgcagggccactgtgtccccggctgagcctcgtgccacagagaattggtcagagaagaaggcggcttagagagggtccggttggcctgcaagcctgagcccctgcccaggtggagattaaatccttgttacctgatggtattgacgcttaaaattaaaactgagttcagttactgaaaatagagaaagggccacttctatgctcctgagatcggaagtgaggtttatccccccggggatctgaaggatcatccactgggcttccctaaagcggcattgtgtcatttctcccggctaggagaggtctccccattctcaattcccgtcacttattctcactcaacagaacctctcagagcacctaccgtgtgcatgagcccagtgtcgatgggccacgggccagccagcctgggacgcgtgtccagggcagctgggatttggactctactccacgaggccacacaggggaaggggaagcccagacggctgtcagggcattcttgggagccgggggtttggaagggctgttgggcgtgctggggcaccggctaggctgtggggtggtgactctcctgcagccttggggggctaccctgagatcatctgtcaccccactgcttgctgctcactcctgatcccgcattctggctgtgggcagagagcactgcctgccacatgctgcgacccgtggccccttcgccagtttaattttcttttgtgcccgttcccccctcagcgttctagtattttaatgtgtgtccttttatttgcttgtgtcccagtataagacacactattctattttggtttctaaaattatttctttactagattgaacctttttaattttatttttattgtggtaaaatatatgtaacataaaatttaccattttaaatattttcatatgtacagttcagtggcattaagtatattcacactgttgtacaaccgtcactgctatccaccttcagagctttttcatcttctcagtctgaaactttgttgccattaaacactaactcctcatcccacctctgctcaacccctgaaagccatcttccttcctttctttttctttccttctttctttctctttctctttctttctttctttttctttcgccctccctcccttcctcccttccttccttccttccttcccttcccttcccttcccttcccttccttccttcctttctctttctttctttccttttttttgagacggagtttcgctcttgttgcccaggctggagtgcaatggtgcggtctcagctcactgcaacctccacctcctagcttcaagcaattctcctgcctcagcctcccaagtagctgggattacaggcacccacccccaggcccagctaatttttgtattctttttagtagagacggggtttcaccatgttggtcaggctggtctcgaactcctgacctcaggtgatcccccggccttggcctcccgaagtgctgggattacaggggtgagccaccgtgcccggcccccaccattctactttctgtcccaataattttgacaactccaggcacctcacatacgtggaatcacagagtatttgtccttttgtgcctggcttatttcactcagcataaggtcctcaaggtctgtccctgttgtagcacctgtcagaatctccttccttttcgaggctgagtcatcttcccttgcctgcgtagaccacgttttgcttatccacttattccttgtcactcagtactgtttggtactcttgacctacataaggactatttcactcttggcctcgatgggtttctatgttcactcagcaccagaacctcatagtagtttcctgcctctgtgcacatctgggccgttgcttctaatggggacctggcgtcccgggggtcctctgcacctgacttcccctcttacccgtgacacaggcccccagcctgggacgctcctgccgcaagcctcagtgtgcaggtctcgtttatcattatctgtgtttccgcattttatgtttcccacccttcttgcttccatttggctctgttacggttcctctgtctgctttccattattaatactgccccttagctgagaatacctatgacacttagtatagattccgatgggtgactgtggctcagtgtgttttctccctgggagagagaagtgccccggggcctgcatttgccttgatcttaggtgcatgtcctcctggggacaggtaatggggaaggtgctgaagctcaggcccggggtgtctgtggcccccatgaagggggttatgagatgggagatgagccctgagaccatgaggttgcttctgttgccagcactttccctaactcacagttgtaggtggccctgagaagaggtgggtttttcaggttgcagagcccaccagccctggggagcagagggggcagccaggaggggtgcccgaggaaggctgataggaatgtacccagcctctacccatgcacgcctgggactggaccctcaccaacacaaggcggctgggctgggattgctgctatcccagaggaatggaataaagtggggtggacacaggagcaggacttccaagctctccccaccactgctccctgccctggccctggggctgctcccacccacacccctcacgggtcccagtggcctcaggcttccccggggctctgtggtttcatgctccctctccccaaggtgtctccagggtcgagccgggcaggggtgcagcccatgctctcactgaagcccgtggctcttccggtacctccacggagtctgacccgatttcaagcccttggtggatgctgacgggacccctgtggactacctgtattttctcttcatccaaatgttggtggaaggaaggaaagaaggaaggaagcaaggactccccattgagcccacctttagcactcctgggagggccttccctacactgggcctcttcatctcctcattcccggctctgtcctcttctgaaaactaatttcctccatcagttcccacctacctggccaggcaaaggacagctggacctgggtaaagtcccctaacatgagtctgcttaaatggagagcaaatttcacagtcaatagtgaaaaaaaaacacaaaacacagggtttgactggaacctacgtaaaaaatgaagcacatttgtgtaaattatttatatattatatatcaatatattgtgaaaaattgtatttaaataaattacttgatatgcaaccctgagccaatttttagaatgaaagaggaaaggaagctattattaattagtttttttggcataattgtatatgcgcttacaaaattaatagcaaatagttaacaccacttactgtgtgccaggcaccatggatgtgtatctacactcatctaatgctcacagcactcaccgagacagatcccatttctatctccatttcacaggtgacaaagctgaagcacagagagcttctgtgcattaccaggtcacgcagccagtgttaggagggctggggtctgaacgcgtacccccctgggctctgctgtgtcctttaagtttctgacttcggcatccgatcatgaatagggtcatctcacaaaaccctgaaggcctcgtggcttttccccaggccctctctgacgctgtcttggaagctgctcccttcgaaagtgcgcactgggccaggcgtcatctttctcacttctctcctctttggctgtaactgacctgcctcctggacttgcttttcgtgtgtgaccccagcagctctgcccaccctgcgctttgcttttcaatggattcacccaggttacactgtgttcttccatgcatgagatccaggagtcatctactacagatcagctctgatgctgagtgacgggcagggcgagaggctggagatgctggagcgggactgactgtataggtcgtttacttcctcactgagccggctttgtgtccgctctgatcagggccccggggaggtagcagtagacaagacagccacagccccccgtttccatggagaggacattctgttaccttcgaacagagggacacacacacacagataagaagggaaacaaagcaggtaaagagtataggaagtgcccggggtgggctgaggggttgcaatttacatagttgggccagagaagacatctgcaagatggagaaatccgagtaaacattgaagaaacccaggaagggggaccccgagggaacagccaggccctggagtcggggtgaggggaggaagagccgaagctgggagcagaggagccgaaggcgagggcactggggtgacagggccggatctcgcagccttgccgcagcctcaacactggctttgtctcgtatgggacagggagctggcggagggtagggccttcaaacagcaaagggacatgtggcttgtacgtgaaagagccaccctttccgcgtgttgaggcaagactgcaggggcacatgtgcatgcagggaggtgaggccaggcgcttgcgatgttccaggcgggaggtggtgaccacagggcccagggtggtggcaatcatgggggcaatagtggccccatggagggcgcacttccgtgtcctaaagtaatggtgtggaaggaggggagtcaagaagacgcaaatgcatggtgcgtgcgacggaactgccattctccggggtgggcgagacaaggtggagcaggggccagagacccgagaggcccaggtgtgcaggacaggccagtgggaaacgcgtgtagggttgtttgcacagatggtctttcaggccaggagaattctcggctcatgggtagagggagtgttgattatatgggaagtggctcccatggagtccccggtggtcaatggggagaggaggagggagagaccagcagccagtggagcccaaggcaggcagagacaaggatgaggaccagaccggtgctgggtggggcagcctgggggcgagtgctggccttggcagagccgctgggaggtgtgggggtgaaagccaggctgctttttacagagaaaggaagaagaggacttggagacagcaggatagacagcctatcatggaattttccggaaagggaaagagagagatagggcagtaactggggggattggtagggagtgactcaagggaggatttcttgtttgatgtttgtcttttaagacatgaaaagagagaaataaccatgtgtttctagccgatggccgtggcccaggggaaggtcaggagttgctgggcctgtggaggggtgtcctccagaagcaggatctggggccaggaggagccgctggtcttgtggggcggggggcgggggtggacggcgcaacccagacacagaaggaagggcagagcctcggggcccacaggcagcactgggggtgtggggacttctcccatggcctctgctttcccagggcagagaggggaaggctcatcagcagagagagaggaggaggcaggaggggacacggcccgaaccccaagcagcttgctcactctgtgggatgtgttgccaccgccatgctctcttttcacaagaaggtgtcccaggtggaccctagaccaggcgtggttggtggaagtcaccggaggggcctcacggtgaccctggagaagggatggcctggagtccacagcctcccctggcactggaaggtcccatggaacagcctcctgctaggtgggcccaaggccagcccagagctgtgggagcagcgtggggacagacccggggaaggtggcagagaaagaaccccagtcgggtggtgggtggtccccagctcagcgctgtcctggggccagtgattcggcctccgggccccagcttcattgtctgggtcttcctggcagggcagtggcgaggagttctacgagctaacgggagtggaatgcctgccctttctcatctccctgacgtgaatcagtttctccaagttcttcacctaacagagcagaaatggtgactcgcggccacacccggggctcttagtcttggaggcctgtccccgccccatctgctgctgcccacagggaaccctcctagagccgtcacggggcataaggcccagggggcctcgcgagctgatctttcctgtgcggagccaaggatgcagcagagggtgtgctcacggcgaggtgtccctctccggaggcagctcttcagggtttggcagaggagaggagcgcagtgaccacccagcactgccctaaggtttgcaggcacccgggagggacaatggctccatggcgggcggaggccgagaagcacttggcaagctagctggtcccatctctggatcctaagacattcccttctgctgttattcccagctgaggaaggccgccgggatcagtcgatcacttgtgttcctaaaatgtgctgcctgcagatgccgttctgacaaatctgcaggggccacagtgaagctctgcaggcttgccttctgcctctggggatggcactctcatcccatcctggagttactgcccgggctcccctctcatgctggccccacctgtgccccaaacacagcactccttacacggccctctcccttgccatctgatggctggatgatcaggagggagcttctgagggctgcctttccatgccatttaatggggaaggaaggggctttctctccactttttcttgcttcccatttagtgtgttctttccatttacacaatgtgttctccaatcttggatagcttctgttcttatttaaactttttaaaaagggattcatactcaacatacaaatgaggaatgcagctgaaactgggagacgtgaggagaagcttttttttttcaagtcagtgcaaatatttttggaatttaattttccttagaaaaaaatgccttgcagacagagcgtctgcatcctgtgtttgagcaccagtggtctctggtgtctttatttgtaaactcaacatgatgatatatgacctcacaaaccctgacttcccccctagcaaaattagaacagtggctcctctcttcctccagccagtacttcccctctccttccccctctcttcctcatgcctctaccctttcctccctttcatcttcttgtttggttgtgggcaaatatgatgacacccttataggaaagacttagaactaacagacaaggaaagtctataaagcaagcctgtgccacttaattgcaaagcacatttcagcccaggcattctgaagggacacagacagaggagaaatgctatccactcagagaaagcagagatacaggagagcagtatgaaaggcaggccaccatgccaccatgtatgttcagcctctgggacatagtcttcttactggacagatggttaaaatggtggcagataaataaatctcctttccaagtcattcaggccaaccccaggaggatcaagccatatatatgccttgtggagggaccatcttcccttgtgaccagtgctgtctggccagcagctgtccccattactgtccccaggaaaccccaggttgggggtgaaggcagccaacagttttcacgaggtgggttgtggtgatagggcccttgggcagagccatggtctaccatcttttgattttccctcatggatgttgtaaaacccttagagttccaaccacaagttattggttaaacgatgatatttccatacgtgtgtgaaccatacagctattcaaagtgagtactggcatggttaaccattaataatgcgtttgggaaaaacacaggctagaaaacacatctttagtgataaaagtcagagagtgtgcaagcgtggggaaaagggtgggtattgaccagcaaggggcatagggaaccctccagatgccagaaatgttctctgtcttgatgggtggggggatacaaaggattatagacttatcaaatcattgagctgtatactcaagatttgagccctgcattgtgtgaatgttatacctcaataaaagggaagctgtaagtgtagcatgaaaatattatgaaattttaacatggcagattgtgttttccaaaaatggccatagcagtatttctggtcctgaatgcatttccagaactctgccactctctgtccgaaggcggagtgtctcttccctccccttgagcctggcaggtctctgcaactttcagctaaaatgaggtggtaaaggagacgcccattactcctgaagttaggtcagaaaagctgcttttgcctggctctctctatctcttgggacacttgccctcggaacccagccaccatgttgtgaggaagccctggccgcttgaagaggccaacagcaccaactggccaccaacacccagcactggcctgaacgaggcttcagatgatactgaccctcctagtgtctctgctgagaccccagacgttactgggcagagaagaaccatccccattgcacacaaccaagttcctctcataggataatagatggtggttttatgccactctgttttggggatagtttgttacacagctattgtaactggaagtgtgtgcacatgtacgtgcatgcttatgcccacacacaggaaaatttctgaatatctggacagaggaattggagttgctgttcatttgttttcgcctattctctaatgtttcaccaataagctggtactattcatgtaataaaaataaaactgaaacaacgtgaataaacttctcaaatggaaacaggaccgcggcggggattcaagcatactgtgccaggtcagcctgtgccctgctgccctccgggcgctgggacaagtccatggaagtgttgagaaggacggagtgagctctggccgagaggacgctgctgcaaccctgcttccagctggagtggcttctgcacctgtgtttgttgaacagcaagcagccttcgtggaaggggttcgggtgcgtgtgtctgtgtctgcagaggtggaagggggcccctggtaggccaataatgcattcctggcaaaactttttctctccagattccaaaaatcaaattaattaaggggtagcctcgaacgctacctctaagaacagtattaaaatattcatataaacgcccacatcttgagttttaggaatgcaaatcaccgggtgatgattcaaagagacttcaacacaaaatacagtgtgttccacatgcccctggccatgaaataataacagtcaggtccagggcctgccttgcagtatgtggagaagcaacgggccctggccactgattcctgaagccagggtggtgtcttgtacggacacttcattatccctgtccctgcctcccacttcctaaagctccctctagcatcccaccctctgcagtgttcaaaggtcgaatagccgctgaaagcttttgaaccgaggaagcctctgcttaggatccacactttagtaggaacagaggaacctgaagcctccttgtctttccatcctcctttgccctccatcatttacccaggttggaatttccaaacaacctgaaccaatcaaggtgggtttgcttcttgacctaagcacttggtgtgaggcagggaacctgggagaatcaccatactttggtttccaagtacctgggttcttttgtttttgtttttgttttgtagagatgagggtctcactatgttgcccaggctggtcttgaactgtcctcaagtgatcctcctgccttggcccccccaaatgctgggattagacatgagccaccatgcctggcctatttaaaaagtgggtgtccacccggggttccccaggtagattgcaggcaatgatgtgggggtgctggggacagcccatcagcaagtccacctccagccagatgctaggagtgatgttcaccagggggccccagaggataacagtgcagagtgcccagggtcatggctctccaactaggaggacgagcgacgccacagaggaggtctggagccagccccggggatctggtctggagacaggtggcatcacattccatttgctgggactggtctgggagtggagcacaggtctctgaggtccgtcagggatcagggatcccacggagaagcaggggagctggagctctctggaggcccagcgccagtgcaggggctgagaatgcaggtatgggcagccaaagtctggggaggtgccactccctgggcaggaactagaatgaacccaaactggcctgggctgctgggggtgtgggaggtacgtggaggggaggagggttccaggaacagctacaggagtcagctgaggacacttttccccacgcccaccatgcaccctgcataccacagaaatctggtgcctacaacaagcagagctcccagggcagcccagggtctctgtggacagacaggaagagatccaggctactctttgggggtgaggagggcatggcccttggcacagagagaccaccaggaccctgggagcctggaggctgggagcagggttgggggtctctgagataagaccatccagatgctcctggcccctcctggaggggagaccaggtgagattttccatggcagtgcagtcacctgtgggatttggtgtcctctctggtgggcgtggcccaagaccccaaggctcctggtggggctggcgtctcattcctggagcctctcctccctgtgaggcacagatcagggtctcggggaagtcaggatgggcctcctgtcccctcttccacctgactcagcactgggactctgatgaggggttgaggcctgaggaacttcccacggttggggactccctgggctcagtgagctctgagatggtttctccagggcgcgagcatcctagcctcacgtaatcccctcctgaaagcacctcagtttcccctttgattgggtctatctgggtggcagaggagagagcctggcagggcaccaggaggcagggcctggcgcggagacagtggtggtccctgcaagtgcaccgaggccccgagaccgcaatcctctcccagcactgcctgttgtcgtcagcttcacctgaatggtttattgaaagctgtctctgccatctctccatgccagccttagctcaggcaccacctccccagggaggccctatctggcctcccaggtgcagtctcttccccagcaccccagtgttctgaaatcccctggtccacctgtttgctcgtccatcacccatcttccctcttggatgtcagcttgatgaagatgaggacttgtgggccggggccaccgcctgcctgtcccagctcagtgcccacacagcctggtagggctcacaccatctttgttggaggcagtgagccagtgggtgacccaggctctgaggtgggtgcaggtgatgtggcaatgaataaaacacagccactgatgtcctaaagggctcaggtgggtgtgcccattacccagttaccttcaacagatggcagatctgtgggcgaggagtttctggctggagttctcaggtactaggcaggggtgtgacggggtcgcacatggactctgggtaaggtttggatggacagaataaaggaaagagcccttactttgggatgtagggtggaaatggcacagaggcaggagagcacgggccttacctgggccagcgcagggtaggctggggcccgcccacccaggttcctctaagcctccaggcctccagagctgttttctctgcaccctcaagctcccttccatcctactcctcctcccaggccccctcgctgtcctcctgcccctcctcctgccggacactaggtcttcacgggaatccccaggacccactttccccagaactgggggaaccctcgaaaagcccccacagcccacactcctaggtttgtgaggggagctcagctctgcagctgtcagcccctgggtcccggccacggtgtctgtcctcacacacagctgagggacttcattttgccctttccccggcctgaggctgagggacttcccctgaccccccacccaaccccagcactgctctccccgctgaccccccacccaaccccagcactgctctccccatcgtcccctgccatctccagcacctaaaaccaccgtcctggggtggggagatccacttgggcagactcttgtttggtggttgctgtctgcagccatgagggaggagggggcgcaggagcctaggtcggggggtttctaggggctgtagtccccactggccttgggcatgcgctgcctgtggtccctcagggtgcaattttccctgtaatgaggcctgcccccgggaatatctacatctggcatgtgtctgggagtgggtggtattcagagggagtggcgctggtgtcagtgcggactccttgggcactgccttcctcccaaagcctcacacacagcggtgggaccggggtccttgcctggcacaggaggcctcacttgagtttgcagccagaccaaggggcaagtgtctgccaggcccactgagctggttctggagggactctgcctacaggagtgaagggcatggggggcaaccccatccttcctccttccgcttcccttgctctcctgccttcggtacctttaccaaaccaggtggtatgttccttatgttatcctaggaagtcaaacacaagcaatggctagcatctaccagacacatacggtgtgccaggcccttttgctaacactgacgctctccccgcaggtagaacctgctaccctcgtccttctacagctgagggggtggaggcacaggtggggcgggtgaacggctcagccagcaggtgggacagatgggatctgagccaggcaggccggctgcggagcccccgcaccaaaccaagaccccagactgcctagggcttagtgcgtggtatttcttattttactctaagggaaatcacctagaggtcatggcaaaccaccttttattgtatggggtcctgagcgggctcctgtccccgagggcctcagcagctgagccaatgtagtccctgttccacagcaatggaggattacaacaatgacctggaacccgaaagacccaggcttcggaaaagctcacgttcatgccgctggactgatgagaacagggaaggcttcactttagaaagcgttgttcacagcactgcttgcagccagcaggacttcccaaggacgttctcagtcagcacagaactggcactgcccaggagccccctgccccgcgcgcgcagggtctccccagttctgtgcccacaccacctgctccagctgcactcgtgctcccaataggaacaggtggcccagagccctccgctgcctggcaggatggtgggggagctttatttcccaccccagtctcccgggtctgatgccctccagcccaccccgcctcccacccatccgtgtgacctcagcctgtggctcctggcctctctgcttctcaccacgccgtggccactgtggtcagaggccagtcccccagtgtcacgggcctccctgcccacgaagaccgtctggacggccagttctgagcggccatatgtgtgggtggaaaggagtctgaaggccaagccagtctccaaataacaatatggaaaaaatgttaaagaggcgagcgctaacctgggatcgctgcaagtcttgttcgttaaaataaggaggaaggaaaattggcatgggaataaggaacattacagggtatttcctgcaaggaatatgggacatacttggaaatttcttgaggcataataagtttactgtcccttttcttaaaaaaaaaacattgctgtggctcacctgtccctccttccccaccaaaaacagttatttatgggtgtaaaatattccctgtttcaagcaacttaagagaacaaatactgctgtgagagactcccccagcagtgaaagatttggcacacagtcaggatctgaggtttggctatttgcttttagccattaattgctgtagaaagcctttgaaaaaaccctgtatctgggagtctcctgctataaaagaccatttagaaccagtgggaagctggtctttaagttcttgtcgacggagactccagtctccaagcaggaactcccaattacacatttacttgataaagatataggcgctacctgggggggtaattaaatgtgaaaatccctctttgaacctatcattgtgggatgcccaaatttggccctagagctgctgcctttgtgagcccaaagagaatcgctgtgggattgaggagaacagaacggtttctttctccccctccttcattaagaatgctttgacctactctcttatagtaaaaattattaattaaacgcccaaacgcagccgctttggcacagggaactatttagaaggcaaacaccgaaattaagcccagacacaaacgcattctactgcagaagatgctactgatgcaccttttgtgtgagacagtgaggaagccggggtttctgagactgtgtgtgccaggcatgttgcttggcataagacgtagtcaggtttaagacaatcctctcgcaaaagcagcactccttttgcccgcggtggtgatggtcctggagatggaaggaagagtggaaatggggatgcctgtccactctgagcctggttcgtttctcttctccacaggatttggggtgttgattctgtttcttctcttatcactgcatttattagagtccttgaccctccagaacctgtcacccacctcgtgtcaggacccagcctttgtggtcaggattgcagcaccctgagcccacctcgagacccacaggcttaactgtgaagtggctcccatcggtaggggacctgatgttggagtccttaataaggagtgagccctgaagtctggagacatttcaattgcccaggtcactgggtgaacctgtaaccaagaggctgctggccaaaaactcatcaacagcttgtgttttccaatttccatctatcatatccgtagggcaatgttcaacgcataaggtccaagtgaaggtttgcactaaaaacattctgttgagtaaacacaaatggccattaaacacacgaaataaagccccacctcactagggaccagggaaaggtaacaattaaagcttcacccattctgaagctagcaagtggaaaagatacaaagataaattgtcgttggcatagacggtgacacccagtgttggtgagatgtggagaaacgggttctcttgcccacaactaagagcaagcatggatgccatctttccagagggcattttggcactgttttcaaaagcattaaaaacatgtgagccaatgtgtgcttccaacaatgttggactagcttatttcagatcaaccctcctatcaagaacaactagaaaagctgtagacaaatgtataaatcacctgcttgaagtcgtgggagtagccccagggcagtgagcacttgaaaggtccaggtcctggagagaagaggaacacaggaggataagctggaagttcggtgcctatttctctctcaaggcagttgccggttctctctcagctgcagctgagaggttgagaagctaagcaacaagcagtgatggaggggctgaaaaagtgggtgaactgctgacaatctcataaggaaaaagtgggtgaactgctgacaatctcacaagacaagggaacaaacattggcatggagggtatgcaaaagaggagtcaaaggtagataccccaggccttcatttcaggggcccaaagagctacctagagtgaccaaccaccctggtttgtctgtgactgtcctggttttagcacagaaggtcctctgtcccaggaatcccctcagtccaaggcaatccagggttcttggtaactgctgtggtttgagtgtcccctccaaaactcatgctggagttgaattgccactgtgagggcattaagaggcggggtcaggtgggacctttaaaaggtgattaggtcatgggtctgtgcccttatgaatggattaatggactatggcttgtcataggagtgggttagttattttgagagtgggtctgttataaaagccagtttggctctctcttgtgcaccccacttgccctgtgtaccccgcttaccctgtgatgccttctgtcatggtacaagacagaaaaaaaggtcctcagcagatgcagctccttgaccttagaatttccagcctccagaactgtaagaaatagatttatttttattataaattacccactctgtgtattctattataggaacagagaacagatgaagatggtcaccctaaataaaccctggaattcatgctgacacccaggttcaaatcctctcaggccctaattaagttaggtgatctgccattgatgatgaccagaagcaaaagttaatattctctggggaaagataacacccagggtcttgagtcttttctgcagttttcaaacacaatagctaacattccatcaaaactaaccaggtatgaaaaatgataaggttggagcaagaggaaaaaaataaacaatacaaaaaatcctctggagattctgatattggtgttacgaggcttttaaaaactaaaataactgagattagtatattccagaaattagataggtattttcagcagcatcctggaagcaataaatggaaactttagaacttaaaaatatgatactaaacttatgggaatagttaagtttaactacagattagacatagctgaagaaaataagtaattgtgaagatagttagaaaaatatatctagactgaagcacaaggagaaaaaaatgaaaaatacagaaaagaatttaagagaaaatatgtaattagagtccaagaaagagagaggagagagattagaagtaatatttgaagacaaaatggctgagagatgacaaaaatgatggaaaacagaaaactacagatttcagaagagctataaagcacaaacagtacagattaaaaaaacacacctagacgcatagcagtaaaactcctggaaaccaaaaagaaaactccaaaagcagccatagaaaaaaaaccatatttccttcaaagaaaacaatgaaagctaatggacaacggaaccatatgttcaaagcactgaaagtaaattgctgccaacatataattatatacacagcaagaatatccttcaaaagtgagggtgatgtgaagacattttcagacaagtgaaaactagaattattcaccagagcacctgcactggagaaactagcaaaagagttccttaggcagaaggaaaatgatcctagatgaaagcacagagatgcagggaagaatgaagagaaatacaaagatttaatatgcaggtaaatctaaatcaagaccgatcatacaaaacaacaataataatgttttgggaatactatatggcattttgtaacgatgaaagatcaattcaccaggaagacagtaattctaaattagcctcaaaattgtaaagaaaaaaattgacaaaactaaaatgaaaaatagacaaatccaccattatcctgggagatttttaacacaactctcttagtaactgaaaaaacaagtagacaaaaaaaagtcagcaagcatacagaaaattcaaacaacacatttaacaaacttaatagatatatgcagaactctgcaccacaaactgcagaatgtgccttctttttaatttgcacacggagcattggctaaatttgaccatattcggggaaatgatacaaacctcaatacatttctaatgactgaaatcatgcagactgcgttctttcaccacattaaaattaagctggcaatcaaaactaggaatccccaaatgtttttaacttaagttatatgttgctaaataaccccgggtcaaaaagaaactcaaataaaaattcaaaaatattttgagaccgggagcggtggctcacgcctgtcatcccagcactttgggaggccgaggcaggcggatcacgaggtcaggagattgagaccatcctggctaacacggtgaaaccccgtctctactaaaaatacaaaaaattagctgggcgtggtggtgggcgcccgcagtcccagctactcgggaggctgaggcaggagaatggcgtgaacccaggaggtggaggttgcagtgagccgagatcgtgtcactgcactccagcccgggtgacaaagcaagactccgtctaaaaaaaaaaaaaatttttttctttgaactgaatgataaatatgtgatataaaaccttgagatgaagctaagctatactgaaatggatatgtgagagaagtaaagaggataaaatttaatgagccaggataaatacaagtgattccacttatatgaggtacgtagagtggtcaagttaacagagacggaaagtagaatggtgattttcgggggcttatgggggcaaaggagttagtatttcgtgggtacagagttgcagttttgcaagataaaaagagttctggagatggatggtagtgatggctgcataacactatgaatctacttactgttactgaaccttacacttcaaaatggttaagatgatatattttatgtgtatctgacaattaacattttttaaattaatgagctgagcatccatctcaaggaattgggaaaataacaaattaaacctaaagaaaataaaaggaaaggggtaaagaatataatagcagaaattaatgaaatagaaaacaaatttgcaaatagaggtgttcaataaagttaacgtttctttttgaaatgagcaatacagtcggtagtaagttgggtttcctgggcagcagattctgagatgaagagcacagtgctgaaaggttacgagggactgttcttggaatccaaggaaagcgaagggaagggaagagaagagaaagggaagaaaccaggattgggtaaaggaagaggttgagctgtaactcagcctcacaggatgcctcagccagctactcagggaggacggaagctgacaccacccttgagagtcatcccaagccggggccagaggcagatcttcatgtcccatagtgagcagtcatcccgtaggctgccctggaaagggcgcatgacactgggagtcaccagcactctcggcagctggggcaatgagcacttcatttctgaagggggattctggtagctcttcaccttacgagcagggtgagaagaaaggagccgcagattgccaatatcaggaaagcagtgggggacagtgaaaggtcttacagaccactgaaaagaaagcgagaggattttgtcgacatattcagtcctatctgcttgaaaatttagatgaacaaatcctctcacccaagcaactttttaaaatgaacacgagaaaagaaaatctgaataattttatatctattaaatgtataattagaaaaccttcctgtaaggaaaactccaggcccagatgacttcagtgcattcttctgaatatttcaggtagaaataatgctaatctgatgaaagctcttccagagaacagaaagcaaggaaacgccacccgcttgtcatgaggcaagcataactttgataccaaaatctgataaggtcattacgaaaaagtaaaatggcaggtcaatcattctcacaaacattctcacaaacataaatatctgaaacaaaatattagttaagcaaacccaagatagataaaaaggtattccaggaatatgaagttggtttaatgtgcagaaagcaatggaattcaccacactaacagaataaagaaggaagtcctgtagtaattatatcactggatgaaaaaaagggtttggtaaaatccaacacctgttcatagtggaaactacagaagctgtgaatggaaggggattccttaatcacagaggcacgaaaggaaaataaatctccccaaaatcactaagccaaaggcaaaagtcgagccgggaactgcctttcattctagtcctaaataagacagctacaaagattaataaaaagctacctacctccctcaccatttgcccgcaaggaaattccttgtggacaacggacaggcagaactcaagtcatccctctgctcacgtgagacaaatgcatatcctattgcttccccttccctatggtttcactgagccaggctaagacataagtgactattcctgtacagtgtatgttgagtgaaaggctaatcagaaactcaaaagaatgcaaccatttgtctcttatctacctatgacctggaagccctctccctgcttcgagttgtcctgcctttccagaacgaaccaatgtacaccttacatataatgactgatgtctcatgtctccctaaaatgtgtaaaaccaagctgtgccccgaccaccttgagcatgtgttatcaggacctcctgagctgggtcacaggtgtgtccttaaccttggcaaaataaactttctaaattgattgagacctttctcagacaccttttcggctacaaagggtatctacacaaaaacccctacaacaagcatcatacttaaccatgaaatagtgaatgtttctcccttgagatcagaaaacacaattcagactagaaagagaagaatccacagatggctcctggcttcaagggagagagattcttctggactttggaagggcacctgggcacgtgagtggtggagggaagtcctctagcctcagaagagggtgcagaggatttttgaaaggtggtcaggtggtgtcatcacagcagagacgaagggaatgagctctgggcagattttgaccactctctccttacccagcaaggctggccttttggagtagggagcgcctgaatcccaggatgttgttggagctcggggcctgggacagaagaggttctcagcagcgtgccttgtgtaaatggtgactctgaaatagcatagctgtccaggctgagtgggggccataagggcctgagctccaggcaaggctctgtggttgaactcagtgccgggcagtattgccacttaggtgcgtctgcagggccaggcaggtggtggcagaccaataccctacagcagctctgggtggcctcacagagcagccccacgcggggcctgagcagctcctagggcactcccacaagcccctgtggcttttgctggaacctgaggtaggcagcaggcacccagagtgatctgcatcgcatacccatgtgggtagtaccagtgggggcaaggcaactcagaggcaagtcaagcattatgcatctttaattagaatcaagagagatcggatttcgtgctgctaaattctgccagcgggggtaactgtaaaaccccatggctgcccatgagccctctgaaaccaggagaggacggaggctagcgcgggagcaatctctgccatgggacttggggtcccctttatcccctcagaggaacagcctgagtgcagccgctccatcctcagggtgtcggggacattggggccctccagctcccaaacatttgcgccatggtgaggtgacggtttgcagacagggctgcttctgcaggagcttaaactccaggagaacagggagtggtctgaatgcctgggcaccccagcacccagcagtgactgagctgtggctggaaggagagggggtggatgccgagaatcaaggacgggtgcagttcttagtcctctcctctaagttcttcagactgtgggcccgtgaacttgtgagccaaggagagtcctcgaggggacactttccttctgcctggcaccccactgtggcattttggcctccagaggagtaagagagaacggtctttctcccaggggttctcctgcccagggtttagaaaaatcaatacaattgattaaagaaagatggtggcacagggatgcttcatcttccctccttcctgacccggggacccacagcagaagctgagaagaggaagcctcccggcccctccctcaacaccagcctccccggcgggacccttgctctccagcacacgcccaggggttctggtttccactgcagcctctcttactatcccattttgtagcccgtggggatgcgccttttcataaagtttcccttacatctaaagcattacaagatcatggtagaagacatcttaaacgtggagaagccgcaagcaagctaaagaataaattcttcataatgctttttttgctatttctccttccagagatttttcctctgtgtgtgtgtgtgtgtgagtatacatagaaaatccctatgctttgctttttttttttttagaaaaatgaacttattccctacatgcggttgtatattttgcgtctttcattcaatagcatgaaaattccacattattcaatattctcaacacttttggctgcacagtattttatatttggaattattacaaccaggctagtaccctgttgttggacatttacactgaaaactattctgagaattcttttgcccttgaccctcaattattctgttctttcctatgatagttctaaaaattgtcttcttgtgaacactctgattagttcactgttttgattgtaccgtgcacccacctccacttcccaggttcaagcgattctcgtgcctcagcctcccaagtagctggaattacaggtgtgtgccaccacatccagctaatttttgtattttttgtagatttttgccatgttggccaggctggtcttgaacctctgacttcatgtgatcctcctgcctcggcctcccaaagtgctgggattacaggtataagccatttgctcagccaacagcacagatttatgattttacagtgcaacaggccgaaagacatgggtctcggtggaataaagtcaaggccttggcaggctgtgctgtctctggcggtcccggaggagaatccacgcccttgtcttttccatttctagaggcggccctcattccttggctcctggccccttcatccaccttccaagtctccctgtgcctctcgtccacagtcccatcctcttctgaccacaactgggaatggatctccaattttaaggattgcgtgattggattgtttttgcctgaaaaaatccaggatcaccaccccatctcaagctcctgaacttcaactgcgtctgcaaagcccactttgccccatggcatgacttagttactgtctctgggaataaggttgggggcagcatctttagggggccatgattccacttcccacaatgctaataactcccatttttcgagcagctgctattactgtcagtgttgaactgggcactttacagggattatctcattttaccccagccccaaatccacaaggcagatactatggttatcctcacgtggcagatgaagaaagtgaggcagagagcagtagtttagaagccaaggctagtccgcatgagtaacacaactcagcaaaaactatgagccttcttggtttgtttatttaacgacaacattgaaaccttaatatagacctggaattttctgaggaattgctgtttataaatgctgagccggccaagtctgtttttactcctcagtgtttgctaagtgtcacgaaatcctcaggtggaggctgtggggctgggcccacgtagctgcctcccaccgctgaggcaggggctcgagccgcgatttgccaaggatgacacatttctcatggaaccggacgtggttctgcgtgacttgcaggtcccagtggcacttgtggaagctgttaggttgcgtacttgggccctcgtaaaaaactttttcataaaaaaattttcaaaaaaatatttaaagaagtcctgagcgactccactcccaccttgctggcgtgaggcagtcatattcggccagagaggaggctgcttctatggaatggcatgaagcacattgccgtggccacagcacagcagagcctggaaccccgccccgggaagggactgctttctgtcctcagatgtcaagtcgccatccagcagggcaaggcaggaaacacagtagggtcaggtccttcaggggcctctgaggcaggtggactttcttttccccagaggagccacagcgaggtcccgttggcgtctctgagaggagggttgtcacatttaagcggaatgaaaacaggactcccagttaaattttttttttttttttgagacagagttttcgctcctgttgcccaggctggagtgcagtggcatgatcttggctcactgtagcctccgcttcctgggttccagtgattctcctgcctcggcctcccgagtagccgggattacaggcgcctgccaccacgcctggctaattttttttgtatttttagtagagacggggtttcgtcatgttggccaggctggttttgaactcctgacctcatgtgattcacccgcctcggcctcccaaagtgctgggattacaggcatgagccaccgcgcccagctaaatttgatgtggattgtatttcagagaaacaatgaataattttttagtgtatgtttccaaaaatgcatggcttcatatttacacaaaaaattatttgttgtttgtctgaaatttaaatttaaccaggcatcctgtattttatctggcagccctacacagcggggaagacacacacttctaattcaggcccccagttcagtgaatccaagccttgtggtttagcctccctgactcagggaaaacagttccatgccctctgtgtctcacaacattcttttgcctcttccctctttgctgccaatctaaatttgttaaggcctaactcacacctcgccttgcctcctcctccaggaagtctctcctgattgcacttcacccttttagttgaaggctgagggaggcctctggtgtttccagaactgtgcaccgtcccaggcttacttacagtctggtgaaagaggcagatgtaaacagaaatattcagagaatgtgaaaatgcattaaaagatgtagcaggatatttgggtgggaaatgaaatgattttatttatttatttatttattgagacacagtttcactcttgtcgcccaggctggtgcgctatggcgagatctcggctcactgcagcctctgcctcctgggttcaaatgattctcctgcctcagcctccgcagtagctgagattacaggctcctgccactatgcccagctaattttttgtatttttagtagagatggggtttcgccacgttggccaggctggtctcgaactcctggcctcaggcgatttgcctgcctcggcctcccaaagtgctaggattacaagtctgagcccccaagcccagctggaaatgattatttgaaaacacctgtccacttccacctttgatgtggagtgtcatccttcctttctgtgagtcagatctctacctgtttttcagggacagtaggaggaagagagaaggaacaagggattcctcagagcttctgctgtaccccccactcctctagatgctgtccctactttggctgagcatccattggtgagaatttagatacacgagggtaggtgcagtgagtcctgggggtgaaatttctctgtttaaacaagccagggaccttgcaggtgtggggaggctgcagagcggtgaggaaacttgaggagggcaaagacgatcggcagagtcacaggcttggtggccaagcaaggttcgaagcggcagagccaccagggccttggggcgtagaggggtctgggttccgggtcccaggtacgttcgtccacagcatcacccctcctctgctcacagcttcagcaaagcctgctccggagcgccggtctcctgtgcgtgaggtacctgcaataaagaaggctggatcgcactgccagggccacgtagagcaggtcctgccactgacagcaggaatcactgaatccagactaagaactggagcccttgtaagaaatcaggcaccgacaggcgtcttgagggaagagtggagacatccttgtcagcagtcctggaggaaacgtgttagtttttatccctggtcctaacttccccaggtttggaaactgaacaagactaaaattccttggggtttaaatatttgacttgacacggcttttttttttttttcctggctaggaagtatttacatttgaaagagagaattcagtctgatagcccaactactagtcatctaagaggttgccagaaaccagtgtcctagcaaatatgttgactggacaagcccaggacttacttgagaggacagagctggaattctgaggacaaccaatgacgacattgttctctatgtgcccacaggaagggcccaagtgctagcctggtgatgggcctggccgaggaggacgtgcgatctggggtcattaagagctcctcattgatcctggaaatgcagtgtgtttttaagtggattggttttaccagtgagcattagaagtgtttgaggatgctgcacatgcctgatgaacgaccgtgcccacgccgtgaaggagcagggcagaaacttccgctcaacaggatctggtgctcagacgcaggcaggacggccgtgcgtacctgaagcagcctcttggtgggaatcccaccggcaccttagtgtgggtgtcactcacttggtgtgtgtgtcactcactttgaggcctctaggattctccagaaaggtaagtacccctgcctgtgtgtccagtttctgcttcttgatcagttcatgccccctaactccgtcatctgggtttggagtggatgcctcttggagaggtcactcctgttcttagccttctcctggattctgccagtctttgggctcgtgaatagaagccaagcctcacaactacatgagagaaagcattagtcctggctggataggagtggggctcctaccagattttaagtgacgaagtcccagctattggcaaattctctttgcccgcttatgcattaaaaagctgtatccactttcatggaggaaccggtggccagatgtcttcagctttaaaaatattcctcctcccacctgtaatcacagcacttcgggaggccgaggcgagtggatcacctgaggccaggagttcgagaccagcctggccaacatggtgaaacgccgtctctactaaaatacaaaaattagccaggcgtggtggtgcgtgcccgcagtcccagctactcgagaggctgaggcaggagaatcgcttgaacccgggaggcggaggtttcagtgaacagagatcacatcactgcgctccatcctgggtgacaagagcaaaactccatctcaaaaaaaaaaaattatatatattcctcctgctgaatgttgcaatgtcacaaaaagccaacttcagggactgtcctcttgtgaccaccaaagaccgatattcttaggagagtattttctgcctgaaccttggtccctctttcgtgggtgtattagggacgctggaaagacaaattcttgaatccgcgcagagccctgcaagctgggcaggaaatggttcggatttacttcaggttcactgtggttgttatttatgcactgcaaacctccaaaaaaagttgtctggcctcgttcaaccaaccaaccagctatttttgaaaaccgcagagcaatggatgattgtgttgcacaagcttctgtggacgcagcaacaggtgggagcaaaccagggcacactaccgtcagccattgtggaagcatttcccggagcatttggattttggctacagtccaaagtcaaggacaactggaatgaagtacctcccacacttacgaaagagcacggagccaccagccaccagaaacccactctcaggcttactaagaagtctaaactggttttgcaactcttaaccagtggtccagccaatcagctgtaaagaatgtatgaagaattaagagaaatggggcaagaaggggtcttgaggggagcagtaggttgtcatgcagtgggagtgccaagaggtgtccctcgaaccaggtcacgtgatgccaagagatacccttagaaatcagggtgccgccagaggggacatgactgtgtgcccaccctgtgcaattagctgaacggtccctggtgacaatgttcctgagagatatttggtgaatgtttggaagtagaaatgagcagaaagaatgatgcctgcttctctcctagaaacctctgaggatgggagactggttggagcagccgccaagtgccaaggagagctgccaggtgcagagggaaaaggaagttgtcagtcaaggtcccagcagaaattcaccctaaatggttaaaataaagagatttataaaaattgagtttactgagacaaaatctatacaaaattacactcattctgttaaggtgtcccattcaatgagttttgcagaatatttccagtcatgtggccactaccacaaacaagatccagaacatttacatcacccccaaaaaagctctagtagacacaccaaagatttctccagaatgtccacgccatacgctgccgccggcagtgcaggggagttttggttgccccgcgtcctcaccaacactcggaatggccaccatgtttattttagccattccagtgagtgtacgaccacctttcacaggtcttcacttgtattttcctgatggccaacaaagtttaactcttttgcatatatttatgagacacatgcaggaaggtattctgatgtgttctttcgggaggtgtctattcaagtcttcagttccttgtatgttgggttgtcttttccttattgatgtgtaggagttacataaatattttgaatccaagtcctttgtcagatgtatatattgccaatagatagtgctgatatcccactctacctgttgccttttgaagaatattcctgaaggcactgcttcaggtggggtgttgagggacccaggactagcattagcagggaaccactcccactgatggatgaaggggaaacaggatgaattgttgtcatgtgagcccagtgaggactggcggtggggaggtcgggcagcccagccagggctgtggatgtgggggccacactatggccagatgcagccctgtagcagagacagggggtgaggaaggcctcagactcctctttccctccaccctccactcccctgctggaacctccattggccaagcccagaagtcatccaggaagaaagttcaaagatgcagtccctgggagtcagcctcctgggacagagaaagacaaagatgggaaggcgtggatcaggagaagggtacaacggaggatccccagaaaagaggggctgcaagagattatccaaagcatatgtctccggggttaagaaactacacagggtgcatatccccgtggggcctctgaagaagccacaaaacgcggtcctcatgagagccagcatttgggtggctgccatgtgagaactacagctgcagaactagttaagttaaaagggaaaagatttcttgcttacttcctctaatcccccatccccctgtcctgcctataagggtgagaagagagagggaaagggagaactaggaaaagaacacgtgttgccccttccctacccctggcccagacaccagcccagcctgtgctgggggctgtgggagggggagtttgacatggatgtcaagttcaaattgactctttaatacataaaagtgagtcattctcacaagaagcagcctttttcttgactaaaaatgcctgcaaacaggtgagccggctatctgagatgtcatcaaggggcagggaaagctgataggagtggtcttacctgaagccaggatgtaaggaagatcaagccatttcctgtctgcttctcactgagttcagaccttcccacagccagttttaagtcataactcaaatccctctttcttctacaagcacaaggctacgtagctttcatgcattgtcttagtaaccctcatgaccactctacagttcagtactgttactatccctgctttacagatgaggaaattaaggcagacagaggttaagtgacttgtccaagtccacaccaacctgctgtcaagtccagcaaacctgattctagagcctaagctaaaggctctgtgcacactccccatgcctcacacagcagctgagagtgtagagttgtgacgttgtctatctggttaggaacctcagaggcagggctggttcccagagtccattcaggctggtgggcagctaagaagtgggggattgcagggcatcaaccaccgctgattgagggttggaggggaccccacatccccagctaagaagtgggggattgcagggcatcaaccacagctgattgagggttggaggagaccccacatccccagggggattggaggaagaccagggcctcctcatgcaacccacattatagcagcaaaacccctcctgcagttcatgttgccacctctggcttccaggtggagcagggactggtccagggaaccctcgcagatcccccctgtgggttgcacagtcacatccacagaagcccagtctggagagttctgcatgtggcttaccaggtatcagggacttccggggccaagactgggaagagttggggtgcagctcccagtggccggtgctcagggaagtcacgcagggaagtcctgggaggcctaggctgcctcatggagaagctgcatggatgtgcagggcacaggcgcacaaagttctggggcctgggagaaaagaggaaggaatcattaccacatgttcaggctgcagaggctccgtagcagaggaatagggagaagcaaccagtaacggaggtgggagccggaaaggtaccaggtgtaagctgggggacaagggagcaggcggacaacaaaggcaatatcttggggaggcaagaggcagaggaggtttgaattttgcccccgcctgtgatgggctgccgggtggactccgccgtcctggagctccatgcaggggccagcgctcatgtcctgagagtgcgggcggctcacagcacagaggacttgcactgtgcgatcgcacctcagcggtggccgtgcaagaatggcctcatctcttaggttagctcctgagagggcctcacttcctccacccacggaagccagagctcagctaaatcagcgaggttccttacccctgtgctgccgtccacccagagggccccgttttggacatgtatcatctgggtttgaatgcagcccagaacccagtcccaactcagcctcaccttcataggcaatcaggttgtctctgggaagcccaggcctcccagaacttccctgagcactggccgctgggtgctgcaccccaactcttcccagtcttggccccagaagtccctgataccggcaagccacacacagagccctccagaccagggcttgtcttggggtaagattgtgtacaccacagggaacccgccaatccataacacataacaggcccctgtcctgttcacaaagatgtgtaacttggtaaaacaccatgcagaagtaaaaatgcactattgcggtgatgtggccatgagtccagtagggaaatcattttccacgctcttcctctgtggacaccatctcctcgaatgtgactggggattggaagctacagcttctagagtccacaggtctttcttttttgctggcaaattcggacaacatctactctgctacaggcttcagcccatctcctatttgccagaattcacctcaagaaatcaagaacaaagcgtcatctctcacttcaaaacgttcttggaggcacgtggtttccgggccaatggcccacggagcaacaagcccgagtctgactgtgacggtatcaccgtggtgcagacctcacccatgagtctccatctgcgagaaagacacagggcggcggtgggaaacacaaagaggacaggaaagacctgcgccggaaagggatggaagagcaggctccgagcctgatgcacaggacaacggctgcatttcaacaaggaaggacacctcctgctccattctccactcctcctcctgcaggggcagggatcccacttccaccagcgcccaggtcctcctcgccaccctggtgtgatgccagcaccctctatggggggtcctcctatggtgccagtgacaggcccacctcctcctgagggtgatgccatgggacctgctcctggaatgaggccacccatgggatgtcacatgccagtgttacccaggcccccaggatgagcccgcccacccatcgcatggtggagcccacgcagcccagaataactaagccagacagattagaatagtggagagacctcgtcatatcagctttttgctatttgttcttctccaggagaccatggtgctgtgacgctgggtgtttccttagcagcataaggaagacctgctcccccttcctaccagagaatagttttggaggggagaagtgagaccaaaaaagtacagttttcatctgtattgtgaaatgtgaacataaaattgccaactctttcagttttttaaaaaaaaaaagtcttggaaaagcaaataaaaaccacaatgagataccacttcacatccaccaggatggctataattttaaaaacgaaaagtaagtgttgacaaggttgtggagaaattggaaccctcgtacatcgctggcagaaatgtgaaatggctcagccactgtggaaaatagtatggcggttcctcaaaaagttaaatatagagttcccatatgtcacagcaattccactgctaggaatgtactccaaagaattgaaaacagatactcacacatgtaccccatgctcatagcagcactaattccaacagccaacatgtggagtcaacccaaatgtctatcatgaatggttaagcaaatgtgatttatccatacagtggaatattactcagccttaaaaaggagtgaagcacttgtacatgctccagtatgcagggactgtggaaacatgatgccaagtgagagaagccaggcataaatggttacatactgcagtattccacttataggacatgctcaaaataggtaaatccatagagacaacaacttagtctttgcccaggatggagggaaaggggaatgggaagccacagcttaccaggtacagagtttccttttgggtgatgaaaatctgggcttagatagaggcgacggctgcaccatatcgtgcagttaccaaatgctactaattgttcacattaaaatggttaattttacgttctgtgaatttcaagctttcaagtactggggttgaatctggagacgcaaggtcacttggaatctctaagtgttattttcttagcctttcctctttttttttttttttttcttgagacggaatttcgctcttgttgccaaggctggagtgcaatggcacgatctcggctcactgcaacctccgcctcccgggctcaagagattctcctgcctcagcctcctgagtagctgggattacaggtgcacaccaccacgcccagctaatttttgtatttttagcagagatagggtttcaccgcgttggccaggctgatctcaaactcctgacctcaggtgatccacccgcctcggcctcccaaagtgctgggattacagacgtgagccaccgcgcccagccagcctttccttttgagatataaactggttgcgggattagagtcaatcattgctgtttttccaatgggttgttgtatatagataatctgggatattttattaaaaactcagggttataaaacttgcatagaaagattctataattattaggcctggaacaaaaaaagaggcttggtgtcccagtggaatgctgagtggccaaggggagcactaccagtggctacaaaaaggccatctggaggccaggatcagttctgtctgaccgtaggtgctgagggtatgggacggctggaaaggaggtttctctagaggacaccagtgtccagacaaggttctggaggatctgaaggagcacgctggtgcctttgctcctgtaggatgctgtggagaaggatccctgtatcttatgtataggttccatgatctctagaagcaccattgcaagcccattttacaaatagggaagacaggagtgaggggcttgcccagggccacttggctggatactcacccaggccaagcttgcccagccctgacaattcactgtcaccaccctttactcctgatgaccacagcccagaaggacagggattgtgtaacattctaagaaaatcatgctgccatgcaggaaggagacagacctagactcagccaatagcagctgaggggtaaagttgcttcaaaagaattcttggcttcttggtattatttggtttgcccagagactccacaccccacttttttttttttttttttttttttttttgagacagagtttcactctgtcaccaggctggagtgctgtggtgtgatctcagttcactgcaacctccaactccctggttcaagcgattctcctgcctcgacctcccaaagtgctgggattacaggcatgagccaccacgcccggtctccacacctcacttctaccctctgctactctcctgtttggaacgttggtttcttctgtttccaatggttatcatacggatggctatttgataagtcccagttccaacccatcactctcccaaggaggttggaactgggacttagacccctgtgggacctggattctaacatgtaaaactctagtgctcccggaagctgtgttactccaaggcagcagccaggcagagagaggcagaggaaacaaggaggtagagatgacgtcctcacctccccacagtgcccagtgcccagctctgcccctaaggcccagccccacactgcccacagattctgaggggtcctccaggatgctgctatgtcatgccccacagactggtaccctcacaacctacccagtgtcttcccgggaatctagaggatgggaagcctcagtctgcatttcccagactcccttgcagagaaggtttcacatgtgacctgggtcccaccaggcagagacacctgcagacttgggagttggaaatgagcaccccagggtggtggcaacactcagggagatcagactttcagcaagtagaatggcccaggtgcttggctgttctgagtagctggggtagagggtctatcatcccaaacctaagctatgggcagcagcagtggcagtggagttttcagaagagtcctgtgatctaggcatgtatttctcctggctctaaggtctaagcttgggtctttgacctgcccagaaattaacaaaccacatgacaggctgtaataaattcctttctcttaaataaactggagtggattctgtagtctgcgcctaagaatcctaatttatacacctgccaataataaattcatcttgttgataattcgacttgggtgtctgtcacttgcaagcaatgtagttgtaatacaatagccaagtaatcatccaaactggataaaaaaactttaaaatggataaaaaatgtctttatccgaataacagacgtctccatttgcaggcagctatgactgtaccctctacattgagacatcaagacataataaatttcattttatagcttggaaatgcatgaatataacaagttaactgacttgtggggaacactgaatagctggaatttcatctaataagagatttaaaattaaaatattttaaataaaaatgttcacccttattgggtcactggttccaatattctcacttcagtcctgaagacacagaggcctggggtgttgctcaaatgcacacagagtccataacaggattagaactattagaagccctacgctaagcttaatatctaggcaatgaaatactccgtacaacaaattcctgtgacacgagtttacctgtgtaacaaaccttcacccgtaccgccgaacctaaaatgaaagttacagaaaataaagtaagaaatgaaaaaaagtaaagaacgagaagccctatcactgaaccctacactggtctctccaccacagcacagtgcctccggaggcaaagatttcagagctcttgacttggccagaaaatgcagaggaggaaaaaaagtcagggcccatcacatattttgtacttgtgaccatgctcatggaattagaagtcagaacagtggagctgtgaatgatgcatcgggctgagttctcacttgtaattcctcttctgtggggagctggcaattcagagggggagagcgtgagttcacggtctgttccacccctcacccgttgccagcaatccccacactggaggagctggacctgggttcctcatgcagtcctccacgtggactggggactaatgcgtctaacagaagtttccgccaaaagaggttttgcttcttcccccaaagcatgtgctccaatacaggttttattttatttaaacaaagcatgcgaagagtctgtagcaattgtgttagatagagatgctcctaatggctgggaagggtgctgctgagatggacaggctgactggaatcatggatttgccttcccgtggtgctctgtgaagtcgtgcagacgcagaggagagaagtgtgttgctgggcacccgccagggtgttggaatgaagctcttgagtttctccatcaacctagctggcagtgactgttaccaacagtcaagagaagcccagacaacagagtgcccgcggggacccacatgcaggggtctccttgggctgcctcaccatcaggggttggatgtcagggcatggccatgatgtgaaaatttaagagcttttagtacttacaagctctggggggtacatgacacacctggaggccacacacacccacacacagaaggaggtcagcgagtgcaggcagagagagatcagggacccatgggccaatgtctttatggggttcagggcgctacccaaataggcttcccaagggagctttagttggtgggttagcaggcaggcacagttccagaaggttacaccgtgacccagaagtgatcactttaagtccaggggcaagtgtctgaatcctttaaaggaagaggggaccccagcctgtcaagagggagaaatgcctctgttttatctctggccacacactggagccattccaatgaggtatagtattgaaaaccgtatcaaggtgactgagccctgcttctggtatagaaaagttaaatttatatttttttaaaattttaaattaatttttttttaattttagaggcgcgatctcactctgttgcacaggctggagctcagtggtgcaacccttgctcaccgcagccctgaactcctgggctcaagtgagtctcctgcctcaggctcccgagtaactgggactacagggtgccccaccgcacccagctgtttttttgtagagacggggcggtgggggggtgggtgtctcgctttgggctggtcttgaactcctggtctcaagggatcctcctgccttggcctcccaaagtgctgggattacaggtgtgagccaccatgcctggcttaaacttgtattttaaaaatagatgccaaggctaaaattataagcagtcactacacagggccttacaggaccctgagtataaacaaagtcagcaaccagcttagaaagtgggtccattctttgcacaaacgctcctgaaggtcctctcggaagaggggcaaagggttcgctggagtagaagagaggggaaacaatcacttttgtcctgggcaaatcactgaaaaacaagaagagctgctccttatcggatgtgtcttctggagatagatggcatcgcatagagtcaaccaaacgggaaatgaatcagtgcttgaaataacagtgactgcaaaagatttttcttaattcccttcagactcaagaacagtaacaatgtcagtgtccgggagatgcaagtcctctgtcacatactgaggaatcacatctcattcaacagcctgttacaggggtctgggaattggatgtgggatctcacgccttattgtgatccttaaccacctatttatctttgccagaaagacctagggttgcagaaatgaagagctttgctttgaatgtcctttctcaaatggatgctggtagcgctgtaggaccatttttcaaaaatgaaaatctgggaagtcatactgcctcatttgagcttcttcccctcctgggagggggtcctttcccagttggattggaccatctgcagccagcaggctgggaacgtgcttatgtgtccagaccagggcaggagggctggggcatggaggggagccaccaaagggaaaagccactacacaggccaccaggaaagtgtcccgatgatctctggcaatgattaatgtagtttctaagggcagggcgggcctgaggtgcgatccaggaggaggagcgtacaatcacagatttgttgcaggaagaacaaaagaagaaaaggcagaacaaaaagggcagaaaagcaactatgagaggcagagaagatctgccgtgggggaaaggagccttgatgtccatgagctcactaccgggaggccagcacggaggcctcaggacagaaaggctggcaaagtacgctccttgaatcgggtagttactgagcaaacttagaacctacagagagaagcctcggcaagataggggaaggctgtcacctgggctgggagcgggcagggtggaagggccactcctggctcccaggttgctcagcgttcacacatctaccccggccgcatcagcctccctgctggccgcatggttaggaggaccacagttgaagtgaggtagaacaatttccacctcataagtctgtgctcaaactatcaaccaaacgtaagggtataataaagatatttgcaaatattcatgtccccaacgttctctgtcatgcatcctttctcacaaggcaactggaggatatggcttatcaaaagtaaagagcgatataagccgaagagcattgaaaacatatgtccacataaaaagttccacaaattttgtaacagcatcatgcgtaatagccccaaagaagaaacaacccaaatgtctatccactgataaatgggtaaataaaatgtagtacatcgacacaatggaacaaagtagtggtacatgctacaacataaagaaccctgaaaacattacgctgagtgaaagaagccagccacaaacggaaagtgactgctaatgggtgcaggatttctttctgggagaagtaaaatgttttggtactacatggtggcacaactctgtgaatataatgaaactactgaattatacactttgaagaggtgaattttataatatgtaacttatgcttcaattaaatgagttttctatttcaattttagttaaaaataaatatgtaaattgagaaagtcaaattttggagggtcttcaacataagagacaggcaaagggaatgcccaggataataggaacatcccaggacagctgtgcagcagtcttggaaagtaacacttcaagattagaacagaagatcgaggattctgagaaagatgtctccaattcaaaaatgagttggtgttgatgagtttgaaaatattcaaaataattttataatacaatcagtttggtgacaaattagtgattagtacatagaaaactaaacagaaggaaaatgagaaaaactattaaatctagaaaagacaaaaagctaaacaagaaagaaattataactagagtacactatatgactcagctgtgattaatagctgcacagtcataatgtaaacacaaatacatacagaactaaaaactgagatacaatattggcaagagaggaagtctatgggtgtttgtgcacaggaggtaaaatgcattatcagtagataatatctaaaatcaaaaagtcaaaaatatcagtatagtcaaatatagtacatagaaatatggatataaaagccagaaaataaaaagcagctaaagcagttaaaagcattcatctcagaggggtaaatattagaagtttcatggatgaggcaggaaaagactgtttttattattcacctaagtaaactacttgatttttaaaaatacgtagatgatattattagaaatttgaattttatttcgtgtcatgtaagagaatgtgtactgtctactgaaagaatcgaaggttctctcattctcatattttctctctacctctctttaaccaagttcatgcacagtaagttctcgatgtcgtggataggttcttggaaactgtgacttcaagtgaaagaaaaacaagtttcccaaaggctggttgatatatacaagagttaggcctctatgtatatttctggccacaaaaacattacaaacttctaaacaaagaccaaaattcttccactataaaacactgaaataactgtgagctatacatccatttaagatagattaataaaaacaggcaaggtaattatttacccaattattccagatcagggtggtgggtgaccggagcctgttctgacagctcaaggccaaggtggaaaccagtcccggacgggacaccatcccatcgcagggtgcactcacacgcgcccacgctcactcgcactgggaccatttagacaagatgatcacctcacatgcacgactttggggtgtgggcgggaggaaaccagagcacctgggaaacccatgcagacctggggagaacgtgcaaactccacacagacggggtccccaccctggctgggaagccacgtttttgcccatcaatattataaggaaacaacattgaacaaaacgttattcgaggacctgctgtatgatacttttcaaaaaatgatacaagaaaatttcctaaagttaaagaagataattatttaggttgaaatggactactatatccctcaattttacatagctggttattatcacacatatctttaaagcccagttcagcaaaactaaattaaaaggcctaatggcgtgtttttttttttttctcttgaagggtctgccaacattttcacactaaagcagtttaactgtaagcaacacagagaaaacgcacacctctgacccttaaggttgtgcgcacgactgaggtttctccttctagggcaccagatggcacggatgcattgtgggggttgatttcaatgtgtgtggttcaatcttcggcaccatttctccaaattacccagtggccaagcttttagcatatgaacagaaaaacactagcaagccaggcgcagtggctcacacctgtaatcccagcactttgggaggctgaggcaggcggatcacctgaggtcaggagttcaagaccagcctggccaacatggggaacccccttctcaacaaaaacgcaaaaattagccaggcatgatggcgggtgccagtaatcccagctactcaggaggctgaggcaggaggatcgcttgaacccgggaggtggaggttgcagtgaactgagatcatgccattgcactccagcctgggcgacagggtgagacgccgtctcaaaatgaaaaaaaaaaaaagaaaaacactagcaatgagacttggtgtgctaatcatggatagttaagacttgtggatgtcaaagttctgctctgcaaagttttttttttatgttctgcatagtttgaaaatttatgttctgcatagtttgaaaacagtaaagtttatccactgggcaaatgccatactcatttcctgttaagagtacagagggtagattggaagaatagtgatacactttctaatgcattggttctggctctccattatctatgtatgtatgtatctatctatgtatgtatctgtcatctatctatctgcctacctgtctgtctttctctatatatatatcctcactcccaaggaaaccaaagatatatctgttgatcacatcattgtttaaagaagcaaaactaaaggaaaatgcttgtaaacattttgaattgctttgcatagttttgagataattggtgtcagaattttgactttctatatttgaaagaatgaaataaaaattttaaaaaaattaaaaagcagaaacggcctactaccgaacagccattcctccctcctcctttggaacagaacctgattgctttaggtcttcatgttcctggtgcagccccagccccagagcctggacctgtgttggtctacatccaccatgatcattctaatcagaagcctaggaagaggcatgtggcccagttctggctgattagatattagaaaagtctcccaggagagggtctgtgatggatttcttggttctcgaaataagacacaaggaaaagatagttccctcttctgctctggacactgcatggccagaatgtgtttcctgaactcaccacagccctccgcagctagctgacatgctgaagttggcagacagagacaatagggaaaagatgagacttgatggcaaggccctgggactgctttactttgggaattcttattatatgaaccaataagcctccatatgatttaagttgccatgaattggctgtttgattacttgcagctgaaagcatcctgaatgacagagatccacatctaaactcacaggatgaattttcagaatagccaggataaatctgaaaaaaaagaagaaaatcctaaaaagtgtccagaggggaaaaagacggatggtcctcaaaggaatgagaatgagataagccggaggctgagaacatcactagattcttgaataccatggagcagagctttcagagactgaaggaaaatggcttcaacataatggtccagcccaagtgaccttccagtgtgaggactcaccacagaagtttttggatatgagggaatttaaaaagttaactgctcatgcatttttttgggaggaagtaactaaagagcatactccagcaaagtaaggaaatgaaccaagaaaagggacaagaaagactctagaaaacaatagttttgaaccccaaagagccaccagaagacccaggactgcatttgaatagcaagcctggatattaaccattccactggagtgggaggtcagaaggctctggaaggaaggacctgtgagaaatgggctccttagagaacagcgtgcttgagacactgcaggaacctgaagtcacgacaaaggcaagcaacgtaagagggagaaatgaaaagcaaagggatgcagagtcgtgtatgatgcacctggtccaaattagtccaggatttggataggattcaagaataagaatgaaacagaccctgagcaattagaattttaggaagcaggaagctaggaggcatttgttgggtaaggtgaaagtttcttctatccaaaagaaaaacaagctgaacgtacaagatataatccagatttgcagcaaaccaaaatgtatcttgattttgagcaattgacagtgtgaaacaatcaattggaaatattttcctttcatgactcaaggacactgtcagttgaaccacacagaagggtatgtcattccagagcgtggcttgactcagcagtgaatagaatttgcagtgaaatcatgtcaacgttatattgcttgtctcttggcttttacctttgagaatcaacctacaaataaattccatatcaatattcatacattgataaatgttatccatcttaacaacatagaaatgtgttgacagaaactgggaagcagaactgggatgagtagaggcaataatgtcctcattccaccgagcaagaagcaagagacagagaccgcagttgctacagcaagaatgagcagagataagatgtttatgtcatttaaatatctcctgatttcagtggtaatgcttacaaagttccaccagtaaatatcatgtttcctgtggcttgtttgtttgtttgtttctttcaggcagagtctcactctgtcacccaggctggagcacagtggtgctctctgggctcactgcaacctctacctcctggttcaagcaattctcctgcctctgcctcctgagtagctcaagcaattctcctgcctcagcttcccgagtagctgggactacaggtgcctgccaccatggctggctaatttttgtattttttgtagagatggggtttctccatgttggccaggttggtctcgaattcctagcctcaagtgatctgcccgcctcggcctcccaaagtgttgggattacaggtatgagccactgcacccagcccctctggcttgatttttaaaaattttttttatctctgggacattttagttctacagaaaaaattaagcaaaaagagagagttctcacccctcgctaatttccccaatttttaacatcctgcattaatgaaggtttttttttttttttttgtttgtttgtttgtttgttttttacaaagggtgagccaatattgacactgtggattgtttctttaggttgagaaagtttccatacattattaggtttttgagtattttgatcagcctgggtgttaggtttttaaacttaagaaatgtatcaagatgaatatatttccccttaatatgctagcgaagtatgttaatagttttcaatgttgaataataacagtaaaaaataggattaatcagtagtgttcggatgttttggaggaaaaaataacttagatatatacctcacacaccacacccaaaagcaaattccaggtagactaaagatctacatgtaaaaatccaaaccatgaatgagtcagaggaaaatatagaagaatgtttttacaatcttgggatgggaaggccttactaaccaagataaaaggaaaagacgaggagattttattacataaaaatgtaaaatatgtttcctgcaccccatcccaccccccaagctgccactaacaaaaaggaaaaagataaaaagatcagtggggccaggcgcagtggctcacgcctgtaatgccagcactttgggaggccaaatcgggcagatcacaaggtcaggagattgagactatcctggctaacacagtgaaaccccatgtctactaaaaatataaaaaattagctgggcgcggtggcaggcgcctgtagttacagctactcaggaggctgaggcaggagaatggcgtgaacctggaggcggagctggcagtgagccgagatcgcaccactgtactccagcctgggggacagagcgagactccatctcaaaaaaaccaaaacaaaacaaaacaaaaatcagtggtagcctggggttgggggaggaagggatgaacaggtagagcacagaggattttgaggacagtgagactattctgtatgatactataatgatggatacatgtcgacattatgtgtttgtccaaacccatagaatgtacaatactggccaggcatagtggctcatgcctgtaatcccaacactttgggaggctgaggtggctggatcacttgaggtcaggagtttgagaccagcctggtcaacatgggaaaaccccatctctactaaaaattcaaaaattagcggggcattgtggcgcacgcctgtaatcccactactcgggaggctgaggcaggagaaccacttgaacccaggaggtggaggttgcaatgagctgagatcgtgtcattgcactccagcctaagggacagagcgagtgacactgtctcaaaaaaagagaatgtacaacaccaaggtgaactccagggtaaatgatggactcgggctgataatgctgcctcagtgcaggttcatcaattgttacaaacggaccactctgctggtggatgttggtaataggggaggctgtgcctgtagtgggagagggtgtatgagaaatctctgcaccttctgctcaattttgctgtaaacctaaaaccgctctaaaaaatagtttatttttaaaaagctaaaggacaggctgagataaaatattcaccatacatagtagacttaggattagcatgcataatatataaagaggctctgcatattggcaaaacaagaaacaacttattagaaaatggatgaaggatagaaacaggcaattcaccaaagaattccaactgcttgtaaatacgtgaaaagatgctcaatatcaaaatgtaagcaaaacactgagagacctatcagaatgctaaaaattaaatgggtggtatgtctagaaggcaacagaaaagggtgaatagtcagggagagtccacctcagaaaaccagggatgctgagggcttgccttgctgctccttgaggtcagtgctggctgtgaagggtgaggagcaggtctgtgtggttctgagtcttcccagcaaggaagacaggcgttaagctccaggtggtgggatcacagctgagcccaccatggcagctgagggtgacctagcattggtcacggatggatgacgtccatccatcagggtggatgacaaaggttggttaggacaatgggccccagcccttcccagcagcctcctctcacagcctggtccttctccctctctgcccccaccccatggcccttgccatcccttctggaggcagggaaccccacactccagctgtgtcccggctctctgcatccctggcccaccccatccccaacctccaccagagcagcatcagatggaggaaaagaaaaggggcaagaggaaagagggatgggaaaggaactccaatatcatttctttcctccgcattttgtcctgctaaagacagttttttaaaaaaataattaaatctgccgatataagttcattgggaaaaaaattaaggacaaatggaaaatgatggaccagtttaataatctgtggttaatcatattagcccagcaagtaacacaaccttgatttcattttatttggaggcttttggggttggaaatatgggtggttaggcttatccctagccccaaagctaactttttttttttttttttttttttgagagggagtctagctctgtcgcccaggctggagtgcagtggcagatcttgactcactgcaaaacgctctgcctcctgagttcaagagattctcctgcctcagccttttgagtagccagcattacaggtgcccgccaccgtgcttggctagtttttgcattttcagtagtgactgggtttcaccatattagccaggctggtctcgaactcctgacctcagatgatccacctgcctcttcctcccaaagtgctgggattacaggtgtgagccaccatgcctggcccagagctaatttttaatccagcaatgaggagggacaggtaaggatcaccccagggacagaggacgccatttgccagggacatcacttgcctccattctctggctcctacctctagctgcatcttcggggggcccggacccactctcctcactccctgcccctcttcaggtccttccatgagccctttctcttgccctgaacatgtcctgtttggtgataaataatctcccttccatccttaatcttttctcctgtcttcttctacctgttggtctaaaccagcctgatgtctccccagggtctccgtgctgggcagccttcttaaatggatatgttgcctccccgagtcccaggggcagaagcggggtccacatgtcttggagctgtgtgcagaacattgtttcacagtcacctctccaggctgtcctccatggacgtctacactatccattggtccgccctctccccgtcagcatcactgaggcacctctagacccagtccagttcttcctcacacagcacccttcagagtcccaagtcccctgggatgtgtctccccctcaagtccggtgacttctcctgcactattctcacgtggccccgtgatgctcagagctcactgcagtcccagaaaccaccctcagaggtgtatgtagaaacagggtaactgaaggcttgggtgtgcacaaagtcacctgggctggaggcacaggccctcagtgtggctttggaactggtcctcacactgcagaactggagctgcatctctgacatgacccagaagtggggagggggcggaggatcagcggcgggctccccatgcacagcctctctgcggaggaggctcaactgcctctcatgcccaggacgctggtccctcagtcgtgatccacaccagccacacagacgccctctgcctgcctcccacaggcatgacactgttgcctccaccgctgcagaaaaccaagtgccttcgccaccatctctgtggtcagagcagaatgaaagcaatcggagcaagacctcagcctcacctccctgtccaggtgacatgcatctggctgtcaggcccttactgacagcccagaggcaagtggttctgagaaacgtgggcttgaactttccagccccccagaggatatccccaaggatgctggagtggaggggcggtggtccaacatctgccacactcaccgcagtgcccacccctgccaggactcactcctttgaacccataaataactttgatcatatctcccaggaacgtgtatatatgtatatgtgtgtggggtacatatgtgtgtgcatgtgtgtccccttgtgtagagggtctgtgtgactgtgccaggggggagagagagacacacacacgcagtgatagagagagacagagagagagagaaagacaaagagcccacaaaggggctgtgcgtggggagccagcagctgaccccctgcccccctccccacttcttgatcatggttttaacctccttgaaggcaggagatagggatggactcacttccctgcacagagcaggaggctcagttccgtttgctgaatggcgcggctggaagtgctctgggggaaggaaatcaaagaatataaggaaacacaaagtggggaagggaactgactttcacagacagctgcatggcagttcatttagatggggtcaggttttggccatcaaaaaaagctaggaaaaaccttcctttcagagctctttgaccttcggaatcagagaaaagggattgtcagacgttgctgttttgagttatttctggtttcccacttaattctcacaggtctcaaggttgagcaactcattttataggagagaaaacggaggctgggccagaaggactgtcctgggattgtcgtggcaggtgtgggctgaatggaatggctaagcctcttccaacactgttcaaacacccctctgtggaggaagaactgggagtcgggggccagtgctgctgtcccggggaactccgaacatacaccccagatttgtattcaagactcatttgtcactcatgactcatttccaagtgatggaattccaactcacaatagcttataagtttaggggcaggtgggggacttattgctttgagtcatggggacttccaggaaagcacagcgcttcaggcatagctggacccagggggtgggcagcctgttgcccagcagctccaatgaaggcaatgactggcccagcttcgatggtctctccccatcccaaggagggtcaaattatctgactggctggatctgagtcacgtctcaaactctgtcaccagaggtggggtcagtgccaactaaaaggaaggagggttagcctcctaaagacagctggccagacaaaagacataccggcaaggccacaccacgcactcactaacttgagccccaacttggcctgacccccgcaaaggagagagggattctttctgagaccaaaaaccctttcccaggtggagcactcctctctagcagccatttctctccttaaccggaacatcacactcggcacgtctgcaagggcatattaaagtataaaagccacagaaacaaaattgaaaataaaatttatgaccctttttcgagccaatatcctaaagctgaccaagatagccaaccagatgtggtcccgtaaattgcgggagaagtgtaacgggcacttctatgaaagcacacacatagagggggactctgctcatttcctaggtccccggggaatggatgaagaatgtctcaaagatctcgcttcagacagagagaagaggtgcacttgccaacaatcagctcatctcttccttatttctgctaaactcgtcaaagctcgtctgtttcagctcctcgggccacctcagcaggactgttattgctacagaaaagttctgatacggcctgagaacttctgtttctctggcttagagatgtaggtggaggggcaaatatctgagtccgattctggtcaaggatgtgccattctttttcttcccttttaagtcttttatttgcatctattttatgctgaacttcttcccacgccgtaaatgtttgtttcttcagattcttctgggatacattttcttctgtgcaacctccttttctggcttgggaacaaattttctttttttcttcagcaaggatcacctcatgggagttcatgtatgggttaatcccaccgtgagttctgtaaatatggtggtgccaatatcttgggtactttgttcacctagacatgttcgttgaccagagaatttacatctaaacccttaagttcagcattactctctgcatttttaagcaggtgtggcaaaaattccatactcttttggatccttggtatctaatatcttgggtactttgttcacctagagatgttcattgaccagagaatttatatctaaacccttaagttcagcattactctctgcatttttaagcaactgtggcaaaaattccacactcttttggagccactgaccctgcatccagccctactgttggcctgggcacacctctcaactccaccatcataagacagaatgacacacattgcttcggttaagatacacctttcagacacttggtggctttccagatacacacacctgtcatggtctaggagtgttcttaaagtgaacacaaagatttaaaactcttgatgtgcatgattttgtgggggttttctgcgtcaagtgaacagtaaaccactttcacaggtcaccagagaccgcttataggcagagctcccattctctttagatgtaaccttctcctctggttggatggaacaggggccatggtaaaagttgcccacaagacccagaaatgcgtgcgtgagtgcatgcgcgcgcgcgcgcgcacacacacacacacacacacacacacacacccatggagagcctctccaacagagcagagggaagacaggacagactcttcacatggaaggctcagaacattccacagggcagtggccaactttccactatagcaggcctgtttcatgtccagctaacacctcttctctatcgtttcttgctaagagaatagtgtctgacgacaatgtgctcaggaacgaggagtgaattatgagtccctccaccagtgagttgaggggtaagggtagaggtgagcatgtgaccagttctggccaatgaaacacaaggataagtcttctaggaaattatggattcattttttaccctgattagagaggggcaagggggaaaatgttccatttttgctgtctccttttctccagctttgtgtgcatggcgtcaggcagtgctgcttcaagctgctgcaactatcagaccagagaatcccaaaaaagccaacttagaacgaaggatccactgtgaaactgcccacctctctgcttcctgataggttagataatagtacttgcatcatatgagatagtgttatattctgttacttgctgctcagaggtaccaacagctatactcatggttgcttctctgacttgagacagaactgggataagacgtcacaccagtgcccatcctacttacttggaattccactttagaaggctttccacacctgtttggagcattcaccatgtaactgatacatgccttgggctcacatctccacttccatccagacatgttagggataattcttgtggcagtcaccatggccttgtgtctaacactatttagcacaactacataattttgcatttcttttgctttttttaaaaattaaactttttattttgagctaatcataggttcttctgcagctgtaagaaataatatagaaagatacaatgaacgctttacccagtttcccccagtggtagcatcttgcaaaactatagtacaatatcacaaccaggaaattgatattgataaagtcaagatacagaacatttccatctgcacaggagtcctccatgttttacttttacagccacatatacttccctccagcccccacccccgccacactcagtccttaaaccctggcaattgctaattcattatatgttctccattcccataattttatcatttcaaggctgttacatagatagactcatacagtaggtaaccttttgggtttttttcagtcagcataatattcatcctggatattcatcctagtttttacatgtatcagcagttcactcctttttatttctgagtagtattgcatagtatgactgtaccacaatttgtctaaccattcactcactgaagaacacctgggtagtttccagttgaggctgttatgaataatgaaggtatgaacattcatgtacaaattattgtgtaaacataagtcttgatttctccaggataaatacccagaaacacagttgctgggttgtacggtagttgcacacttattttcttaagaaactgacaaactgttttccagagtgactataccagtttatactttcaccatctatgtataagtaatccagtttccctgcatccctagcaacatttggcattgtctcttttattttagccattctgataggtgtgcaatgatacctcattttggtttcaatttgcatttccctgatggctaatgatgttgaacatctttttatatgcttatttgccacctgtatatcttctttggtgaaatgtctgttcatgtcttttgcccattttctaattagggctttttttcttttttatttctctttcttttttttttttttaactgttgagcttcagaagttctttgtatataataaatactagtcccttgtcacttatgtggttagcaatattttctcctggcctgtagcagcttttcaactcttaacagggccttttgtaaggcaaaaggttttatcttttttttttttctttaagttctgggatacatgtgctgaacgtgcaggtttgttacataggtatacatgtgtcatggtgatttgctgcacctatcaacccgtcatctaggttttaagccccatgtgcactaggtatttgtcctagtgctctccctccccttgtccccgacccccaacgggccccagtgtgtgatcttgccctccctgtgtccaggtgttctaattgttcaactcccacttatgagtgagaacatgtggtgtttggtttcctgttcatgtattagtttgctgaggatgatggtttccagcatcatccatgtccctgcaaaggatattaactctttcttttttatggctgcatagtattccatggtgtatatgtgccacatttaggttttatctttttattaagtttaatttatcaatttttcctttatggttcgtgtctttgatgttaagttgaagaactctttgccagactctatatcctgagccaggcatggtagatagagcctgcagtcctgactgttcagaaggttgaggcaggaggattgcttgattgaggctgcagcaagccatgatcataccaccacactccagcctgggtgacagagtgagactttgcctcaaaaaaaaaaaaaaaagttttgcatccccaagatgttttcctatgatattttttctaaaagttttagttctacatttataactatcattcattccaacttattttcttgtataaatgagaggtctaactcaagattccatgtttttttaatgggtgcctactttatccagcaccatttatcaaaaaggctatcctccctccattgaatttttttttagagacaggttctcactctgtcatagctcactgcagcctcaaactcctgggctcaagcagtcctccagcctcagcctcccaagttgctgagattatagccatgggccactgagcccagccctctattgaattcttttgcatctttatccaaaatcagttgggcatatttgtgttggtctatttctggatttctctatttgattccatcaaactatgtgtgtatctctccatcaataccgtagagttttgttactgtatgttttaaagttgagtagaccaattcctccaattcattcatccttaaaattgtttcaactcttctagttccttcgcctttccttataaattttagaatatttatatctatgtatatatttattttttcaaaaaccttgctgagattttgatagaaattacatttagccaataaataatttggagagcataggcatctttactacattgagtcttccaatccatgaacttagtatgtcccttgatttaattagagcttctctgaattctatcatgagtattttgtagtttttagcatacaagtcctgtaagcattttatgacatttatgcctatttctttgtcttttttttagtgatcataaatagcactgtattttaagtttcagcatccacatgtattaatagtataaagaaataaaattgatttttgtatgttgttcatctttctatgtccttgataaatgcacttattagttctattttttttgtatatttcttgggattttctgtatagacaatcatatatgcaaataggaacatttttagctcctttttgatttgtatacattttatttccttttattaccttattgtaatggctaggacttccctactatgttgaataaaagtaagagtggatattttcaccttattcccaaacttagaggggaactattcagtgttattattattattcaactaagcattaagtataattttagctgtaaggggttttttttggtacatggtctttctccaatagagaaagttccttctattcttagttttctgtaagttttttttttaatcatgaaaaggtgttgatttttgtcaaatgctttttctgtaccagttgatacgattatgtgattttttttcttcagcctgttaatatggtggattacattaaataacttttgaatattgaaccaacctagcatccttggagtaagtccaacttgctcatgatttagattttttttctatattgataaattctatttgctaagagtttgttaagaatttttgtatctatattaaagcgggatgttaatctttagttttccctttttttaattgtctgtctggctttggtattagggtaatagcagctttatgaatcagtggagatgtgttccttccttttctatatttggaaagagatcatatagaattggttttaaatattatttaaatgtttggaaaacaatcttcagtgaaaccatgtgtgtctggagatttctttcttgggaatttttaatttaaaaattcaatttcctgacttttggttaccagtgcaacatctaaagagcttgaaagttgttattcccatctccacagcaaacaaaccaatgaaaacaccaaacaacctgaaaatcaacaattcttcttagatccatcagggaattgaagccacaggacaaactgccactttgaaaattacagtgacagatgggtattgaaatttatagctgaaatcaccttcctttccccgccagaaccttctaagaacacttaaagggtagctgactaagattgactgtagaccagcttgagagctaaactcctagaacctggcttagtgggccccacattctcatgagttttacttctaggagacataccagattctcaccagaaagattggagaaaatcccaaaatatttggtgattaaacaaattataaataatacatgggccaaacaagcctgaagagaaatattaaaatattttggactaaatgaaaataaaaacacaacttatcaaaattcacaggatgaagcaaaagtagttcttgggggaaatttatggtattaaatgcattatcagaaaaaagaaagatctaaaatcaataatctaaacttttaccatggggaattagtaaaagaagagcaaattaaatttaaagtaaaaataataaaagaaataataattagagcagaaattagtgaaattgcaaacaggaaaaaatagagaaaatcgacaaaatcaaagctgatttttttcaagatcaataaaattgataagactctaaccagggtaaccacaaaaaacacatcagcaatgaataataggaatgaataatatcagaaatgaaagagggatcatcactacagagcccatggacactaaaaggataataaaggaatattatgaacaactctatttaacttagatagaatggaccaagtacatgaaagatataatctatcaaaactcacgcagccaggcacggtggttcacttctgtaatcccagcaattagggagggtgaggtgggcggatccactgaggtcaggagttcaagaccagcctggccaacatggtgaaactccatctttactaaaaatacaaaaattagccaggcgtggtggtgtgcacctgtaatcccagctactcgggaggctgaggcacaagaatctcttgaacctgggaggtggaggttgcagtgagctgagatcaagattgtgccattgcactccagccttggcaacagagtgagactccatctcaaaacaaacaaacaaacaaacaaacaaacaacaaaaacacgaaaaaccaaccaaacaaaaaaactctcacaaggagaaaagtctaaataggcctatatctgcttaaaaaatggaattagtaactaatgacttttcaaaactgaaagtaccaggtccaggtggtttaatagatgagttctgccaaatatttgaggaagaaaagatttctataatctcttccctaaaatagagggagaaggaatacttcctactcattctatgtggacaacattatcatcataaccaaaacaacaaaagacatcacaagaaagaaaaactacagatcaatatcttacatgaacatagatgcaaaatcctcaaaaaatattagcaaatagaatccaacaatgtagaaaaaagtacatatattacaacacaattaaaaatgctcagcaggcctggtgtggtggcttacacctgtaatcctagcactttgggaggctgaggcgggtggatcacctgaagtcaggagttcaagaccagcctgaccaatatgataaaaccccatctctactaaaaatacaaaaataagccaggtgtggtggcatgtgactgtagtcccagctacttgggaggctgagagaggagaactgcttgaacctggtaggtggaggttgcagtgagctgagattgcaccactgcactccagcctaggtgacagagtgagactctgtaaaacaacaaaaacaaaacaaaacaaaactcacaaatgaggaggaatagagagagatgaacttccccaacttgataaggaacatattcaaaaagactacagctaatatcatacttaatggtgagaaactagatgcttttcttctatgattagaaaaagacaaggatgtcttttttttacaactgctatttaccattgcactggaagtcctaagtaatgcatgcaataagactttaaaaacagaatgaagataaactgattgggaaaggaagaaataaaactctctttgttcacagatgatatgattgtttatatagaagacttccaagaataatcacaaccacaatattcctggaactaataaatgattacagcaagatacaaagttaatatacaaaattcaaaaaagtattgtcctacatttcatcaaagaataattggaatttgagattaaaaactcaccatttatattagcaccaaaaatgaaattcttaggtataaatttaacataatatgaataatatctatatgagaaaaactacaaagttttgatgaaagaaatcaaagaatagtaaataaatggagagatattccatgtccatggatagaaagacttgatattgttaagatgctagttcttcctaactaaactttatctatagatttaatgcaatcccaatgaaaatcccagcaagttattttgcagaaatagacaaaactgatcctgaagtttatttggaggccaggagcggtggttcatgcctgtaatcccagcactttgggaggctgaggtgggtggatcacctgaggtcaggagttttagaccagcctggccaacatagtgaaaccccgtctctaccaaaaatacaaaaaaattagccaggcatggtggtgagtgcctctaatcccagctactcaggaggctgaggcaggagaattgctagaacccaggaggcggaggctgcagtgagccaagatcacgccattgcactccagcctgggcaaaaagagttaacctccatctcaaaaataaataaataataaaggttatagggaaaggcaaaagatgtggaataggcaacacaatattgaagaaaaaaaaaagtcagagaattgacactatccaacttcaaaatttactaaaaaagtacagcagtcaagatggtatgatatggataaaataataggcaagcagatgaataaaacaaaatatataactcagaaataaattcaacggaaatagttggaaatacattcaactgatctttggcaaagaggatcaaaggtaattcaatggagaaagggcaatcttttcaacaaattatgctggaaaaaactggggacacacacaaaatgaatctagacagagatcttacactctgtctaacacgctgttttagcttaaacaaaagctaactcaaaatggacgagcaaaactatataatttttagaataaacatagtagaaaatctaggtgactgggtttggcagtgactttttagatataacaccaaaagcacaatccatgaaagaaaagatttataaaattgatttctttaaaatttgaaacttgtgttctgcaaatggcactgtgaagaacataaaaatacaagccacagacagtgaaagctgataaatgacatgcatccaaaataaacacacaaacaaaaaaaattaaaattcaacaataagagaacaaacaactcattcaaaaagtgggcaaaaactctgaacagacacctcaccaaagatggtatacaaacaacaaatacgcgtatgaaaacatgctcaacatcatatgtcattagggaattgcaaattcaaacaataatggggtaccagtaatcagtaatttggccagaatccaaaatactgacaacagcaaatactggcaaggatatggagcaatgggaactctcactcattgctggtggaaatacaaaaaggcacaaattcggaagacaatatggcagtttcttacaaagctaaacatagtcttactatacaatcccacaatcatgctctctagtatttacccaaatgaattaaacattttgtctatacaaaaacctgcccacagatgtttataccagctttattcatacttgccaaaatttggaaacagatgtccttcggtaggtgaatggataaactgtggtacatctacacaatgtaatattaacgcagcattaaaaagaagtgagctattaagccatgaaaagacatggaagagacaaaatgatgcatattaccaactgaaagaagccagtctgaaagggctacacactgtatgatttcaactgcatagcattctggaaaaggcagaacaatggagagagttgttaccagggggccaaaaaatatatatattgaataggtggagtacaaaatttttagagcagtaaaactgttttctatggtaacggaacggtgcatatatgtcattacacatttgtcaagatccatacatgtagaataccaacagtgaattttaatatgaaatatggacttttagtaataatgatgtctcagtgtaggttcattgattgtaacaaacctactattttgatgggtaaggggaggagacggtcacagcagaggaggctgtggatgtgttatgagacagtaaatatacgaactctctgtacttgctactcaattttgctatgaacataaacctgctctaaaaacttgtcgattaatttttttttaaaagtcagtttcttaatagttacagagctattcaaattatctaattaatattgggtgaatcgctatagctggtacatttcaaagaattggtctatttcatcttagttgtcaagtttgtgtgtgtaggattgtttgtaatattcttttatttttattttgatatctgcagtctgtactgatatctactctttgattggtattgattgattttctatagattggtattgattgatattggtaatttgtctcttcccttgttagtcttgttagagatgtgccaattttattgatctttatttcatctttttggattaattttattgattattcagttgtttatttgaaaaaaatctatttattgtttttttcaaagaaccaacttttggtttattcgatttttctctgtatttttctgtcctcacgtttatttatttctgctcttatctttattatttccttacttttacatgctttggctttattttgctttttttttctagcttttgaagtgagagcttagattattttaagacatttcctcatttctaaaggaagcattttgtgtttatatatttgcctgctagttatttagctgcatcccacaaattttaatatgtcgtattttcatttcattcagttcattgtttttgggttttgtttaaattttccctggtagcttcctctttgatccaaggattatttgaaagtatgttgttcaatttctgagtatttagacattttcacactatctttccgttattgatttctagtttgattccactgtgcttgaaaaaaacaccctgtattatttcaatcttttatttactaagtttttattttaataggccagaatatgatctatgtggctatatgttctgtgggcactagaacgatatgtattatgctgttgctgggtagagcgttctgcaaatgttagagatcctgtcagttgatggtgttgttgagttcttccatgtctttgctaattttttctctagttgttctatcaattgttgagaaaggggtattgaaatctccaaatataattgtgggtgtgtgtgtttctcccttagttctatcagtttttatttcacatatttttgcagctcttttgtttggtacatgcacatttaggattgccatgtcttcttgttggattaacccttttataactgtaatttccctgtctgtctttggtaattttattttctctaaagtctactttctttgctatcaacatagccacgcctggtgtcttttgttgatattgcatgcaatatctttttccactcttttactttcaacctacctgtatcattaatttgaagtgaatttctttttgagaacatgttattgagtcatgttttctcatacattctgccaatttgtttcctaatcaatcatcacatcatctacatttgacctaagtattgatatgttggggtttttatttttcatttcctgttacttctgttttactttctctgttttcttttatttcaaaaggctttgggggaacagatagtgtatgattacatgaataagttttgttttttttttttttttttgagacaaagtcttgctctgtccccaggctggagtgcagtggcgtgatctcggctcactgcaagctccgcctcccgggttcaagcgattctcctgcctcagcctcccgagtagctgggactacaggcgcccgccaccacgcccggctaatgttttgtatttttagtagagacggggtttcaccgtgttagccaggatggtctcgacctcctgacctcgtgatctgccctcctcggcctcccaaagtgctgcgattataggcgtgaaccaccacgccaggccatgaataagttctttaggggtgatctgtgatttctgagattttggtgcacccatcacctgagcagtgtacactgtacccaatgtgtagtcttttacccctcagcccctcccactctttcccccaaatccccaaattccactgtatcattcttatgtctttgtgtccccatagcttagctcccacttgtgagtgagaacatacaatatttggttttccattcctgagttacttcactcagaataatggcctgcccttccatccaggttgctgcaaatgctgagcatgtctatggctgagtggtattctatggcatatacataccacatcttctttatccacctgttgactgatggacatttgggctgattccagatttttgcaattacaaattgtgctgctataaacatacgtgtgcaagtgtctttttcgtataatgacttcttttcctctgggtagatacccaggagtgggattgctggatcaaacagtagatctacgttggttcttaaggaattgccacgctgttttccacagtggttgtactagtttatgttctgaccaacagtgtaaaaatgtccccttttcaccacatccacaccaacatctatcactttatgatttttgattatggccattcttgcaggagtaaggatgacattgcggttttgatttgcatttccctgataattagtcatgttgagcattttttcatatgtttgttggccattcgtatatcttcttttgaaaattgtctgttcatgtccttaacccacttttcgatgggactgttggtttttttcttgctgatttgtttgagttccttatagattctggatattagtcctttgtcaaatgtatggattgtgaagactttctcccactctgcgtgttgtctgtttactctgctgattatttctttcactgtgcagaagctttttagtttaattaagtcccatctatttatctttgtttttgttgtgtttgcttttgggttcttggtcatgaactctttgcctaagccaatgtctagaagggtttttctggtgtgatcttctagaatttttatggtttcaggtcttagatctaagtctttgacccatcttgagttgatttttgtataaggtgagagatgtggatccagttgcattcttttacatgtggcttgccaattatcccagcaccatttgttgaatgaggtgttctttccccactttatgtttttgtttgctttctcaaaaattagataactgtaagtatttggctttatttctgtgtgctctattcagttccactgatctatatgcctgtttttataccagtaccatgccattttggtgactatggccttatagtatagtttgaagtcaagtagtgtgatgcctccagatttattctttttgctaagtcttgctttggctatgcaggctcttttttttttttggttccatatgaattttaggattttttttttctagttctgtgaagaatgatggtggtattttgataggaattgcattgaatttataggttgctttttgcagtatggttattttcacaatattgattctacccacccatgagcatagaatgtgttttcatttgtttatgtcttccatgatttctttcagcagtgttttgtagttttccctgtagaggtctttcacttccttggttaagtatagtcccaagttttgttttgttttgttttgttttgcagctactgtaaaaggggttgagttcttaatttgactctcagcttggttgctgttggtgtatagcagggctactgatttgtgcaccttaattttgtatcctgaaactttgctgaattcatttaccacttctaggagctttttggatgagtctttagggttttctaggtatacaattatgtcatcagcaaatagtgacagtttgacttcctctttactgatttggatgccctttatttctttctcttgtctgattgctctggctaggatttccagtactatgttgaatagaagtggtgaaagtgggcatcctcgtcttgttccacttctcatggggaatgctttcaaatttcccccttcagtataatgttggctgtgggtttgtcatagatggcttttattaccttagggtatatcccttctatgccgattttgctgagggttttaaccaaaagggatgctggattttgtcaaatgctttttctgtgtctcttgagtgactatgtgcttattatttttaattctgtttatgtggtgtattacatttactgacttgtggatattaaaccatccctgtatccctcctgtaaaacccactttgtcatggtggactctttttcatatgctgttggattcagttaactagaattttgttgaggatttttgcatctatgttcatcaggggtatttgtctgtagttatttttttttgttatgtcttttcctgattttggtattagtgtgatattggcttcatagaatgtttttggaggattccctctttctctatctttggtatactctcaatagaattggtaccaattctttgaatatctgattgatagaattcaaccgtgaatctgtctggtcctggacttttttttttggcaactttttaatcaccatttcaatctcactgcttgttatttgtctgttcagagcttctgtttcttcctggtttaatctaggagggttgtatatttccaggaatttactcatcttctctaggttttctagtttacacacataaagatgtttatagtagccttgaatgatcttttgcatttctgtggggtcagttgtaatatctccccttatatttctaattgggcttatttggaatataagtcctcttctctcttcttttcttggttaatatcactaatggtctatcaattttatttatcttttcaaagaaccagatttttgtttcattttttttattgtgttgtttgtttcaatttcatttagttctgctctgatcttgattatttattttcttctgctgggtttgggtttggtttgttcttgtttctcttgctcctcgaagtgtgaccttagattgtttattcgtgctctttcatgctttttgatgtaggcatttaatgctatgaactttcgtcttagcactgcctttgctgtatcccaaatgttttgataggttgtgtcactattatcactcagttcaaagagcttttaaatttccatcttgatatcattgttgacccaatgatcattcaggagcaggttgtttaatttccatgtatttgcatgattttgagggtattaaaatataaggtactattctattcatcatgctatttgttgcctgaataccttgtttttttttttttcattgtgtcattgttttataggtcctgtgagatttatgctttaaggagattctattttggtgtattttgaggatttgtttcaagatttagagctccttttagcagttcttgtagtgcaggcttggtagtggtgaattctctcagcatttgtttgtctgaaaaagactgtatcttttcttcatttacaaagcttagttacatcagatacaaaattcttggctgataatttttttgtttaaggaggctaaagataggaccccaatcccttctagtttgtagggtttttgctgagaaatctgatagattttcctttatagattacctgatgcttttgcctcacagctcttaagattgttttcctttatcttgactttagagaacctgatgactatgtgcctaggccagtatcaccctaataccaaaatcaggaccagacataacaacaacaacaacaaaactacagaccaatatccctgatgaacatagatggaaaaatcctcaacaaaatactagttaactgaatccaacagcatatcgaaaagataatccaccatgatcaagagttgcaggatggtttaatctgatgatctttttgtgatgaatttcccaggcattttttgagcttcttctatttggatgtctagatctccagcaaggctggggaagttttcctctattccctcaaatatgttttccaaacttgtagatttcccttcttcctctggaacaccaattattcttaggtttggtcatttaacataacgccaaacttcttggagcccttgattatttttttaaattcttttgtctttgtctttgccagattgggttaatttgaaagccttgtgctctggctctgaagttctttcttctacttgttcagctcccttgttgagactttctagtgcattttgcagttctctaagtttgtcctttatttccagagttgtgattgttttttatttgtgctatttcactggacatttttccattcatattcagtatctttttttgatttctttaagttggacttcatctttctctggtgccaccttgattggcttaatggttgaccttctaaattctttttctggcaattcagagatttcatgttggtttggacccattgctggtaagctagtgtgatcttttgggggtgttgaagaaccttgttttgtcatagtataagaattgtttttctggttccttctcatttgggtggactatattgggagaagatctgggactcaagggccactgttcagattagtttgtcccatggggtgctcccttaatgtgctgctttccccttttccctagaaatgaggcttcctgagagccaaactgcagtgcttgttatttccttctgaatctagccacctggaagagctactgggctctggtctggtactggggagtgtctgcagagtcctgtgatgtgatccatcttcaggtctctcagtcacggataccagcacctgctctgatggaggtagcagaggagtgaagaagactctgtgagggtccttgtttgtatttttattaagtgcactggttttgtgatggttggcctcctgccaggaggcggtgctttcaagatcgcatcagctacagcagtacagggaggatcaggaggtgggtggggccatagagctcccaagatatattatgtcctctgtctttggagttcctctgctgtcccacagagccttcggctgcaatccatctccttcaaagggtctgtggattatctcagctctcctggaatgttcctgcagtagttcttcgagtcaaagttcacgatgtgggtctccacacactgctgtgtccatccaagtgggagctgcaagttagtcctgcctcctatctgccattttccctcccagatccccagtgtctctgctttcattttcctgctttctagtgagttaagcaaacattttttagacttatatttttatttacctatagtgtttttaagtgaatcttttttttcctctattttagtgaatatctgtatggttttttaagtggttgttttcggtattaaattatatatacataacttattattctactgatgtcaacattttgccaatttgaatgaagtatattaatcttaccttcccttacatctctctgtcctataccacttatagtataagtaactatttcttctatagcacatttaagacttcatcaatgatgttataatttttatttcaactctcaaacataatttagaaaactcaagatgtgaagaaaaatgtagtatatttaacctcgatctccactcattccattgttccttcttctttcctgatgttctaagatttcgtcttttatcactttctttgtttgagattttcctttagccactctcttatggtaggtctcctggcaacaaattttctcggttctcatttatttgataatgacttgattcccccctaattccttaagggtattttctctagatatagaattttgggttggggcctaagagatcaaaatagatgcccctttatcaactaagatggaccccaaggttaaggtgagttaccttcaggtcgagggtaaaaggctcagctggcatgggaactttctcaattcatgcaaccacaagaaaatcactcttgctaaactccctaacaataggagctatggggcaaattctcaggcccttcttaactctgatttacaatccagaccactacaactttgaatggacagaagactggccttacacacattatttcctgataagcaactgcagaccttaagcccatttcagcagcttatagagactgcatacaaatggtgtttgctccctatacttcacctttggatgtaaagagccaaattccaccctattttaatgctaaaagcctgccccaaagtgaacatgggatatatattacatatgtgtttacctattgcacatgtgcccaacttccctcattaatatgaacggcttttcccctaaatctgctgaatatgtttgactctattgtgtgatacaggctctgtaagacataaaacctaaccttcccttttcctcttcaaagagagagcaccttcagtccacaccagagactgtctcttcccagtttacaaattggtatcgccaataaagctgtcctttctaccatgtatagccatcctgggtggtctttgcatgacagcgttggcagttcttttctttcggcacttgttaaatgttgtgccacttccttctagctagcctccatggtttctaatgagaagtgttcttttttagattgttttttttctctatagataagatgtttttctcttgctgctttcaagctttttttctttgtctttagtgttcacaagtttgattatgatgcatcttggcatggatttcctttaatttattcgttttggagctccctcagctttttgaatctgtattttgccaagtttctgtcttttgccaagtttgggttttttttttttttcagcagttatttcttcaagtgcttattaagctacacccctttccctttctttctgggattctgataacacaaatgttagatcttctattacacagtcctccaggtcactgaaacgatgcttacttttttgcagtcgactttgtccctgtggtttggatttgggtaatttccattgttctgtcttcaggttcaccggttttcttcttctggaccctccattctgctgttgaccccatccactgagctttttattcccaatgccctatttttaagttcttttttttcttccatttttttcttcatgtcttttctttcttgagattttccatttcttactgagactttttcagttttcactcatttcaaatgtgtttgtaattgctcattgaagcatttttatcatggctgcttgaaaaatctttgtcggataattctaacatctctgtcatctcagtgttagtgtctattgctttttttttcatttaagttgagattttccaggttcttcatataacaagtgattttcacctggaacccagacactttgagtattatgttatgagggcttgaatcttatttaaaccttctgttttagctggctttctctgacactactgcaaatgaagagaagtcactgccttgttattgtcaagcgcagattcccttctggcctccattgacactgagaagggaaaagactccttgttactgctgggcagtggtgggaattccagctgcctactagccctggctgggaggggcaggagtgtttcaccactgttctccacgtggcctctgctgacactgcaggtgggagggggtgcctcataactgcttagcatagatgaaagccccagcttcctgcacagccgtctctgacacctctgcctcacgggagctggagcaccttgctctgcagcctgatgagggtggaagtctaggctcacccattcagcatgggtggaaggtgccaaggtttttctgtagagtttggctggagcagcagtcatggactaaacgttttctgtccttctaggcttcccctttcctggtcctttgattaaagagagaaggcttttgttgtttttgttgttgttgttgtctgtagccattggtgtttccagtttgcctgcttcttcaagctccacgtctgagacatgtgatacaaaaggagagcccagggaactcatcatagtcattccctgggtcctgaggtccctggtccattgccttcttccctcaatcttttggagtcttcttatgctgcttttattaataataacccatgtttttcattgcacttagcaaaaggagtagggatagtatgtctatgccatcttcctggaccatttggattttcaggtgtgaattttcctgtatctacccaggattgggtacctaagttgatttatcacactacaaagaggctgctctttaaatatattgcagatctccacgaccacattatattgctttgcttctgaggagaaattgcagggcagaaactatccaaattttactttagagttaggatacagcaccatgacataaaacccatgaaaacataagacaacttactgagaatttcagggtactaaatcaactctttgtggtttgattcttacacaagtctcagaacaaattgctgtattaaatattattattatcattattattttggagatagaggtagaattacagtgatgctgatcatgtttcagaaccccccactttcatgggcctttccgaatccctagttcacatggttacacgttatacaatctacaagaataacggattttatttgtagttggttgtgactactttttgttgccattctgatatcctctctgtcatatgtcccctcttgttgggtaacttttgaagtgactatgtacagttggggcattcattaaggggaagggagcaggggatacatttaattcgggtttaatgagatgtgtttatgtgattcatactcatttccatctatagttaaattattggaagttatctggtataaaaatgtttcaaaatttccttactgcccactgtgttgacttgctgggcaatgtagcaagaaaatattgatgactaattggataacaaatattatcagttcaaagtttatttcaggctgggcgcggtggctcacacctgtaatcccagcactttgggaggctgaggcaggccgactgcctgagctcaggagttcgagaccaccctgggcaacatggtgaaaccccatctctactaaaatacaaaaaattagctgggcatggtggcgcgcatctgtaatcacagctacgtgggaggctgaggcgggagaatcacttgagcccgggaggcggaggttgcagtgagctgagatcacgccactgcactccagcccgggtgacagagtgagactgtctcaaaacaaaaaacaaaaaacaaaaaacaaaaacaaacaaacaaacaaaaaacatatatttcagattggccattgctcaagtgtcctgaaatctcacagctcagatatctcagaaactggataaagatttctctaaatttgaaataatacaaaactttacatgacattttgttaatgacaaggtatgaagctgaaaagttttctaaactatcaataaaaaaaaatcaaattttaggccaggcatggtgcctcacgcctggaatccaagcactttgggaggctgaggcaggtggatcacctgaggtcaggagttcgagaccagcctggctaacatggtaaaaccccatttctactaaaaatataaaaaattagccaggcatggtggcatacgcccataatctcagctacttgggaggctgaggcaggagaatcatttgaacccaggaggcggaggctgcagtgggccaagatcatgccattgcactccagcctgggcaacaagagtaaaactccatctcaaaatcaatcaatctatcaatcaatcaaattttaatgaatagtgttaaaggaaagcctcatttatcttttaattctctctatagaaaatgccattgcaaaatattgtcaaaagcataagaaagaagtgtcctagaggtatgttaaagtagaaaattaatttttaaaattttataagatatttgaggtttaaaatttataatttcttgtgatttattttctcattaaatattcacctttgtatatagttttgtttgtaaaactttatattcttttactttgtaggatctttcaacgatagaagcattgggccccacacagctggatctgctcatgtggaggcctttctttgggtccgtagacatccatggcactggccaggggcctggttggaaccaacagaagccaatcaatttggtttcagcaggaagggatttattgattagtttgagaaatctcacagttctgtcggggaggattgaaggactcagctctgggctgtgcctcgaaccacagaatggcaaagctggccttactgccctcaaggccaccctgcctccaccatgctgttcctgcatcctccacatggatgcccaccctgtgtggtgcgtcccggaccccattctgagccacagactcacatggtgtctgatgggcaggtgccaaatcaggctgggaaaagatgtcagtgtgaaaggcagggttgacaaagtggggggttgggaaaacgtctagaacacttgtaaaaagatgataggcctccctactgaccaatgtccactacacctactacataacaaggatcctctgagttccaagcacagacaggtaaggaaggcagagtcccgacttccagaatgcccaggagcatgggtcagacagagtggtacccagacaccccaaaggagagcgtaagggttccagccacaggcgccatactcagactgtgacttatgggaagggaggaccatggattggtgattttccagctgattgatcacgagagagtagagtcaagggttggcctctctggcaccagagcagaccatctccagcttagagttactgttgctgctgtggctactgcctcgggaattctcagtttctggtaaatgttacattccatcacatttgcaaaaaagaagagagatttaaaaacctaaaaatataatatataccaaacagcctcttcttccctcacccacataggcacagaatataaattaaggtgttctttcagagtttctaaatttgtatgtatctacaggatcaaaaaatgaaaggataactaaaattttatttcaaaaatacaatctcctagcagttgaaacataaaacatttgttaggaacgttccttctgtaatgcaggatggggagagaatgcataaaatagtaatgattatttcaaatataaagaccacgaagacagaaataggtagaaagatgctgctgacccaacttgatattgaaaccattttccctggtgctgggatatcatctgctttggaaaagggccaaagaaagtggcattacgttccataatatacatgacaggccctggatgcttatcatgtctgttgtttggaaattaaaagtctaggtgtttctgagacattctgatttttcaatcagtcacacccattggcccctaaggcacctgccagattccaggttcagatatttggtctggaaaatgtgatcactataacttagaggtaagcaagaagacaatggatttactgagttattactctacaccagaccccaagcattgcttttcatgaggcatctcactccctcctctttgccccactgggaggtggctacaatgacaacctggcttcccatttcagtgaagagacagacaccatcagaaagtgcttctgcaagccccctctaccccttctatgccggctcatcttcccacccatccttcccacctaaagccagccctctgcctatgcaccagacattggcttctgcctactcaaggatgtgtccagcagggcttgcttctctcgcctgcattgttcatttcccctttgcaggatcattcccatcagatgcatggatgaaacctagatgccccttcccccagtcctctccggctactgcttctcgttcccctttacagcataactgaggaacatgaaggagcattattctcccagtcctctcctccagcataaactgagcccacactagtcagcttccctcaccctcctcatcccatggaaatagctctagtcaaagtcactacatgcccctccactgccactcctaatgtcaactctcagtccttatctcacatgactcattggcaccatgggaaccagttggtctctgcctcctacttaaagcactttccccaggaggctcccaggaccatgtactcttccagctctcttccagacccacatccattcctcaggctccttagtcttttctcctcagctcccaggcctcttgatgtcattgcaccctggctcaagttggccattttctcccctcaattgcagtacccctgaggctttccatccaccatggcagtgagcttggaagtgtgttctccccaggcaagccttcagatgagactgcagcccccgccgacactttgattgcagccttgacaggtgagagaccttgagtcagaagcagcaagcaaagccatacccagattctcacccagaaaaactgagagataataaatgtttgtgtttttaaagttttagagtaatttgttgcatagcaatagataatacattcttctatgacctacgctttgccctgtttaagcttcgaagctttcccaattctagccttctggcatctagaggataaatctgtgccttcctcagtaggttcccagaatataagagaagtttgattttagaaagatgataatttcttctggctgagtgtggtgttttatgcctgtaatcccagcactttgggaggctgaggcagaataactgcttgagaccaggagttcaagaccagcgtgggcaacatagcaagatcctatctcaaaaaaaaaaaaaactaaaaaattaggcatggtagtgtccacctgtagtcccagctattcaggagacagagacatggggatcatatgagcctaacagttcaaagctgcagtgagctatgatcaagccactgcactccagcatgggcaatagagcaagacccagtctctataattttttttttttaaaagaaaggtgatcattttatataagcaattttctccatgtgttatgttattaaagatttaaactggactcagagttcagcagaggggaagaatcagtgtccactaatgtcctgttttctcttcctgcatgatttgcggcaactttgaaaactccctttttctttgtgtgccaaaaagtctggcttctcagcctcattcccaagcggccttctctgggttatggaaggaatccacttgcctctggaggagggctacgcaaagatgtccacctcctcacatatcttgtaggaccatggcatgaggcagagccctggccaagtactccacgaaccagatccagctgaagtaattattgcattccaagatccaaagtgtatccagccatgggaacaaaagcttcatcttatgttccagtgggactggctgcttgcagtgctctgcggagaaggatgtaaaggccaagttcacactctgtgggaaagaatgccatggtcagtgatcagctagtgatgtctgtcatgatcacagggatgggaagtggaggcaggctttccactgatgatgctccctccattccttacaaaatctttcccccttgtcctgaaggccttttgaataagctctgcatccagttgtgtctaggtacttttaaaaacagaaagggcacaatcggaaatggcagcccaaggcccacccaaccccaggttaggtcccattgatcttgtcaactgttcattcaagaaaagaaaggcggctgagcgtggtggctcatgcctgtaatcccagcgctttgggaggctgaggtgggcagaccacctgagatcaggagtttgagaccagcctggccaacatagggaaaccccgtctttactaaaaaaaaataaaataaaaaaatcagctgggtgtggtggtatagacctgtaatcccagctactcaggaagctgaggcatgagaattgcttgaacctgtgaggcagaggttgcagtgagccgagatggtgccactgtgttctagcctgggcaacagagtgagactccatctcaaaaaaaaaaaaaaaaaaaaaaaaaaggaaaagaaaggaaaggcaggccagacgagaggtccaggaagtcaggcaggaagctgcaggtttgtgttgggtgggaacatgggggtgatagtaacccggcatagggcagccacaggcagtgaagacagagggaacaacaaccccccatcgatggattgtactgggaagaaatgcagaaaactcacagcctcatcttccgctgaaacacaggcatcctcggaggtggttgatccagatccatttaaccatctgtggatggaggtagctgaccacggtgggtgacaggctcaccatagagctcgggactgcaaggtccaccctcaggtgcaaagagcactttaccttttcgggggccttaggctccctctacctccctactggaaataagtattaagcagtggtgggctgataaatgctcaacagctggccctctggagggaaagattgtgtgtgtgtgtgtgtgtgtgtgtgtgtgtgtgtgtgtgtgtgtgtggggtgtacatacacatataaatgaagagataatttattataaatgttactgatataaagaatgtacaacaaaacataatgatacaatatcctttattataagctgcatatagttggttgatcctcacagaatgcctttgttgagtttttccaaactcttgtatctacagcctatgtctgtttgcatatgatgactaagtgtgctttacacatgagggttggctattttcatttcgtttcattctcatgaggctgatattttcatttatgttaacaagtaaaagtgagacaatgaaggcgaatatcagaagttcacttattcatcaatgtcacaagtgacttccttgctgaatcaatcaggccacagtttttaagcactggaagaataaatcctcaatttttttgcttgtcacaatataggggtgcatcagtgtagtaggttaaataatggccctcaaataatatacgcagatctgaatctatgaagcctgcaaatgtatcttatgtggcaaaagggactttgcagatgtgattgagttgaggatcttgagaaggagacattatcctggattacatgggtgggtcccaaatgcaatcacaaatgtcctgataagagaggatagagggaaatctgacatagaagagaaggccatgagaagacagcgtggagagaattttgaagacgctaagccactgcctttgaaggcggaggaaggggccacgagccaaggaatgcagctctagaagctggaaaaggcaaggaaacagacccccctggagcctctggagggagcggccctcatggcaccctgattccatcctgctgaaactgatttgggacttctgacctccaaaactgtaagagaacaaatgtgccttgttgtaagcaccaggtttttggtaatttgttacagcagccacaggaaactcacacaggcagtttttaatctattgcatctcagctctgaatgcacctttcaatatgtgctttaggacaaagattggaaccttttaaccattttgaatttaaagtgaacaggatgtgaagctttctcagtagacggtgctggaaggactttcctgtaatttccaggaaggtcagccaagcggagactatcccgtggagtcggacggagcctcagagccagaacacaatgactctgtggccatgcctggcggtgactgtctacacagcagctggcctccgacctcactacgcagcctgccacttcctctgcaacctctccacccgccaagcaacctcagcacccagaaggccttctgccctgggggcactcagtttcccactgcagttcacgcctttggttactaatcacctgttccctgcctgccctccagagggtgcctattgtgtgtccaccaactccaaaccagctgtagctgtgtgctctgggctaaacttcattgctatccagtggctgaaccacaccctctccagctatgtctgaaccccaaacaacttcatttttactttgggagctccctcagccctaggatactgcatagagcttctttttatcttactctttttttttgagacagagtcttgctctgttgcccaggctggagtgcaggggtatgatctcggctcactgcaacctctgcctcctgggttcaagcgattctcctgcctcaccctcccgagtagctgggattacaggcacctgccaccaggcctggctaatttttgtatttttagtacagatggggtttcactgtgttggtcagcctggtctcgaactcctgacctcatgattcgcccacctcggcctcccaaagtgctaggattacaggcataagccaccgcgcccggcctatcttactgttttacaactgttaataattttaacttaaatttcccctgtttaacctgctgtgtgatttctgtctcccgattagagccagactgctacaaatggccccagacatgacccacttataagttgaatctgtactattaacaattttttattactttcttaagcctagaaaatcaacaaaacaataacacaagctctgatttgcagtgtttgccaacttccatggtgtaaatactcctatcatggccaatcccaagctttcaatgtgacgtcacagattgtgggcttgggaagagatgcccagtagctgtcactatatactcttcccacggcattgatataatagatgcaagtaaccctcaaagcatagaaaatagcaaaagtagtaaaactcattgggaaggggtgtttgttaacatatttgattataagttcatatgattaattgtgaataatgcctatatttacaactggctcacaaaatctgagcacatttaacgcttggttctattgaatgttacaagccagctccagcacagcactgggattaagggcccccagcaacaaaccagggggagctccgcattctttgggcaattgctggccccctctggcatcaagacaggtctccggttcagcctgtggcattgagatggggcggtggaggggggacagaggagagggtgcaggcaagagtttctctgttgcaggattcactcaggacctcccattgctcctgttttctgccctgacgttgatgccccttcatgtcctggcccgaggatggaggcagcagccttcccctggaccctttccggcacggtcagacctgccgtttgccatgcatctgagagtccttgaggtcatggcagccgctcttttgcccccacttgaggtcattgaaggagagtgagggaatggctgtaggtatggtggtcagcgagtcaggagtctagtcccgaccttactcctggctggtggaaagactgggggccagtcggtcacgctcccaggcctgaggccccacctgtgcggtgagggtgggcctgatgccactctgaggactgatgaccctgaggcttcttccagctccaggatgaagtcctgcctcacgtccaccttaatggcaggcacagtgatgccacctcccaggatctggcagctgcaggggcatcagcaggtgctgcggtcctgctgggatagcctatccctgggaactggccccagacgctgatctcaggacctgccatcagatagctcagccttcgccaagagaaaacaaaatgcaggcaggtcatctgatcttccttttccactttcccagggaccaactagcctttataataaaacccagaggagacagtcccttcccagagataaaacccttcccaagccgtccctgctactagggcaacgctgggcgctgcgcggctggcagggagccccaagagctctctgccaagggggctgggctggtggggccgaggtcccagaggctgcctgcccagagcctgtgctaatgagggaagagggctacactccgctttggagcacctctcaacagaggggacaccttggggtcgggggtcagcatgacggatgtcttcaaggttcagtgtgcagacaggaccaacctctcccacaagcaagatgctaagggaagaccccagaaacagcaagtgcaggacatgtgagtatgggggtgatgcagagagcctcacagtacccaaggacagggtcggaaagacctgaggtgagtggaccgccctggcctgggaggcagcctgtagactgtggggccagtgacggtcccctcctcccaggcgcagtcctccccttcctgcgtcaccctctgcacacccctctccattcctgctgtcatgctcgggccaacgtcccaggtctaactagtgaagcctttgcaagctccacgctgcactcttagagagatcctactcaaaagcagggctcagagtggactttcttagaagagactctcttttctctgactgcccttcaccagtgccctacccaaggctgcccccgccctgcccccacttgctcattttatcacctgcccctcctccccactgttcctccaggcctcaaccaaaggccctccttcgggtcatcctttcttccttaaaacagcgtctgatgtctgacctagttcaagaaagccgtggctcagtgtccgaggagccccgtctgcagtctgccctggccacgcctagctgcatctccctgtgcttaaacaaagtgtcgctaagtcgggaattcatgggcctgttagcagcggcttggcttccacatgtcccctttcatggtctcactagtgaaaggtagatgaaagagctgggcgtggtggctcacgcctgtaatcccagcgctttgggaggccgaggtgggtggatcacaaagtcaggagatcgagaccatcctggccaacatggtgaaaccctgtctctactaaaatacaaaagattagccgggcatggtggtgagcacctgtactcgggaggctgaggcaggggaattgcttgaacccgggaggcggaggttgcagtgagcagagattgcactactgcactccagcctggccaaagagcaagactccatctcaaaaaaaaaaaaaaaggtagatgagagaagaataaagcataaagctaaggtctaacttgctaggttattcaggagggagagaggacagaaattacaaataaatattgatatgtatacatacacccgtactgtagataggtgtatgtgtatatatgtgcaaatgactgtatattatgcatacacatgtgtgtatgtgtgtgtgcacatggtataaatgtgtgtatatgtacatatgtatttatacacacatgtatcaactcccataaatgcacaaggctcagcctgacctgtcatttaaccaaacaccagacagtgccttcccagaacattctaccctcaaggcagagtgcctccgtgacacgcaaggcagggggccagctgcaggcgccaggccaacaggatgaatgtctcaggttttcacgcccctggtggcagggcaggccactgtgggcctgctctcttctcatcttgctgtcactttagtgtccttgaggtgctgaggactctcagtttgtatgtccagcccaacagctcctgggctctagacccagagactcagcactgctcgatacgggtcccgggcccacaagtcccctctaccatcctcctcccactgtgcatccagaagcctgggtgctcccggacacccctgctccccacatgcccatctcccaccgtctgcttggttttcactcctaaacagtccttgggtgcagccacttgtcggcatcaccaccaccctgggtcatacccactctcgctctccagtgagtgcagccaggctgctgtttgcaggacttaactctcatcccaccagctgtggctgcccagctcctaaagcaacactagggccctgggtggggcctgcaaaggctgcgaacccaacgcagctccccctctcctagcccggagctggttcctcctctgtcctccaatgccccagcctcctctctgcgtgactgctatattaccacctgacccctgctccccggggcagggactttcttagaagagactctccagacagccaagcacaattggaagcagcacctgctcagatcttccaaactgaggcttggtgaggcctccattgggagcacttcattgacaaacgtttgaaattctgaagatgacctccgtgggtgctggggaggggacctggggcttggctgaggccctggccctggtgagtgaggccctccggctgggcacctctggatattggctgggagggcacccagggccggttgaggccgcagcttgcttttcggcctctccttgctgctccctccccacatggccttgggcaggtgactgctaatgtcggtgaccaggccaggctgccgccacccccaccccatttcccaagcctggctgctggtggcagggtctggtagaagtgctgtggcctccacgcaggcatccctctccatgggatctccatggaagagcgtgtgctggtgcctgggtgtcgggaccccataaaaaccacgggtgacccctgtgcaggggctggggctgctgggactgtggatggtccccctaagccccatgaggcacatttcccaggcatggcagcatggcggtacctctctggggctgtcccttgtgcatgcactcttactccagcagtctctggtccctctacctttctctagtggccctcgggctgagaaaccatgagagtgtgtccaaagcaggcagcggccttaaagaaatgccagcccacctcctccccacctagtgtccaaaagagctgcatgttggaagcaggggtctgtgcagccctcccctctcccctggtacaccctacttggggagcagatttgcctgggcaggtctgcacggggtctgctccctggcccagcagtcactggtgagacacccagccctggcatcctctgttcctaattcccatgaaggtgccttttgtggctgcacctacttgcataaggactgaggcatcggccaggaaaagacgtcaggcttggccagctccatctagcaagacactccaggtcaccggggaaagggcttttcactaaagcctccagggagactttggaacatgagcagcacagcttggagacgagccagcagagcacgtgacagcgaggaggcagccgtgcacgtcgtcacccaagccccaggccacagcatccacgggagagactttcctgcagcactgcgtgttgggggtagggaagagaacaaacttaatcctgggctgttacgggaagccctgacgagccccaggaatatcagggactgcaggaagggttccagtgtcactggggaacccggattcccacaaatgccttgcttcccacaacccggcctcctggtcccacatgcctcacctgttgttccagcctctgcacctgctcacatctctggggagtcacccgatggggctccccagtccccgcagcagcattttcctctgactctcagggccctgctctgccttctgtgctcagcagttgtttcggattgggagtcaggaggccattcccacacttgaaacaaggctgcaagaggaggctgagcagaaaccgcacaccccgagggcaaggcgacatgctcattgcccttgcgcccttcctccttccccaggagcaggacttctggccgctctgagtgcacgggtgacggctgccgtttatcagccttcaaatttgtgcccgaatcacctgcttccaactcctcaaatacagactggcttagctcagcctgattaagaccaaattaggaagggcagctgtgttccaccagagcccagggagccaggcagagggcaggaggatcaggccaccaaaggtcacctacacacaagcccgtaccggtgatgtcatcgtggatggaggagatgggctggcattttttaaggctggccccctgcctgggacacactctacatgtttctaagcctatgggccactggggagagctggaaggagccaggcacagccacagggaggtgccaccatgcttgggaaacacctcgtgggtctgggctgcaaatgaccatccacagtcccagccctggcaaaggggtagctcatggtccttatggggtcccgacacccaggcaccaggacacgctcttccacggatgcaggttagataagaaaccaccttcaggactctcctacacatctcttcacacctgtgcacaaaggaatcagcaaaagatcccctcccagcctgctgtgaccgcaaaattccatacccaagaccagggctgcttaaataatttgagctctgcaatggaaacctacaaagccactaaaagcagcagagaacgctggtgagcagctgtgagtggcagctgagattcattacagttccacagtcggactcgggaaaatgcttccgtgtgtgtagcaggctgtgatgcggtgtgtggtcccagctgaggcccccacactgacagcagtaagagccgagtatctcacatcctaaagatgccggtccgtgcccgagagcagatagtctatgagaccttaaccggggctgtcccagatgccactctgagcccttctggaagggtgagtttgatcagggagatggcgagggaggagtccttgtccaggagctttggggacagtttgacaggagcttttgggatgtcaaccttgctcctaccatggggaatgcagaagggggctcccccccccacctctcctcacatctgctccacctcagcccagatcagaggcagggaggagagccttgaggagccccggagttgggtgcactgactggaccccgccctgagtagaagagggaggctggcctggaggggctgcaggagaacagcagagttgctcagcaggacaaaggagacactgcggaaggggtctgagttcaggtcatcttgactggtttcctcagcacggcccatcatgaggcaaaaccctaaacgctgactcaaagtctgggaacggaatgggctgttttgtccttggctagagccctgccagctgtcccgttccctctaagtgctgcatgcactgtggacgtggcattccctctaagtactgcatgcactgtggatgtggcctgccctctaagtgccgcatgcactgtggacgtggcattccctctaagtgctgcatgcactgtggacatagtgttccctctgcctggtcctcctatgtgaaatccccttcccagccagccagcgcccccacctgcactcctggccccacccttgaggtcctttctggggtggctgagctcttctgcaagacctgtgtccgggcttccctccaccacagctcagaccctcccaggggcccatgtccatgtcggtagaatgcatgagggacgcccaagcccattcggtcccagatgcctccttcgaggcagggccgtgtgtgtgtcatcagcatcacacactcacacacactcacccgcaggcaaagcccctccctgagcccaggaaggctccaaaaggggcgtggtcacagcctcctgcgccttcaggggcgggaacccagaggaagagcagcccacgtgcggactccgcaggaatgaatggacacagttgggaggagaggggagtttcttggaagtaaattccccctgacattgagataactggttcagggtcccatccacagagtacgtgcctgttagcagggcaggaggccagagggcggggcctcgggaaagctgcccaagctcagcagggactccactgctcacagagcaagcagcccgacttgttcagcttggaatctgggctgggaccgctggggtcagcaaagaagatctaggagacatcccataaaatatcagactatcaggatccaatataatacgtgtgatattgagctcattgcacagaagctacaagtaaacattgggtttaggccactcagggaaaaatgacggagcctcatttccataaggagctggcctcatttgaaagctttccaccccacctctcgcctcacctcccccgcgctcctttcttgcttcataaactttcaccactgccatcgaccaaaaagcaaacagagacttggaaaccccgtgtacaacacgtacactgcgctctcgttgatcactattgggtaaactaaaatgtagcttaccacccaggggaggcgtgatgtgtgggtgtgtgtgtgcacgtgtgagtgtgactgcgggtgagtgtgtgagtgtgtgatgctgatcacacaggataaggcatagtcctttatcctgggtctgagaagatgcatggtttgtagaaacagacaaatctgtgaactgcaggatgaatggccctggctgctgtgagcccatcaccctctgatcacacatcataaagagaccttgaggaaggagtgagtttactgactgacatctcattaattcggccccggcaggaaacaatgaaatctaacttttctagacaccatgagatacccttagaatcacgcaagcttacaaatgagcattttgtgggaaacatttttatccttaactaaaacattcaaagcacagcttaattttccttcagactctgggtcctcgctgtggaagatggtcattccttggagctgcaatcaggatgactccagcagggtgcccacttggccccagagaaaatggctctagatcactgcatcttgcagccttgcatctactcgcaatggtcagtcgtaaccatgtgaatgaagcgattcacagaggcacacggggatcaattatagcaaaatggccgaggtgaacatcaccctaatccattaaactgctccagctcagctgacacataatcgatagcgtcgtaatccatctagttaaaagtttgcagaagcaaggagagagggctggagcgagatccacggaagcaggggtttgcttccgtctcttaaccctgagccgccacaggtctacgtcgtggggccaatgttattatatctgcaaactctggccgaacttacacactacagccctcctggagttactggctggctcggaccccatcatattccacgtgggatttgaggtggcagccacttgttgctgtgtgcctggagtccttacccgccaggcagccctctgagctccactggctgcagcgggcaaccagattttaaacagacggctgcatgtcaggggtgtttgcagctggcgggccacgcttatctgcggaaatgctggcatttgcactgttctgtttctgcggttgcctccaggacctggagagctgattcagttctccctggctgctgatactcctttagggatccagactaaaccaagagccaggagctgcaaagctgaggcccaagccctggctcttggtgactgtcaccctggagggcctggtaagctgtgcaaataaagacaggtcgttgctgttaataacagtaaaagtgcaaaaggtggcaaactttttgtatttgtaaattagagtggattataaatatcatatgaggagatctcgaattgtgtttttacacagattgtgtcatttgcaatcccatgaggtagctactgataatccctccattttacagatgaagaaactgaggccttggttggctacagaccacactgatgtatctgagagctctggggccttggctccccaccgctttgctgcctgtctccttgtgagccgcctctccccacctccttccacccccgacccgtgtctgttactcgcttgctcgcctcctggtgcaggagagagagggctggagttacgccgccccgccagccagcaccgtaacctgcaacttctctcctcagggttactgatcagaaaagattcttcagtgtctgatttcattatctacttacaaaatgttttcatgatgattacatcaaaaattagctgacttatttttcctccaagaatttcctttcttacataggccaacattagccgtccccctatccacgacacactgtggctgaccccaaaaggctgggccagttgggggtggcgtttggctgctagtagccaactgtggcttaaacaggaaagaattgttttttctctccggtgggaaagaaggcacagctggggtggaagctccctgtatccttggggacggtgtatctttcttgtctgcctttctgtcacaaacacatccttactccagcctgaaaggaggaggagagaagaaacaggcagaaaggacacaaactgcttccaaacgagtggtgtgtgtctggtcccatccaacaaaacaaaacaaaataaaaccagaaaccacaagaggcctcttttggtgatggatgttccggtggtcttgggttggtgggcttccacaagttccagcccgattcagccaagatctccagtcccaggcgtatcaagcaaaaggaagtgaagatgagagttgggggactgagaggaaaaggagcaaatgtggctgctgtggtgaccctgatattggtgattgcaggaagcagctgtgacccctggagccgagggagctcagaggaggggctggcgctgtacctctgaacccagcacgctaggccggcaggcagaggccttgctgtggccatgcccatcttctgcttccagagcagtggggctctccagggcacctgtttgtgtacccacagccaacagctctgggcagttagtgggaaattacagcaaccagtaaagtcagaagcactgaggctttagactcacacacgtgcagtatctccccagccgctagctaaagacattgaccttttttggtgatggatgttctggtggtctggggttggtgggcttcaacaagtgggggttttagcatgattcagccaagatctccaatcctgcagcctgggaccctgacttggtaaaacgaacacatctgacaccgcttgagtcgccatctataggaggtaagtgtgagtctgggttccaaatattttatcaagcctgtcagggaagcaagcgctgtctgtctgcaggaagatgtctgtggggagagggcagatctgagtccagtgagtctctcctgcagccagcctccaggtccaccctcccccaacagatgtcctctcgcaaatgaaaaacactcaagacgtggaaagcagacagatggcaggagggtccttagcccggactgatgacagccggctctgggccaggttctggacaggattgtgggcacacggtcccgacccaccactgcagttcttgtgggatggtcttggtccacatgcgagcccctctcaggccaaacacctgcttactccatattttcatgtaattctaattcatgtaaatgatgttatttcatcaaggacaattgaagttatggttggccactttgggtaacttattttttatttttttaaattttttttgagatggagactcactctgacccccagactggagcgcagtggtgtgatatcggctcgctgcaacctccgcctcccgggttcaagcaattctcctgcctcaggctccccagtagctgtgattataggtgcccaccatcatgcctggctaatttttgtatttttagtagagacggggtttcaccatgttggccaggcaggtctcgaactcctgacctcaggtgatctgcctgccttggcctcccaaaatgttgagattacaggtgtgagccaccacgtccagccactttgggtaacttttaacatagacaaaatagttattttgagaggcatcctaaaacaaatagaaaaaaaaaatcctgactatccaatggcctgcattctttagttggcataaggagacttctaaactcaattcagattctaaaattatctacctaagttattctactcaggtcagaaaaaatgtcagtgataaactgagacttgtgccgcgcatttatattctaggcttttctgacttcctctgaccaatcatttcccaggaggtgcgaagccttgctggataaaaggtaagcggcgtgaccctgaaaaggacacagggttaacacatcctcgaaaacacaaacacacaaacaacaaaatagaaactcttttgacaggaacacttggcaatagtgcgaacaaaagaataactggaaagtaatatcccacctaattacagaaaaaaagaactagtgagttctgagggattgtgaaggaagactccagccagcccctctcaccttcttttcccctgctcttcctccagctcttgaaagactctggaggttaattatagcaactggtattttctaaaaatggcctctgtgtggtttctagtttcattgctttttctgaatcttcctgccctcctgccccccccagtcagagcaggagttcacgtgtgctccccttggcttcgggtggatctttgtagctcactcaattaatgggctgtggtacgtgtaccgcagcttggcttctggagctgggttagaacagccgacacagcttccgcgtggccagccagcatgccggaagggagcccaaaccagaccctgcggggagaccacacggagaagcccctgtggagaggatccccaggcagatgactaaggagcctgtgggtgattccagcccccatcctcggagtctcccagctgcggccccaggcatcacagaacagagacaaaccattctgctgtgcctgtccaaatgtctgatgcacaatatctgtgaaaatgtgtgactgttttacaccactgagctttgaggtaatttgttacaccgccataaaaaatcagaacatcaagtaatgacacaaatgttccatcatgatgtgcatactctagaactaactagcacagataaacagataccccacaaaagaaaagtaatacatattacaaggtctattaaaatccatgggagatgctgtcctaattggttacagagagcttatataaatttaaaataaaacaatgcaagagtttccagaagatagagaaaaatgttaaccttctcgttatgtgttgattcattttattttcaaaggaaaaaagtttaactgtgactttcattaataactttggttactaggttacaaaaaaaagactattcacagcttttaaacatggctggaaatgctttaaaaatcattctataaatacagaagaatgtatttaaaagttcatataatgttcttgatagatggctttgtagacaaactagagtgagatggtgattttgaaacatctcgttttaaaacatctcattgctgcttccatgtgggatgtagaaagctgcaaagaataataaaaaaacctggctagtgtaccaacattataatttttcttgagtctatcaaagatctaagatggcaaggcaaccaaataagcagaattccaaagagggagcaggcactccagggagacacgagacacatggcgtttctcacctttgcctgagcacaggaaaaacatgtggcccccattaggtatgaagctatcagataaaatgttagtaaatcattaaagtccaagtgtggcctaggatgtaagtttggaataactgggaaactcagggagtcacactcactcacaaaatcactgagggctctcaagagacatattaggagtgggcaggaaacgggggctgctccttcagaggcacaggtatgtgggtgtgcaggacaagatcagctgctgttggaggacaggaacaaagccccacccacttcccctggatccttcctttctatgcagtaaacgccttaagacattgaggggaggggaccgcatcctcccacacacagggcacaggcaaaatccattgctcttatagaaagactagaagcaaaacttatatgcctctggaagaggggtaggaaaactctagccccaaggacacaggagaaaatcctttggtactgtgggaagggtagatgcaaaaatgtcctagttctgagataaaataaagaagctattccaggcccaggatcctataccagtaccaaccagaagtctgctacactgagggaggggagagcaggaatctcctgtccaagaccatcacagatacaaggcagaatttaattgccgtaggaaggaagagcagaattgctgagacagccccaccctaaggtttatatctgtctaagattgaggttgcagcaagacaacaaagaaaaccctatctcaccataagcctagcacagagtaacaagtaaagagagtctatccctgaagaggcgagagtatagatagagtccctctgtggcaaagacatgcaggaatagctaaaaggtaaagggagcattaggaacacagaagaaaaccacccaacaccccagtccccaatctagtacaagatattatagaaacatctcgtatttacagaaacttgaagccttagcagcactgaagatagcaatagcaacaaagtaaacccaaacccagctcagctcctaactagatcgacttcaccttgcacactagaagtcagacataataggcataataatttggagatgtgaatattatttacctcagtctgtactgttaacacacaatgtctggcattcgatcaaaaattataattttttaaaaagcaaaagataaaacaatctagagacaaagcaatcaacagaaatagacttgatgaccccaatagttggaaccattagacagagattttaaaataactataataaatatgttaatgcatctaatgtaaaaggggcaacaaacgcaaacagatagggaatttcaccagcgagaggaacactacaagacaaagtaaaatagaagtgctagaaattaaatatatgacatcacagataaagaattcttttgacaggcacatgagtagaatgaatacagctttgaaaaaaatcaacaaatttgaaaataggtcaataaaaattatccaaagagaaacacaaagaaaaaataatggcaaaagcaaagcagagtattcaagagctgtaggacatcatgagacgggctaacgtatatgttatcagtcacaggagaggagggaatgaagaagaagaaatattagaagagacaatagtcaaggattttccaaaagtaataacagacattaaaccacagatccaagactctcagagaaccctatgcagaattaataccaaaaataaaagaaaggaaaaagaaaacaccaacaccaccatcagcaaaaaatcccacttaactatacacatcatagtgaaactgtcaaaagtggaagatgaagagaaaagcttgaagatagcagagaaaaaagggaacattacatgcagaacagtaaagataagaattacaggacacttctgatcagaaactacacaagccaaaagacaatggagtgacatttttaaaatgctgaaagaaagggaaaaaatctctcaacccagaattctatattaaataaaaatatttttaaaaattagggtaaaataaaaacattttcaaacaaacaaaggctgagacaattcattctcgattcatttaaagaaatttcttcagatagtaagagtgtattatgatcaccttgaggaggatgggatcggccccctctcactggaatagtttaaatgtcaagaatgataaggccgtatgcaccgagaagatatggaaatgcttcttgctcatgccatgggactttctgaagagaaaaggtcaggtgcaagtcagtataaatggtgggagtgaggcagagttaatggatttggcttgtattgtgagtaggtggtgggactgaggaaaaggttcaagcacaaagggtggggcttgtgtggttcagacttcctgctgacaccaagggaagaaatatgcaggtccttgtaactggagaaggaatgaggtttgaaagctatcaaaggtcaaacataaaaaatggaatcttactctctattacatggaatgtgagagcagacaaaaattcgggtctacaccaggggtgtccaatcttttggcttccctgggccacattggagatagaattgtcttgggccacacataaaatatgctaaccctaaggatagctaatgagcttcaaaaaatcgcaaaaaatcccataatgttttaggaaagtttatgaatttgtgttgggccacattcaaagccatcctggccctcatgtggcccatgggccatggttggacaagcttggtttacacaaagaaatgaagagcatcagaaatggtaaaacatggaagtaagtataaaagattcctctcatttctattggagtaaccacattccatcttatatttcccactatttacaaccaaactctggatgaaatctctaaagcaaccatcagaagactgagaggcagagaaaagaaggtgacttggccagggattctgagacatgaggaacaaccaggtggtgagttccttgttatgatttccctcccgtatatcttcatttgagtaccggagaggcccacactcagaaataccaacaggcacaaaaaacaaaggctccaaggaaagcttactttctctaggcaaaagtattgataacgggcagccctgagagatagaacacattctacaccagatgaacagatggtataaaaaaaaaagtgatacaatcctccaaccccatgcaacaccgcagctgcagggactgagggcagagccctgtcaaccatccctgtcctaccctaatgatcagggaccctttcttctcccgacttggagtctatggtcagggagaccgtgttagtttgtcctcctgctgctaataaagacatccctgtgactgggtagtttataaaggaaagaggtttaactgactcacagcttagcatggctgaggaggcctcaggaaattacagtcatggcaaaaggggaagcacacatgtccttcttcacatggtggcatcaaggagaagtgccaagcaaaaaggggaaaagccccttacaaaaccatcagatctcatgagagctcactcactgtcatgagaacagcagcatagggtaaccgcccttatgattccattacctcccactgggtccctcccatgacatgtggagattatgggagctacaattcaagatgagatttgggtgtggacacagacaaaccatatcagagactgtagtggagacctgtttggccatttctgtcttgcattaaggagaaagaacccttcctcctctacaccaggactcagagcaaacttcagggtgaagccctttcaactattctgatcctacactaacatgggtagaagtggcacccctcccccaatacctatcactgtggagactgtagagtgaatcctttctaccatccctctgctgcactaagcaaatgtcagcaaagaggtgatgcttctctcccactccactggtgcatagactgtgaccatccccaccgtgcacgaagcaaacagcagcaaagaggcagcacctcctcccctcccaattagagcagggtaggtaggattacggaggagagaacctgtgtattaattcctgggcagacccccaagcagcctatgcctaataagaatcaacacattagaagattggagaactgagctgcagtgtcaaacactgctatcatttcacattggcctctgggcagcacataagctgggaagaccagggtagcaaactaaattggcatttgaatctcagcctatgaaagtgtaccggaacatgcatcctgaagctaaacaggttgactgcctgctgaaagaagatttaaatagaaaccagaacttcatgacacaacactcagaatgtcctagttacaatccacaattactcatcacactatgaccaaggacatctcaatttgaatgcaaaaaggcaaacaacagacagcaacaccaagataatacagatactataattgtctgacaagggttttaaggaaccagcataaaaatgctccaaaaagtaaatagtaacactgtgggagaaaaaaaaaaagaaaaaatagaaactctaaacaaaggaaaagaaaacttaccacgggaggagccaagatgtccgaataggaacagctctggtctacagctcccagcgtgagcgacgcagaagatgggtgatttctgcatttccatctgaggtaccgggttcatctcactagggagtgccagacagtgggcgcaggtcagtgggtgcgtgcaccgtgcgcgagccgaagcagggcgaggcattgcctcacttgggaagagcaaggggtcagggagttccctttccgagtcaaagaaaggggtgacggacggcacctggaaaatcgggtcactcccacccgaatattgcgcttttcagacccgcttaaaaaacggcgcaccacgagattatatcccgcacctggctcggagggtcctaccccacggagtcacactgattgctagcacagcagtctgagatcaaactgcaaggcggcagcgaggctgggggaggggcgcccgccattgcccaggcttccttaggtaaacaaagcagcctaaagctcgaactgggtggagcccaccacagctccaggaggcctgcctgcctctgtaggctccacctatgggggcagggcacagccaaacaaaaagacagcagtaacctctgcagacttaaatgtccctgtctgacagctttgaagagagcagtggttctcccagtacacagctggagatatgggaaccggcagactgcctcctcaagtgggtccctgacccctgacccctgagcagcctaacagggaggcaccccccagcaggggcagactgacacctcacagggcccagtactccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctagaaagcagagcgcctctcctcctccaaaggaacgcagttcctcaccagcaacggaacaaagctggatggagaatgactttgacgagctgagagaagaaggcttcagacaatcaaattactctgagctacgggaggacattcaaaccaaaggcaaagaagttgaaaaactttggaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagtgagaagggaagtttagagaaaaaagaataaaaacaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataactgtcagattcaccaaagttgaaatgaaggaaaaaatgttaagggcagccagagagaaaggtcgggttaccctcaaagggaagcccatcagactaacagcggatctctcagcagaaaccctacaagctagaagagagtgggggccaatattcaacattcttaaagacaagaattttcaacccagaatttcacatccagccaaactaagcttcataagcaaaggagaaataaaatactttacagacaagcaaatgctgagagattttgtcaccaccaggcctgccctaaaagagctcctgaaggaagcactaaacatggaaaggaacaactggtaccagccgctgcaaaatcatgccaaaatgtaaagaccatcaagactaggaagaaactgcatcaactaacgagcaaaatcaccagctaacatcataatgacaggatcaaattcacacataacaatattaactttaaatgtaaatggactaaatgctccaattaaaagacaaagactggcaagttggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatattagtctctgataaaacagactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgcgacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgcaaaagaacagaaattataacaaactctctctcagaccacagtgcaatcaaactagaactcaggattaagaatctcactccaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagactgcaggaaatagagacacaaaaaacccttcaaaaaattaatgaatccaggagctggttttttgaaagatcaacaaaattgatagaccgctagcaagactaataaagaaaaaaagagagaagaatcaaatagacacaataaaaaatgataaaggggatatcaccaccgatcccacagaaatacaaactatcatcagagaatactacaaacacctctatgcaaataaactagaaaatctagaagaaatggataaattcctcgacacatacaccctcccaagactaaaccaggaagaagttgaatctctgaatagaccaataacaggatctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcagtaaaatactggcaaaccgaatccagcagcacatcaaaaagcttatccaccaagatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagccaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaagagaatcaaatacctaggaatccaacttacaagggatgtgaaggacctcttcaaggagaactacaaaccactgctcaaggaaataaaagaggatacaagcaaatggaagaacattccatgctcatgggtaggaagaatcaatatcatgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactataaggctacagtaaccaaaacagcatggtactggtaccaaaacagagatatagatcaatggaacagaacagagccctcagaaataacgccgcatatctacaactatctgatttttgagaaacctgagaaaaacaagcaatgggtaaaggattccctatttaataaatggtgctgggaaaactggctagccatatgtagaaagctgaaactggatcctttccttacaccttatacaaaaatcaattcaagatggatttaagacttaaatgttagacctaaaaccataaaaaccctagaagaaaacctaggcaataccattcaggacataggcatgggcaaggacttcatgtctaaaccaccaaaagcaatggcaccaaaagccaaaattgacaaatgggatctaattaaactaaagagctcctgcacagcaaaagaaactaccatcagagtgaacaggcaacctacaaaatgggagaaaattttcgcaacctactcatctgacaaagggctcatatccagaatctacaatgaactcaaacaaatttacaagaaaaaaacaaacaaccccatcaaaaagtgggcgaaggacatgaacagacacttctcaaaagaaaacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtgcagaaataggaacagttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaaacgtcattctcagtaaactatcgcaagaacaaaaaaccaaacaccgcatattctcactcataggtgggaattgaacaatgagatcacatggacacaggaaggggaatatcacactctggggactgttgttgggtggggggaggggggagggatagcattgggagatatacctaatgctagatgatgagttagtgggtgcagtgcaccagcatggcacatgtatacatatgtaactaacctgcacaaggtgcaaatgtaccctaaaacttaaagtataataaaaaaaaaattttcttaaaaaaaaaaaagaaaacttaccacaaaatttagaactgaaaaataaaatatgtgaataaaaagaagctgtcactgaatgggttgaatagcaggtggagacaacattagaaacaatgaatctgaggctagatcaatataaattatcctaaataaggagaaaataagactttaaaatgaatagaatctcacaaacacgtgggacgataacaatctaaaattaatgtgatcagagactcaatggaaaagagagtgtggtgcccaaaaatatctgaagaaaaaatgattgaaaatttcccaaattgggcaaaagacataagttgacaaatttaagagattgagcaaactccaagcaggataaatccaaataaatccatgcccaaatacataacaataaaacatctgaaaactaaagacaaatttaaaacttttagaaacagccagaaaacaattattacctacagcattaaaactattcaaatgacagcatatttttcagcagaaatcatgaaggccagaaggacgtgtcataagacttttcaagtgctgaaagaaaaagaaaaactgtcacccagaattctatgtttggcaaaactaactttcaagtatgagggtgaaataaagatattctcagatgaagaaaatctaagaaaatttgttaccagcagaactgccttaaaaatttttttgctggaggaagtaattccgacagaaaataaatgataacagaaggaaatgtggaacgtttggaatgaagatgagcctcggaaaggatatattacttttctattgctttataacaaattactagaaacttggaagcttaaaacaacacgttgtggatgaatattttgggcatcgcttagctggattctctgtttcagggtgtcaccaggttacaacacaggtgttggtgggactgtgttcctttctggatcttggagtcttcttccaacctcatcacactgttagaagaattcaattccttgcagttgtaggagtgaggccctcagatcccgaaggacacccacagattttgcaatgtgttcctgaataagcagttcctatcagaccatctttcttcttcaaggactgctgtggttagggacgctcatctgcaacaacacagtgtaattcagcacttctcatgctcttcttctcacgctcctcaaaaatccacctttttcagggtgatgtcaatgaagtccaacagtgagctgaacatgaagccccacctgggcctgcagactatacccaaaaagaagaagaatttaaaagaaaaaacaattagttcttatgacataatatccaacatgtccaggagacaataaaaaatccatataccaagaaccaggacattcacaacttgattgagaagagatgatcaaaaggtgccagcgttgagaagactcagacattgggattacctgacaagaattttaaagcaactatcatgaaaatgcctcactgagcaattactaacactcttaatacaaatagaaagtagaaaataaatagaagatataaaaaggtaccaagggaaattatgtaacaaaaaatataataattgaaattaaaaactcactgggctgcctcagtagtggacaagagatgatagaggaacgaaaaatcgatgaactcaaaagcatatcaatagaaatgtccagtctgggccaggcatggggactcatgcctgtaatcccagcactttgggaggccgaagcaggtggattacttgaggccaggagttcaagaccagcctggctaacatggcaaaacaccgtctctactaaaaatacaaaaattagccaggtgtggtggtgcatgcctgtaatcccagctactcaggaggctgaggcaggagaattgcttgagcctgggaggtggaggttgcagtgagccgagatcgcagcactgcactccagcctgggcgacagagcaagactccatctcaaacaaacaaacaaacaaacaaaaaactgaaaagagaaatacagaaagccaccattagagttggagactgcaacatttctctgtcagtaattgacagaataagaacacggaatattggcaaagatagaaaaatgctgaaaaatactatcaagcaaattgacctaatcgtcactgataaaacacatgacctggaccagtggaatacacattattttcaagtgcacatgtaacattcagcatgatagaccgtatgtgagccataaagcaaatcaacaaatttaaaataactaaaataatacaaattttattctcttaccacagtgaaaaccagctacaaactaagtacaaaaatatatcttgaaaatgtctttgaggacatttttaagaccaataactcatttaaacaattatctttaaatgctttatttaaaaattatcttttgggccaggtgcagtggcttatgcctgtaatcccagcagtttgggaggccaaggcaggaggctcacttgagcccaagggttcaagacaagcctgggcaacatagtgggaccctacctctagaaaaaaatttaaaaattagcccaccatggtgatgcagacctgtggtcccagctacccgggaggctaaggtgggagaatctcttgagcctgggaggtggagattgcagtgaactgagatcgtgcctctgcactccagcttgggtgacagagcaagaccctgtctcaataataataatataaatcttttgaccaaaaggaattcaaaagtgaaattataaaatattttaaattatacataatagaatttgtgaaatgttctcaaagttcagacggaaatttatagcattacttataatacttatattagaaaaggagaaatgtctcaaattagtgacccaagcatctaccttaagaaactagggagaaaaaaggaatactgtttgcaatctgtgagcattttttatatttagtgattaaaatcacagcctggctactatcagggccattttccactttctcagcatgaactcacttttggtgccacatttcttttactgtgaaataaattctttgatcagaagcaatcttgtgtgaaacagtgaataaagctagagaaggcgaatccgtgttcaaagtaagcatctattccagtgtggacaaatcaacgttccctgcttgatggggaggggcgggggttcagtggaatcatctctttgtgcttatatttttgtgcacaagaatatgacatgcttcatgaaaggaagaacttagcttagtgctaaatccccagggctcaggagggtgcatgccacataggggctcagtactttcgctgaatgaagaaatacgcttaagtgttctatagtacagagttttcgcaggggcttttcctgtgtttcttggattatattttcctcaagatgaactcttcatctttctttcgcagactgtgtttcttcctgtctttcctttcatctgggttctctcgttccccttctatcatatgtatgtgtggttactgagccgtttctttttttttaagaccgctttattaagaagtaatttatatgctgtaaaggttaccagcttaaagtgtaactggctttcttcccttagcaccgtgtttttgaggtttattcaccttatggtgtgtatcagtacttcattcctttatgtgatgaaatagtattccattatatgaatgaactacattttgtttatgtattattcatcagtgggacatttgggttgtttccacttttttactatgaataatggtgctgtaaacgagttttttagtgtatgtcctaaaacctaaaataacaatagacagataggctctccaaaggagtttatctgggattggtgggggattgcaatccaagatacccatgccacaatgaaccaagaaacacccaaagatgctggggtcaaggcaaacttttataaagacaaaaaggagaaagtcatgtaagctggtttgaaacaaaaactcttgactgttgaagctcatagctcctcattggtcacgctggctgttgctggggagatgtcttcacagcagcagcttaacatggagtgtttatggtttccagggagtccttgtaatagttcttatcataggtacatgtgcgtgagtactcctccttcagggcctcccggattcattttgctagggtttgacctaagtgaccccattttggtgctgacaactttcacaacatatctccacttctcttgggtgtatacctagaagattccccaagtcacatggtaactctatgtttaacattttcacaaattgccagactgttttcctgggcagctacatcactttacatccccaccagcaatatatgaaggttccaatttctccacattctcatcaatacttgttattgtgttttctttttcttttattttttagagacagtgtctcgctctgtggctcaggctggagtgcagtggtgtggtcacagtgtcgatgaagagtccaactctgtaaaatatttgaagagatttattccgaaccaaatatgagtgaggcacagtatcaagaggtcctaagaacatgtgcccggtgtggtccggctacagcttgaatttatacattttagggagacataagacaccagtcaatacatgtaagatgcagactggttccatctggaaaggcaggacagctcgaagcaggggcttccagatcatgggtagattcaaggattttctaattggcaattggttgaaagtgttattgtctaaagacctctaatcaacagaggggagtgtctgggttatgataagggattgtggagaccaaggttcttatcatgcagatgaagcctccagattgcgagcttcagagagaatagattggaaatgtttcttagactgaaaaaggtgccagatttgtgactgattctctgctgtgtcagggaaaagacctgaaagggaaggggattctttgcagaatgtagatttttccaagagacagctatgcggggccatttcaagatatggcaaagaaacatatttggggttaaaatattttgatttatctgtcatgtgatgttatgccagagtcaggttggaaagtaagccacatcacatagggttaaataaaactgctttgagattttataaggtgcaactccccagccccttagataggaatttgggcaagagggaaaaaaggtcagagtttagtcctcagtagctaactgtaactccacctcctgggctcaaagatcgctcccacctcagcttcccaagtagctgggaccacaggcgcacacctgcttatttttatttattttttttagagacaggcgtaactacgttgcgcaggcaggttaagaatgccttttattatagtcattctagtgggtggtgagtcatttcattttgttctcatgtaaaaggacaacttcataatatgtgaacaaattcccttggttttctcttcgagcattttgcaagttgtattttgtgttctattctacattccgtgccctgatagctaggagtgaggcagggaaaagctcagctgagactatatctttgctagaatatctggtctctggtttcttgactaggattttctaaatgtcctgaatcaaagtttcctccccagggaatgatgcaatgacccctgggggtcaccccaggctttggatcctttatctggttcagcagggaacccctgaacccatcagagtccctcctgtttgttcacgagccctctctcactggtctcttcccagcagcccttttcacttcccccagcagtaacaggagaaagatatagatacctctctttctccgaattaacctgtttttcctcaccagtgagacccccccaccttttttttttttggagacagagtttcgctcttgttgcccaggctggagtgcaatggtatgatctcggctcacagcagcctctgcctcccaggttcaagcaattctcctgcctcagcctcctgagtagctgggattacaggcacctgccaccacgcccacctaattgttttgtatttttagtagagacgggggtttcaccatgttggccaggctggtctcgaactcctagcctcaggtgatctgcccgcctcggactctcaaagtgctgggattgcaggtgtgagccaccacgtctggcctccagtgagactttctgagttttgttgcgccagcagggccatttgcgggagtaatcttacacacctgagcaataattttttttccctgtattcacaattttttgacgtttttggcatttggctgtatccttttgcttgttcgctgtggagttttcatttgtttgctggttttgggcaggaaggaggtgctggcttttcctacagtgtgtttatcatttaagtatttgagaagggagatgctgcaatccagctgcactctaccactttaaaaattctcagcaatacttttaggtgtttagcttactcccagcaattcctccttactcattcatcaaactcctagtcactgtgcacctgctgcatggccggcagggctctcagagctgagctacagcagagaaccagagccctgccttcgtggagccttagtaaattatgtccacgtgtctccatcaaagcgtattttgcataaaagtgttgtgtttatggaagacaatttcaatacatttaaaagaatttaaatcaaatttgcctaggttacaaaattaaccaataggtctagtgcatagcatcactacagttatcatattataaatttgctaagagtagattttaagtgctcttaccatgaaagaaacgcatacgatgtatatacaataaaagtttaaaaaatgtgtctaccccctaacattcatgtgacacttcatactctaccaaaagggcagaacagaggggaagctttagagcaggagcggaggaatctgcctccatttttcctgggtgtttttttttttcctttttatgcatattctacttatgtagtgccttcattttcaggctttttcaatgttgtatttgagaagctgcatcaggtacagctcattttccactcattgcttacaggatgaattaaaatcatttgcatattccgtagctgatgatatatgcccaaaataaatgcaagtctggcataaggcattaaaaaaaaagtacagagaaatgaagttgtgtggcatagagaaggtatttttacattttaaaatcttgaagcataagatctttgaaaaaatctttttatacgcaccataaaccagttgttcctcagcaatttgcagaaatcagatcaacatggtgttacagacaaatatttacttgaagccaatttctatatattatctccttgcagccacctcaactgccagtccctggaattgtacacagtcccttcaaaaccttgaggacacccgtggcattaactcagcaaataaatgagagcctctgtgtgcacggcattgttctagggacaatggagggggtagacataaataacccagcaccttcccgtgaggcattactggggtaaatggaagagagctgacaaagcaaggtagagattcttaaggggaaatcatgacagatggcctgctgcagtgataaattctgagtgtctagagaactatcaatagaggatggttgactgatatggttcccaacctgtgtgaacaggatggctatctaatcatatccctgggtcagagcccatagctcacacatgatggactgagtatttgtgtcttttccaccccaaattcacatgtggaaatcctcaccactgtaatgatggtatcaggaggtgggacctttgggaggtgatcaggtcatgagggtggagctctcaggattgggattagtgcccttatagaagaggccccagagagatcttccctgcctctaccatgtgaggatgtgagaagatgttatgaggaagaaggccctcaccagataccaaatttaccagcaccttcatcttggactttctagcttccagaactcttaagaaataaatttctgttgttaagccacgccgtttatggtattgttatagcaatcctgaaaatctaagacagcagaggaatagaacctgaaggtcagactccaacatggcattttgctgccagcagaggcccatgggatttgctacaagagattgcacccacactccctagtgccctttgaaagtatagttttactttgcagtttctttttggggctgtgtatgagttcatcgttcataaatttgtttgtactatttgaaaatctcttcgtatttcctgctagttctgtctcaggccatcagctctatcaaagtccttgatctgaagcattcctgactggcttacatccttcaggttccaagggctatgcccttgtgcaaactttttaggatttgggaacaagttcatttatgcctcctttcatggattctgaatctttgagctttactctcagacactgcagcttcattatctaattcaggccccagagccacaaaaatggttaatcaaggatgctgttacctatttccaccaagggcaatgcatacttcctactaacttcccaccgactccctggttccaccttgcatggttgctcaacagggaagtattagattctcttctacacagagctacataaggagactcaggagacatttttattatagttagcaaaggggctacttcttgaagaaaagatcgtcttctaaagaaacacctgctcaatcaacagtttaacggatacaaaaagtgtgtctttgctctcagaaagaaaggtccacataaaccgggttactcccatcctgaagaactgctcatgctctgtgacaagttcctcgtaaacaaaacaaaacaaaaccagtttttttttctgtttctggaactagaatggggaagcaaatgtaatggggatgcgccacctagcgacgagagatggaactgtcactcaactaagaaaaggactgtgctttaaacagcagcaagtgatcactgaaacctttcaggtaaactgaaatcaataaatcatctgctgaatgaaatatgcagatattttatagcttctagatatgatatggtggttaacagtcttctggataatacacacaagtgtttaaaaagcagtaactcagatacccacatttgaaagaaaaaatgctaagtttttaaatgtttcaaaagcaagcttgagtaaaaatctttttgaataactgagttttttttccccgataaagggtctataacagatctatactcaaaaacatttatatatttccactgtgtcaataaaccagccaattatgactctgttagaatggagtaatgccctgaaagataaaaatgttattcttaacaataaaggtaagttgtaatgattattcaagattatatttaatatagaaaacaggcccacagtatttcttaacttgcaattttattaatttttcagtactcttaccttttatatactactaagaaaatttaaaccataactagacataaacattctgcagtttaattcaaattttcatatatacagaccagactacatatgtattacactgcaaaacttacacatgactgaagctgagcctaataacttcaattagccaacaacagaaacactcccacttcctgcagtcacagcaattagctaacaataaaaacactcccacttcctgcagtcacagctgaaagacttttcaaggcagactacatttgggctggagatacaagtgatgtagtttgacttgggcaatacaaaacaaaagtcataggaattaaatggattttcaatcactgtataattcattctcctggcttaagtacgttttaattttttcacagaaaaaaatatatttcaggcaaataaaaacaaattccagattagcatagttcagcgtttcatttatcttacctttatcaaggcaaacaaagtacagatgctgtacattaaaaacatagaaatatatcactcacaccacatcaactcctacggacaaaagggctttttctaagccctgctcctttctgaagcacacaccacagctaaatgtacaaagagccatctgctggtccaacatagccaactccaatgagcaggacgtctatcagcgtccatattcccaggccaccgaagctgaagagcttgccgaggccttcccgccactggcccaggtagaaacggtctgctccaaacccaccgagggtgatgctgcgatggcaaacagacaggattccatgagaccacctccaccccagctgtggccagtcacggtttaatcaccacattatgtcagatttgagaaagggcttcccctgatcgtagcccttaactggaacacaagtgactatttcacaaactgacaccaccaaataattacgggcaggaagacagtttaaatgtcaaaagtaaacatacaatttttagctgtactaaaaaaccaatgttttctttttttaaagttatcaatctcattgctttttagtcaaaataaagcaaagacccagtctaacaggaagtgcactaacacggggtcagggctggagtcaggaggagctcaccaccacctggacgacctggatcaagtcatccatgttttcagtctattttttcattcatctctaaaatcttaatgttaggaataaatccttaaaagatttaaggatcttttaaattctaagatctaataatactgaaactatattatggaaaatttctaaacacctaacaataaaaagtaaagagaacagtacccatgactcagctccaataatcaacacttggccagctgtgtttcatcaaaaccctcctctttcccctccagagtaccctgaagcaaaccttgggcatcatctcattacagtgatgattttaaaagaaaccatgttgccgggcgcggtggctcacgcctgtcatcccagcactctgggaggctgaggcaggcggatcacaaggtcaggagatccagaccatcctggctaacacggtgaaaccctgtctctattaaaaatacaaaaaattagccaggcgtggtggcgggcgcctgtagtcccagctgctcgggaggctgaggcaggagaatggcgtgaacctgggaggtggagcttgcagtaagccgagattgagccactgcactccagcctgggtgacagagagagactccgttaaaaaaaaaaaaaaaaaaaaaaagcaaaaaaaaaaaaaaaccatgttgagtgctgagaagttttaattgttgaaagtatgttacagtatagtactgtaagaggttaacaatgtagggaaaccaggttaggggtatataagaactctactatctttgcaacttttctgtaaattaaaattattccaagtttcaaacatttatttatttttttaaaaagccagttgttaatttgaaccattgtcagcaatggttactaatctttttttttgagacagaatctcactctgtcactgaggctggagtgcagtggtgcaatgccagctcactgcagcctcctcctcctgggctcaagtgatcttcccattgcagcctaccacgcagctggaaccacagacatgaaccacgatggcaggcttttgtatttttggtagagatggggtttcaccatgttggccaggctggtcttgaactcctgacctcaagcaatccgccagcctcggcctcccaaagcgctgggattacaggtgtgagccatcgcgcccgccctatcttatttttgttagtctcattttctatcctggcaccctcttttacttttcagttacacttttcctgccaggcaagatccttctttcctcagctcaaattctaatgcagtggttctcagcaaggggcaattttgtcccctaggggacacctggcaacatctggagacacactgtcacagctgcaagggatggggggtttgctactgacaagtagtaggtagaggccagtgatgctgctcaacaccctgctatgcacagcacagccccaagacaaaaactcattcagcccagaacgtcagcagtgatgaggctgagaaatcctgccctatggctgcaatgctgcaggcctcagggtctcaggcacgaactcaaaacttcaagtgtaggcagcgtaaccttttcactaatcagttaaccagggtcttacctgcccttccctttggtgggaagaactgctataatttcttaaagtactgttgagaagtttaacaaacagcacatttctatgtaagaaatataagcctataattatctgctgctgatgaaattataggtaatttttaatgtttttgtcattttcatttttccagttttcagtgttcatcatgtattactttttataatagttacttaaaattaaagatatacatcataaaactgcctattttggatagtccacagcattttactgattcgtggtacattcagaatggtaaacgtaatgtgcaggcatcttgggagaaaagctaacatgcctgccagtcaactccacggaggtactggtctgatcatctaaactcttccagctgtttgctagagtctaacacacgtggtaggatctgagtgaagaatgaaggggactgagctcaatgtctgaagattccaccaatcccaaagaaatgcaaacggccttttacacttacgagtaacaaggcttaccttagagccagagccgtagaccacttatagcctccagtccaattgcaatatagcattttgggaaaagtacggttaccttaaaaaaaaaaaagaaagaaaaatacagggtataaaaaatactctcagaaagacttaattgtaacaaatgggctcaaaatttaaaatgtgaaaagtcaactctctttacggtaatacatgttgaagtgaagagtacaaagcgcttaccatctatctacatagatgtaatatttaaatcagctaagttaggattacaacgtgaggaacatgaaatgctcacccacatatcaagacctacggggaagttacgagtatataagacagtgtagtcttgaggcataaaaatcacccaataggaaaagaagagaaagtcaagaaccagaaatatacaaacacttcatgtatgagtgttatgacagaggtcacacacggatcaacagggaagagttgagacaactggccatccatgtggggggacaattaaagtagaatctacctcacaccatctaccaggaccaattccaggtggattctaaacctaaatgtgaaatgttatacttacaactttcaaaagaaaatgtagcaaattgtctttattaacctggggtagaaaaagatttcttaaaaccaccacaaaaaaggactaactctaataacttccagtaattatatttttaaagttctgttcatgaaaatatacaataatgcaaaaaaaaaaaaaatcaaaatctgggagagggtttcagggacagcacaggtaatatccaaaatataaaagaagtctagacaactttaagaccaaatttaagaataaccactcttggagagaatatggctcatcaggaacagttacatagcgcgggtgggaatgccagtcaatacagccatttaaagaatgacacacgctggaaagtacatgctgaagaagctcttgcacctgtgccattgggagacaggcaaagaaatttgaacagtcacaacagcggaaaacagcacttaaccaaatatattggagaataaactgtgatacaatcttacaatagattattacacagaagtaaaaaaaagaagagaagtcacgtggatgaatcctagagccacaatgtttaggaaataagcaagtcccagaagagcacacagcctgaaatcattttacacggttctaaaacatgcattattgaatattattttattacatatagacaataaaactacagaaaaaatttaaaaggaagtgaaataaaaaattcaaaagggtggttaccttggaagaggaggaaaggcaaccaggtgaaggcaagcactcaggcactcaggcggccgcaatggtattggtgctgctttcattgttattttgggtaaaggtcaattactgtgtattatgctttatacttcaaatgtttttcttattttatcaaatattacatttaaaaagaactgcaattttctggatgctttactttagtacgttgagtttattgatgatgcttggcacatctaaagagctgctgataaatgtttctaattaagtaacttgactcgcaaatttctggttaaagtcccttcaataaacttggagaaaaacattttgttgacaaatgtccttgaactctgacctacccaagcagtggacgtggtcccgcaccgtgcagttggcagggtagcgctgccgaggacaggacaccgtcatgcagctggtggagttggtacactcgtaatctgtttcaggaagctgccagcaaaatctgcaagtcatgttaatgatgaagttcttttgggatttgaagtcttgatcctatgtagcaaatgacacaaaactcatcaatcacaatggtgtagtctgttaagatgtcagtaagactacacagtcacatggcacaaaattccgtaaatgcttgtatttaggacctaggagtaagtgccagaaaaacagttaccaaaacaatatgtatgtaaaacaaatgcctatgatgtgacctcataatcataaaactacacacccaaacatatgtacttaagggaaaaaactagataaattcacatcaaaatagcaaaggttatttcagggtgatataattatttcataacttttgcttagctaaatttttcatagtaaacgtatacttttataatgcagaaaagaggaaaatttattttagaaagtcacaatcacggatggctggaaggaactgatgaatgcatttgttgaaggtcactgagcttcaagtgaggagtggaatccaggtccctgaactccagcctgatgcttctgtaatggttaacacaccgccttgcttccgagttgccaaccttccctaacatcccctaccttgcacagcctggcaactcagggttgttacagctgctcctaccaccagggcatgtggcatgtttaatccagaggcagcccaactcagaagcaccacatggtgtgtggaggctcagtgagtgttcactggtggccagagaatttttcatttcaattttaaaagccattattttgtattctgcttacaaaagtagaatgttctttgtatgttacatatttgaagattatagacaaaaacctataggtgttcagagctaaccacttttaatcttctttccgtttcttctacatgtatatttataaatttactaaaatggaattatactgaaagcactttgtagtctttttactctacctgacattacattgcagtgcatatttttcaaaatcatttttatgtggtcacacatctctggaagcatcatgtatatatatgtatacatatatatacacatacacacattatttttttttctttttttgagatggagtctcgctctgtcgcccaggctggaatgcggtggtgcaatctcggctcacttcaacctccgcctcccaggttcaagcgattctcctgcctcagcctcctgagtagctgggattagagacgcaccccaccacgcccagctaatttttgtatttttagtacagatggggtttcaccatgttggccaggctggtctcaacctctgacctcaggtgattcacctgcctcggcctgccaaagtgctgggattacaggtgtaggccaccacgcccggcccatgtttgttattttttttaacatttcacaaatttgcatgtcatttttgcagaagagccatcctaattctctctgtatggttccaactttggcatatgcgctgatgaagcaagtactattcattttcttatcaatgcaaaaaccactttttatggaaaacattcaaatatgggtaaggcatcacttgatttaggcaaacagttggatctgcaaaataatacgtttacatctgcctattttcagtgatgtgcttaaaacacactttttttaatggttttttaaaaagtaggtgacacatgtacatggaacacatgtcaagacacaacaggagagtgagaagtgagccggcctcgtctggcccagccgccgggagcccctgccctccccaggccaagtacgctctgtgcttccagagagagctgattctacacataggcacatttatgtcacctacatttaatgttccccaatactttcacttaattttggacatctatcagtacattacctctagagctgcctagttctttttaatggctacaaggtgtttattctattacacgtgtaccataaattaagcagttcttagacatttcacttcttttgaatcttttgctttaatgagcaatgcagctaaaaaataagcacacttatctgcatccatgtataatgatatctataacataaattcctacatgtacaactacgagctcaacgattgtgtgcatgtgtaagtttaacagatatggcaaatcgcctacaagaggttgatcaatttgattacctattaataagatatgagcatctgacccttatactctcacaaactcagagttaatcaaattaaaaaaaaattgccaatctaagggttaaaaatgtattaattaaatactatgagaaaacttatatgtttttcatgttatatatctatttgtatttcctttcctatgaaccatctgctcatgtcctaacactgtttttctacaagactgtcatcttttccgtgtgggttttaggaagtgtttatatattactgatattactgtattatttgtcacatattctagaaacgctttttcctagtttgccatgtcttttgcctttatgcttttttttttaggtcatgcagaaatctccaatttttaggagtcaaatgtatcaattctttattttatggcttctaaactttatttcatacttagaaaaatattctccattttgggattataacagcaactatctggtgttttctgtggtacttcagggtttcatttttcacattacatctttggactatctggaatttattctggataagacaggcgttccacttaattttgttctagagagctaccaggcattccggcatttactgaatccatcttctcaccacagataagcactggcccttcaaaagctcatctatggcagaaagacactgccaccccctctgtacactagctgtcactattgagaacacagaatccatctgaacgaattagacttgcttcagatatgctagtagactgagatcttctccagtcctacaaagcaacatttctgtcaagtgcatttccagcagacatcaactggcttgacagttatcattataactaaaacagtagtgagctgatatggaaaggtctattgggttttttaatttatttctgcttacatactcaaaagggaaatcataaaagaatataaaaattcttcagaatttcttcccaataatcaagtctgaattgttcttctaacttaaagtttacaatgaatttatttagaataagtaagctgcagtacttacaacacaggtaacagatggtttcactgcacagtcaaaagtgacaggcttcccataggtacaggagaaatttgttgtgcagtctatacagtctgcaggaagcctgctacacaaaccattgctcggacacttcatcacataaggtgggatttcagtactttctgtgagaggcaagagagaagcttattctcctataatactgattcgaataacagagaacaatcttctaaggttaagagacgtgatcattagcaagtagacactgcactggaagggaagaagcatgggactggagtcagagacacctgcaattaaagcagaattctgcccacggccagctgtgggacctggtgagcaccacacttgtaaaacattacttcattcctgcctcccacgtggccgtgaaaactaaaggtgctcatatacaaataatgtatagaaaattctgggtatacattaagggcttaaaaaaaagactatcattttgtaagttgaaaaaaaacttacagtagggttttgcaaaatcacagaggaagtctgtggcaaaactggaactagaacccaaatctctccatttccaatcccgtgttcttttcatctgaattcactaattcagaaatgaagccactgacatcctcagggcatcaactttaaaatgtcattatttcacactggtacttcgataagccacatttgctaatataatatttacagttttacgctaccaaagttcaaaacagttctctactttaataacatcttcagtaagctgcaacttatttccaaccaacctaatgagtgtgcaatgtatttttaccaactgaaaggatcaaaattgcaagtattcctgaaaagaagggctttcaaaagcctgcaagagttaagaactcttgtgctttctctaaaaagtaatctgagtttaaaattcaagtgcactgctgttttttacatccaaataagaatcagtaaaatatctctgccagtttcaattcactgaagtaatgtcactttaaagtgatgaaattatagtcagagcctccacctagcaaaacacactaatgcttgtttaaaactggtcctactttactcactgtattaaggaacaattctacaaaatactctttttgatcccgtgactatgtggctggaaggtggacacttagaatcacaaagcagaaatgactttaggtcgtcagaccaaccccaccgctttaaagatgaggaccaaggtccaaagaggataaataatttgttcaagatcccagtagcaaaaccagatctagatttcaagtctccatcagtcccgctgtaatccttccatttccacagtcctgagggagcctttaatattccaacatcaggaacagggttttagcagtagaggaaatttgctgaagggaaagaagcacggactgaaggttattttgatggatgaagtggaaaaataatagaaataaggtgacaaatgagcgtgggattggaaaaagagaggaggcagaaacgtcaaaaggtataaatacgaagactatctactgaaaatggctgtgtatctacccttaattcacataatctaaaatacaataaatattcaaaaatggaaagtgacttcgtatactaaagggaatttttataaaaacaaagagaaactactagagataactacatgtatttactagaatagaaaacgtctagtacctgctgccctgggaactactgtgaatgtgcgtgttgggcccggatcctttattgactgagccagcgcctgcgattgctctaaatttaaggatcgtacaattagagaaacacgttatcccgggacaagaaaaccttattttgtgtggttaacacggcgggtctacaccaggccaataagctgctcatgaaaacctcacggctggtcagccagaaaacacaaagcttagggacgaaacgtcaacagagtagacatcagttcaggtcagccggcaacgagggaccgaaggatgacatcgcgctccagttccgcctccccggcccagcccccaagcgctccatctccgtgccagggctccgcagccgcgatggcgggctcggtgtcgccggagcggaggggcggcctcgggccgggcggccagggcgccagactccagatgcagcgacaagcggcccggagcccggcactcggcctcctccccgcgtcagcgtccgcccgtgggcccggcctcctcgcagctcccggggccctgctgccactcagccccacccggcgctgaacccagcctttgactcaccaccgcccgacagaatgcagaactgcgagaggaagagcagcacgcgacacaaggcgcggaggcccctcagcgggagcacccctcccgccatcttgccagcgcctgcgcacttccgggccggggggcggggcgcgcctgggagccggagcgtgaactggacgcaggcgcgctgcgactcctggcggccggcgtttgcgctttcgctgtcctcgcgcgggtcgcgggttttcttccggttgagccttctgggaggtccccgaggaggatgcgagcctgggaggttgttccatttccacgcgcccctcacgcccttggacgaggccctcacccctggttccactgcaggagacctgttaaaggtcatccgtggaccgaaatgcgcgcccgaagcaaccaagagcagaggcgggcgaacgcgggaggctggccgccccagtgtgtggtcggatgttgtgtgctggatctcgtgcgaaggttccgaggacactatcgcgtggcgtttcatcctaaagacacttatttacagtcggggaagcggccccgggacgacgagggcccgagggacccctcccctggggccggcgctcaggcctgccgcggctttcacttctggccggcctcttgaagatacgcagcacttccagaaagttcctctcaggcctggagaagcaggatggcccgaggcgctgggaagtgaggggagggtccagagcccagccctgcctggggaaggtcgcggccgtctggggagccgcgctcaggccccagcttgcggagacccttgccggtttctgtcacagcacacctgggagaaagcgctggtgacaggtgctctcctcccacccacgtgcttcgggatcgttcattccgcggtcttctgactaccaccccctcacgtgcatgtttgctgaatgactttttaaaaaatacatggaaaagtgccggcacataagccctgaatgttagctttaaaaatcgtatcacggccgggggcggtgaatcacgtctgtaatcccagcactttgggaggcccaggcgggcggatcacgaggttaggaaatcgaaaccatcctggctaacaacacggtgaaaccctgtctctactaaaaatacaaaaaaattagccaggcgtggaggcacgcgcctgtggtcccagctactggggaagctgaggcaggagaatcgcctaaacccgggaagcggaggttgtagtgagccgagatcgcgccactgcactccagcctgggtgacagagcgagactccgtctcaaaaaataaataataaaaatcatatcacacaatctgcaccttatactactacacaagcctgatatatattgttttgtttgccaactgtttcactgttcacatccctcaggaagttaactaaatgatcagtatattgaaaagagattatttcttacatttcttttgaatttcacagcatatcgcaaaataaacaatacttcttgtttggtagctgaattctctattgacataatgccattttaattcagttctgagcacgtagagcattcctctctttaaaatctgaaatccatttcagtacataaatccatggaatgtcatcccatcaaaaaagtaacaactctaggtgagcggcttagtggtggtagaagcccacagctgaaacgctggaaacactgatgcaattcatttgggaatttatttttttctaaagcggaacaaaacctaattatgaataagaaacatttaaatggcaactcttaacctatagtgcaaacaccagattccacaaaactgaattcctttgtcagtaatccaatatttagcagtagctgctgcttttgtggttgttggttagttaaaattaagtaatgattccagtttagaagataaagtttcagtgtgaattttagtagaagtcataaaaatacctgagacatattagaaaataagattttccctcctatttaaaaaaaactctgcagacttttatttgaagcccatcttttgaaaatcactaacatttcataatcatttcctagtgttttgtttcactttctcgatgaataatatttccccatttaagtttctcaaggcattgattgctggaaaatttcccacgtgccctctaaacgtcccccgtggacatgagtaaattaaacttcgtgcatgtcagctacacgttcatcgtctcctttctcagctgaggccatgagtggacccatcagtggctccaaagtcgtagaagtactaacatgttaagaaaaatacatttttaagggtcaaaacaaagttacacagaagcaaatatcagggaaggacttcaaaaggcctcctcagcattgagtgtccgtgtcttcctgagattcttcagtttatcaatggcagaagttactaaaatctctccatgaattttgttgtctcttgttcgcacgtttacagcattatctatcttttccttttctccaaccactgcagaaaagaaaggtaaagaaatgtattttaaatcagcaatttaccaaacattaagtcagcagtcccatgacatgtttttatcaagtttttcttcactaatattaaatatcatctaatgagcatttggttcatcctctgatagttaagtttcttgagggaagcaatgacttctgatcccatctctctattgtccacctgagagaacagctcttgtggtcctggggtgcagatgagaggggggagctcttacagactcacactgactgcacctggcactagggcgcaaatgagagcggggagctcttacaggctcacagtgaccccacctggcactagggcgcaaatgagagcggggagctcttacaggctcacactgaccccacctggcactagggtgcaaatgagagcggggagctcttacaggctcacactgactccacctggcactagggcgcaaatgagagcggggagctcttacaggctcacactgaccccacctggcactagggtgcaaatgagaggggggagctcttacaggctcacagtgactccacctggcactagggcgcagatgagaggggggagctcttacaggctcacactgaccccacctggcactagggtgcaaatgagaggggggagctcttacaggctcacagtgactccacctggcactagggcgcaaatgagagcggggagctcttacaggctcacagtgactccacctggcactagggcgcaaatgagagcggggagctcttacaggctcacactgaccccacctggcactagggcgcaaatgagagcggggagctcttacagactcacagtgactccacctggcactagggcgcaaatgagagcggggagctcttacaggctcacagtgactccacctggcactagggcgcaaatgagagcggggagctcttacagactcacagtgactccacctggcactagggtgcaaatgagagcggggagctcttacaggctcacactgaccccacctggcactagggtgcagatgagagtggggagctcttacaggctcacactgaccccacctggcactagggtgcagatgagagcggggagctcttacaggctcacgctgactccacctggcatacctgatgagccaaggagtggacaccagacccatgcgagccagccagaactttctggaatgtgggtaaaaagtttgttctctctagtgacccatattgtgagatgatgcaggaatctacagccatgcttcttgccacacagaaggaagaaaccggtctgcagataagtggaataaggtagatattcaagagaagcataaagaaccagagcaagacaggaacgagaaatggggagaaatactcctggtgagggttgagctcctgattgctcttctagtggtttggctatttaattctacctttcatgtcatgggatactccaagacccttccaacaaatgctgtctttgtctaaaccaagttgagatttctgccaccataagaagcctgactgaaacagcacaatacctactctggtgtcaaacattatcattgaaacactgtcaatagaacaatgctatgcatatttatttcgccttctacagactctcaacttacaagaaatagcaatactgtgcctgcagttatatcagtgttagtttctcttaattttggaatcatttttaaagcctaaattttagattctgcatctaattagtcatatgctaaaaggacattttacttttcatctaaatcttttcctttagatcattttaaatttgggatcttttctttctgttagtttaatcccaaagtttcctaataagccagaaaagtgagggaaaatattacaggcctgtgaggctgaaatataaagtatataattctactgatgggatcattttcagagttgttttcgttgtttgcttgcaatatgaactattgctagtaaaactatcccaggggattcaggtgaaactttacaactcttcttccagcaaacaacaaagagtacctaggaacagctaagctaggaatgctatggactcttccttttgtgtaagtattaaatagacaaatcatgataatcaagtagttgaaccatatttcttatttggtcttttggaattgaagtgggaaaaaaaagcatttggaaaaatatatacaaacttaaattacccaaaataaaattatactgagccagctgtgcatttcgtattttcttatttagtgtacaactgtgatccaagtcaacgtcagccataaatccttcttcaaaaaattcactggatacctagaagaaaatgaaacacctttactgttacattatggtacctagcctccaagaagaccccgttgttccccactcttggtattcacacctttgtatagttccctgctcactataccagagcgggtctgcgtgaccataaagaagtgcggaagtgtcggcgcatcgtttctgagactagtttataaaaggctgcagctcccatctctctcagatcacttgctctgggggaaaccagccaccatgcagtgaggacattcaggcaagcaagcacccaggtgatgaggagctgcatccaccaactgtgagcgagccccgagctccgcagccctggctgacagcctgactgcagccccaggagacgctctgcgccagaatccaccagctgagctgctcccagaccctgactcgtaggaactgtgagatcatcaatgtttgttgtttaaagctgctaagttttggggtcacttgtgacacagcaacagataatattcttccctaatagagctgtgtagaaatgaataattatgatatgttttaaaatactaatttctcaaaaaacattaagaatgaaatagttctgagacagctgcagagacatgattcgtgtgttactcccacctgctgaaaacacggtttaagctaatgtgtcagttctgcaatattttaaagcatgaaggacactccaaatcgatgacctacacagaatacatgcaagattattatgtactttaaacacctctgattttacctgaagtgcatatttttcacaagttggccccacagggatgaccatcacctgacgaggagatagccagaaaggcctgaaaaatatatataaaatatgtattttcaaagtgtaataatggctacttattacatgattttcaaataaccaaagattcttttaaagacttcacaagagggcagtttcagtagcgcagcatggaagaaaactaaattatattaaagtttgaaggcagcaaagtaaatgaaaggagaattttggaattttgatagcacaagtgcaggtagaatgagctggcagacagcccaaagggctgagcatgcacttactgtctgccccagcaattgcactcctggcatttgtcccagagaaatgaaagcgcaggttcacacacaatactgctcactaacgtccatagcagctttatttataatagccccaaacaggaaacacacaccccaaatgtcctttagcgggtgaatggccaaactgtggtgcatccacactgtggaacgtggaacaccatcagcaaaaaaaaaaaaaaaaaaaaggaaccaactaatttatctcgaaacaaaacaacatggatggctcttaagggaattccactgagtgaaaaaaaaaaagcctacttcaaaagtttgtgtactctgtaaatccatttatgtaatattctttatatgacaaaatgatggagctagagaacaagttcatggctgtcagataggaggacagggtgggatggtttgagtgtggggaaaaaagggcagcaggagggagccttacaagtgatggactgtcctgtgccttgactggtggccttacaccatctgtccgtgtgacacagctaaatacacgttcacacaaatgagtgcatgtgaggctggtgaaatcggaacaaggttggtggacagtctcaatgtctagttcttggctgtgatattgtatctagttttgcaagatgttaccattgaggaaaactgggtaaagagtgtgctggacttctctgtataacttcttttttattttttttgagatggaatcttgctcacccaggctagagtgcagtggcgtgatctcggctcactgcaacctctgcctcccgagttcaagtgattctcctagctcagcctcctgagtagctgggattacagccattgccaccacacccagctaatttttgtattttcagtagagacggggtttcaccatgttggccagactggtcttgaactcctgacctcaggtgatccacccacctcggcctcccaaaggttgggattacaggcgtgagccaccacatccggcctctatataacttcttagaacaacatgcgaacctacaattatttcaaaatataatttttctagaataaaaaagatggcagggtaggtataaacagtgtccgctgtgggacatgtttgccctttccctgtcatagtgagtatttagtctgaaggtgaaaggacatgcaaggaggactatttcagatagcattttataaatgtgcatatttatatatttattctcaaattacaaacacaaaacaatacatgataaatggtagaacacagaaatacagggtatataatggcaactacatatttccttttgagctctgtccttatcccatccccagccctactcctctcaaggacccacactttagccatctttacttttggctcctggggagatttccccacaaggctgactgctgtctgaagtctggatgtatgaagtgcagggagtatacttccgtctctgcgacaaaggaaggcatgctcagtgcactggccccaaccacctcctgtctccctctccatctcctatttcactagttctctctcttttctttaaaccactttcactgcaaccattctaatgcaaaacaccatcatctcttacctatggtaaactatttaaaaccaactggaaagaaatataaacatgttaactcatactcaggcggcatacatattcatacccatacttttggcttaactgtaacttcaacagcttagaaactccatgatacctaagtatatttctctatgatcacaaaatatcaggaatatacacagactctctagctacccaggtcttttggaagacactttgtttgggaaactttccaccttatgtttcctgctcaaaaatttgcttccccagtctcgctggacatgaatggtagtatgcatgggtgtgatctaggttctgctaatgtataaacatggcactctgacttaagacagagtggagaaggaggcaccacatggaatccattatggcaaggaaaggtgatgcagagacatggagcttttggaggaactggttgcagtgaccctagcagtatcatccggtgcccagtgtccacagtgggagctgcagggactgtgcccggcaatagtagcagtgggggcagtagtttctgaagagagagctaaactgcatgagcagatgcttagccaatttctaaaaatggaatgggaggtagaaatttcacaggtggttgctggtttgcagcatttccacatactaggatacatcatcacaagatgttgtctgccagctggtgctataactgctagtaaagccacttgcttctgaatgcatggtgatagtagtgaatcccttaatgtcagtgcaatgctttacttatttgctataaaatctctttcatagtcagaagcactgttgtgttcctggcagcacctaagtacatatttggtgccactggcagaagcatggcagcaaagaagagcaaagcaaaatccacagtgagtctctcttcagtgagaatgaggcattgctccttacatgatgaaagggatccaacgtaatcaacctgctacaagaccactggctattaccccaggttatggtaccatcccgggggatcacaattaatcactgactgatggcaacctgaattctcagaagagatgtagccagatggaacttagtgaggcaaagtccatgtctttgagcccatgcctatccaccagtggccactttgcccatgagccattgagcaacaactaggggaaaaagcagctgattttaacagaatgggtcctcttgtattggaatactgaaaaattcctcaacagcgggggccttttggtggcaataccacctctgttggcccattctgagtgatcatccacatttctgcttcccaaatctatgtaatttgtttttcaatctaattagttctaaatctttgactctgtggccaaagcagtaactagagcctgtgcatccatgtaactccttatctccggccattcttccttccgggcaaaaaggaccacaggatgcaccactcaaaaaggaccacaagatgcaccactcaaaaaagaccacaagatgcaccactcaaaattctgcactttaggacacttcccttccccactgtcatcctaaatgggctgtgctgctgagccatcctctttgagtttgtgccatttatgaatcaggtttacatgttttcctcctcagtggctgtagggaaccccaaaggcaaacaatatgggttgaaggaaggatggctggagggcaagaggtggtacctaggagtgtgggtcacatgttttcaggacagcaactagatctctgaagggcttgaaacaggtaaaaagataactttaattctaccgagtcccccaaaaggtaaatggtacagttttatgccactctcccttagtttttattttctgatctggcaaatcgaataagaattctttatttgctgtttggacaattgctaattacaaggcaggaaaggccctttcttttgttactacttttttcttttacacatgattttttaagaatagaaatatttttaaaaaggaaaaatgagtaaattaataaaaattaaaaagaataatagacatatagtttttcttttccatatcacttaccattttccgccatagttttctgaaagaatggctatcattctttccactgatcccaaaatggctcgatgaatgatcacaggtctcttcttatcatccccatccttactaaaaaatgaaaattatacatttaagtcttttcctaagattcaataactatcttctagccttatatttaattttgagaatagatttagattagtgatatcagatctctccattaaccttatttgttctgtgactgtcttgttttctcattgctttctttgctaatcttttttcttttattttaaaaactttttattagagcgcactgaaacatatacaaaagtagagagaagagtataatgaacttccacataccctctctcagcttcacaaaatgtcaactcacagccaatctcatctgatccaaatgcacccccattcttgccactatctcccacattataatcttcatttttaaaatgttcctgatatgtgttcttgaagtccactggtcaaattccctgaaaccctcatgaggtgtatcttacatttaattattccctcttccccttaggaaaaaaaaatgaaaaaagcaaatgatgacttaattgtaatgaagtaagccacttcaagatctctgcacaagcacaagcttctcagaaagataaatttcacattattgcaacaaatgtgacatgcgacacttacaaagttcttttgataaatttttatctaaaaattataccagctagctactactacaataaatgaaacaaatttaacaaataaataataaaataaaacaaacaaaaacagagaaacccattcattaaacctacttcaaatgagttgtaactggatatcatcactgccaaccatttctgctaagagccattatagaataactgcaggcaaaactctctgtctggaccctacaggaagctttggggtaggggtgagcggcttgagtccattcctatgcaggtatatgaagaaattcatcccaaaaattgaaaccagtatgaaatattcctgaatatcccatcatgttgattttgtgtagggaagaaagagaagcaaactgatcctttcacagagcctgggtatccaaaatttctgtcccatcatttctttgaatcatgtctagacttaagaagagcaaatagtgacataaactatgattacacatctgtgctatcagataaacattggaatgaatgccaaattcccccaaaataaccccagtggatttgcttacaattatattagattaatagataaatttgaagagaataacttcacaatgttgattcttctcattccaaagtgtggtacgaatcttcatttaaataactcttttttgtggtcttggagaaaaacttatagcgtatgcttataaataacatctatagtcatgtgttgcctaatgacattttggtcaacaatggactgcagatatgatggtggtcccacgagattataaagaagctgaaaaaaatttttttttaaattatactttaagttctagggtacatgtgcacaatgtgcaggtttgttacatatgtatacatgagccacgctggtgtcctgcacccaaggaagctgaaaaattcctatcatctagtgatctgtgttacaagtacctagagcattcagtacagtaacattctgcacaggtttggagctagcagcaataggctatcccatacagcttaagtgtgtagtggcctatgccatctaggtttgtgtaagtacactccgtgatgttcacacaacaatgatattgcctaacgacacatttctccaaacatatccctgtcatgactacatttatggggatgcatgactatatttatatttattaagtttattcatattttctattttgtggttgctgttgcttctgaaatgttttttccattgcatttcctagcagattattgctaacattatgaaggcaaattgatttttgcatttttaccttccattattattagtgcccatttctccatttgattctgttggatttctctatattttaacatctactaataataattttatctcttgctttcatgtatttgtaatcccagaataattttgagtaacaatacaaatagtagtcatattcgtcttcttcccaactgtgttgagatgctattgctgttttctgataaaagctctttatcgtgataaggaaatttctgttcatttcacaggaatgaatgttaacttttatctgatgcctttctgcatgctgaatgtaatgaatgacaacagcacactctcatccacccctgcttttttagggaaaaacccttactcaatcatggtgatgaccttgatgcttctctctctcctctcatacataagcctgagcaaatcacatcagttcttcctccaaaatacacttccagtacccctactttgttcatctctatgccacctggctccaactgtcatcatttcttacctggtctgcaatccactgcttccacctttgcttgcctactcgccatttgccacacaacacctatgatggctggctgggctgatttgtttctcctccacgtcctccttaaatgagtagtttcacttgcattctgatggccctaagcaattttgttgtaggactgatcctgaaggtttgactttctctctaatagttctgacccttgctcctccaaaacggagagattagacttttcggagtcctactaactccactgtaccaatcaggcaaaaagttagaggtcaactcccagaagcttttccgttttggcacacggtatgacctatgggacttggccactgggtggcgaacacatggaacagatgtgaatatcactataaaggcttcgataactgaactgacaccgaaccgcagcccacaaaagtgggctggaaatttccacctgaacctaaccaggcagattcactgccaaaacaagacaaccgccttaggatttaaacaagacacagcatctcataacataatattcaagacattcaggatataatcctaaattacttagcatatgaatcattaggaaaattttcaatttgtgagaagaaaagacaaacaacagtccagcagcaagaaaacacaaatgatggaattaccaaaggctagaaatagccattataactgtaccccaggaagcagggtaaacacacctggagtgactggaaagaccaaagtctcaggaagaaacacaaaacacgaacaacagagattgtagaactgaaaactacaatcacagaaagttttaaaaagtcattcgatggattcagtagcaacagagatggtaaagagttggtgaatttgaagataagtaaatagaatgtatccaatctgagagatatacaaagaaagactgaaggaagcataaacagcctcagaaaactggaaaaataccaaaaggtctaatattcaggtcacctgcgtcccagaaggagcggaggtatagtaccaaagaaatatggaaaaacaatacaacgtttgcaaaccaataacttacagattcaggaagttcaaaccgccacaacatagacttgaataagtccacagacagacacatcacaatcgtgtgacacataaaggaaaagtgactgcaattactgcatatttctcatcagaaaccataaaagccagcagcatgtgtaacaatattttttgtttttactttgcaagaaaataaattatataacttaaaaaataaaacccccaaactaagcagttcatcaaaatatttcagcctacagcctacagaaactgctaccatttaaaattgtacagcgttatcatctcagcgtgtagtggcacacgtgcaaatagcatagaccacatgaggacagattacaacttaggaactcaaatttgttcaacactctaaacaacatacagtgtagatgacaggaaagctctcatgtaatgtttattttacaaacatgaccttggaagaattaataagatggcatctcagttatttacataaaaatagaaaaatcagcttgagtttaagacggcaaatctttctataaaactagccaatctttcacccagattgaagttttaaaatttgctctttgaaagggctaatgacatcttactgcaaataatgtaaaatattttttaactactcaggtcatattttgtattaaatttaatacaaagtaaaagtaagaaagctaagtttttactttgggaagcgttaacatttatgcacaagatgagaacaagacttgaaaaaacaagttgatagaactcgggagcccctccaataaatgcaaacattggaagacttcagaattcatttcgagatcctcactgaatcattggagcagtaatgttctaatatttacctcactgtaagcatcaaaattgttctgtattttcccttcataaattttatttcatgtctacttactctggaaatgagatgcaacaaaggttaacacaaaaatggatgtctctgtttttaaattagaagatgagtgttctaggtcaggatcggtggctcacgcctgtaatctcagcactttgggaggctgaggtgggcggaggtaaggagttcgagaccagcctggccaacatggtgaaaccctgtctccactaaaaatacaaagtttagccaggcatggtggtgcatgcctatagtcccagttactcaggaggctgaggcagaagaattgcttgaacccaggaggcggaggtttcagtgagccaagattgtcccactgcactccagcctgggcaacagagcaagactcatctcaaaaaaaaaaaaaaaaaaaaaaagatgagtgttcaaagtttgcattaacctcagaagcgtcctcttgctatactactaagttaatatatatttttaaacaatatttttaaaatattaaaactaaataactatcaacccagaattgtacaagcaaagaaggttattttctttgaaagtacaacaaaataaagacattctcagatgaaagaaaataaggcaattcatcttcaaccgacctgctttaaataaactgtttattctcttatatcttcagatatatgagaaatgatactagagggaaccctggaacatcaggaatgaaacaagatcaacagaaatggtaaatatttggtaaatataatataatgttctcctcctaagctctttaaaacatgtactatgattgaaaacaaaaataatattgcttatgaggttgttaatgtatatggcatgtagtgtgtagtatgccttccaaaatgaatttttaaataacaagacttgaaagtcaaaattgtgccttgatccatgggctgcagaatggatgttgtgttaataggcatgagaaaacattaatctccttgtacgtctccatcagagctcttggatgaccaggtgcattgtcaatgagcagtaatcttttgaaatgaatctttttttttttcctgagcagtaggtctcaacagtgggcttaaaatattcagtaaatcatgctgtaaacagacgtgctgtcatctaggctttgttgttgcatttctagaacacaggcagagtaaatttagcattattcgtaagggttctaagattttctgaatggtaaatgagcactggcttcaacttaaagtcaccagctgcattagctcctaataagagggtgagcctctcttttgaagttttgaagccagtcattgacttttcctttctagctatgaaagtcctagagggcatcttcttctaatagaaggctgcttcatatatattgaaaatctgttgtttagtgttgtcatcttcatcattgatcttagctagatcttctggataacttgctgaagcttgtacgtcagcacttgttgctttaccttgcacttttatattatggagatggcttttttttttgagatggagtttcactcttgttgtccaggctggagtgcagtggcgtggtcttggctccctgcaacttctgccttctggattcacatgattctcctgcctcagcctcccaagtagctgggattacaggcacccaccaccacgcccagctaatttttttatttttatttttgtatttttagtagagacggggtttcaccaaccatatggagttggccaggctggtcttgaactcctgacctcaggtgatccacctgcctctgcctcccaaagtgctgggattacaggcatgagccactgcacctggccctggagatggttcttttaacttcatgaaccaacctcttgctagtttcaaactttgcttctgcagcttcttcacctctctcagtcttcacagaattgaaaagttagggctttgctctggattagtctttggcttcagggaaactttctccacatcagcaagaaggctgtttcacttccttatcatttgtgttcactggagtagcacttttaatgtccttcaagagcttttcctttgcattcacaacttgggtaactggtgcaagaggccgagcttttggcctatctgggctttcaacagtccttcctcaccaagcttaatcatttctagcttttgatctaaggtgagagacttatgactcttctttaaacatgaatatttacaggctgttgtagggttattaattagcctaatttcaatgttattgtgtctcagggaatagggaaggctgaggagagggagagagattagggaggggccggtggagtggtcacaacagacgacatttatcggtaaagttcatcgttttaaatgggtatagttcatggtgccccctaaaattataagagtaatatcaaatatcactaatcaccataacagatagaataataatgaaaaagcttgaaatactgcaagaattacctaagtgtgacacaaagacatgaagtaagcccatgctgttggaaaaatggcactgacagacttgcttgacacagggctgccacaaaccttcagtttataaaaaatgcaacgtctgcgaagtgctatacagtgtgaagcatgataaaacaagctgtgcctgtatatatatataccgtcatgcactgcgtaacagtgttctggccaacaacagagcacatacatgacagtggtccagtaagattataatggagctaaaaatcttcccattattcaggtgtttgtggtgaggctggtgtaaataaatctaccatgctgccagctgtataaaaggacagtgcatacaattatgtactgtacatcatacttgataatgataataaacaactgttactggtttatgtatttactacactatacttttaattgttatttaaggtgtattctttcacttactttaaaaaaaaaagttagctgtaaaacagcctggggctggtctttcaggaggtattccagaagaaggcactattatcatgggtgatgacagctccatgcgtgtactgcccctggaaccttccactgggacaagatatggaggtggaagacagtgatatcgataaccttggccttgtgtaggcctaggctactaggctgatgaatgtgtttgtgtcttagtttttaacaaaaaaacttaaaaagtaaaaatttttgaagtttttaatagaaaaatgtttatagaataaagagataaagaaaatatttttgtacaactataatgtatttgtgttttaaggtaagtgctataataaaagattcaaaagttttaaaatgtcaaaaatgtataaagtaaaaaagttacagtaagctaagcttaattaactattgaagaaaaaaattatttaaatttagtgtagcctaaatgtacagtgtttataatgtctacagtagtatacactaatgtcctcggccttcacatatacttacaacttactgactcgcctggagcagcttccggttatgcaagctccattcatggtaactgtcctaaacaactgtaccattttttatcttttatacctaattttactgtaccttttctatgttgagatatgttttgatacacaaataccttaccactgtgttacagttgcctacagtattcagtagagtaacatgctttacaggtctgtagcctagaagcaatagtctagaccatattagcctaggtatgtagtaggctctaccacccaggtttgcgtaagcacactcggtgatgttcacacagtgaacaaagggataatcagtggtcccatagaacagaatttataatctagaaacagacccacatatatatgtccaactaatttctgacaaagatccaaaggcaagtcgatggtgaaatagtggcctgttcttacatcatctgatgtgtgaataatgagacacttagatgcaaacaatgaatcttgacccaaatgtcacatcttacacaaacaatgaactcacatcagatcttagaactagaaaacttttaatataaaacatagaagaaaatcttcatggcctgtacttaggcagagcttatagatatgatgccaaagcatgatccataaaagaaaaaaatggagaaattaaactttattgtatttaataactcaggatgaatgggaaagtaaagatattacaaaaaatgaaaaagcaagctacagaccagggtaaaatatgtgcaaatcatatattcctccaagggctagtatctagaatatataaagaattctcaaaactcaacagtaaggaaacaaatcactcaattaaaaatgagcaaaaagactttggcagacttttaaccaaagaggataaatgaatagcaagtaagcacatgaaaagatgttaacatcattagccactaaaaaacatgtaaaatcaaaagataatgaaatactactacacacctattagaactacttaacaaacaaaacctgacaatatcaagtactggcaaggatgtggaacatctggaactctttacacattgcaggtgagaatgcaaaatggtgcagctgctctggaaaacagtttggcagtttctacaaagttaaatatttaattatcatatgacccattcccagttatttaacctaaagaaaacttctattcacacaaaaacctatacactaatatctacagcagttctattcataatcaccaagaactggaagcaacccaaacacccttcaatgagagattggatccacaatggcacactagtcagtgacagaaaggaacaaactatcaatacttgcagaatcatggatgaatctccacagcactgtgctacgtgaaagaagccagtctcagaaggctcgatactgcatggctccgtttacatgacattctggaaagggcaagactatggtgatggggagctcattaacggcagccaggggttaggagtaggaggagtgtgtgactacaaaggagcagcacaagagaacaacagaatcataaccatcaagctgtacacacaacacacacacacacacacagagttaattttactgtattatttttaaagaagttgttggtttacagtgataaaattgccttttttcccctgctttttcaagaaaacatctcatccttaagacacagacccaatgccagcattttgtgaagtcttccccctgtaactcagggagagtcagcagcctggatcatattttcatggaactttgttcatatctctactctcatgtttacttatcttcctcccgctactagaccagaaaattcaagttgattcgcaactggattatgatcaggtaaacaaatatatattgcgtgtatagcacatatactagacattcactaatgtttatttttgcattgctaatactcaaatgacaaaaaattagaatattagtactataatatttatcacattcaatcactcacctaacatatgtgagattaaatctaataggcagttggaagtccagctgaattgtagcacattgatggtatctgccaatagcatccttgatttttatgtcaatctacaaattaaataatgtttgctcagaaaagagtatttatttttcttttacattttgctgttttgaagcatgtggtcgactcactttagggccataaaatgctccatctcctgggttcattttccacggttctccaaagtccatcaagctgttctgcagttgctttttcaaaagaagaaaaaagatacaattatacactgtatcttttttttttacatacagctcacaaaagttactataactcttcattacagtctatgttagttcaacatatatttattgagcatcttttacattcaataaactattgagcagggactacacagagatgattaaggtggcacctgctctcaaagaaacataaacatttcaactggggagaaaagatcatttataaattgttccagtgaattccaggtaagcattagggaggggtcgcttttgaccctcctcccaacacaggccccctgtgccctacacatcaaccagcttctgcctcctggtgacgggcctccacacatgaaaaagcagaaaagccttgatcacactccctcttccactctgagtctgggtgggtaagaaggccaagagggcaggccttactacttcctttttgcctttccttcacctctgcacgtgtctgggagggtcacttataatttataggggtgtggaggcatgaggctccacttttgtcttcagcctaagccaccacatgccttcaacttagcttgtagtgaagatgttccacattgaaggtgaggatgcaagtgtattaatgaaaaatttcccagagtcttccagtattcccgtgaatccagcttccctgggaagcacgtgggcattcctgagtccttggccaaaagtactgccaaaacacgagccaaactcccatcatcacctccaacatacgggtgcccatgagggggcagacttgggagtgacgcgcctcatggggaaatcagagccgtggcagagtcttagggccgaagctgccatcatcaagaaagctgactcctgggaaagctgactcctggagtcctggcagcctttcccaggacctcagtcaggatctgatcttgagagagacggagatttttttcctgggatcctgggagtgtcccgcataggcctgatcttacagaagcagcttcttttctacttaggaccagagaaagccaccccacggagacacttccggggcctggaggctgcgctcccctgttccactctgtttctcaaaggagaaggaacacaggtacatgtttccaggacaaatgaggccctcctacagcagataccaagtgatggaaagaattctggggactgcaagaagctaaaaagccaaggaaaggccaagttttggagaagaggataaagcaggggtcactgctgctcctcgggccttggaggacacaggacaggagggcacagtaggagctgccagagccgagagagcatcggatacatgaagatgtgtctctttcaaaccatttcagacacttctgaagacaaaatatttcaatgctcacctcagtgatttccaggccagggttagttattggagagaaatatctcaaaagtggaagcaggtccatccagtcacacccctgggtgacctcaggcttggctgctaaactatttacccccattaattaagaaaggagcaaaaatgctgggacttccagcctattctccccatgccaggtctatacctggtccatccccttttcagctccccacaccccaccaagtttcaaatgaatggagtaatgacaacgataccaacacctgacatctactgggcacttacacgtgcctggcactatgcctaacactccatgtaaattccttcatttaagttcaccataccctcaggaagtgggtgtcattgctacatcaccaccaccaccatcaccaccatcgttatcatcatcaccatttcatgctggatcctgatgcttatagatcttctataatttactcatggagataaagtactttcagactttaaagtctggagcaaatggctccagagctgagctctgtgtcctcatttcctcttcctgcttccacatggctgttaggtaaactgagtctgcatccttcccagggtagataggctatctcatttggccctctttgtccatgcagtggatgtggaagaagagcttaggatgggcacgggtcagtggggaggagaaggccctccttagagctcaaggctaaactgcttctgtgcagcctctgctcggcttctgcacctattaatcacgtaaaaataattgttatactattaatccagggcttctctgattcttatttctcatattggtgtgttaagctcccaggagtacagtagtcccccttctctgtggtttcatttttctcagtttcagttacccgcagtcgactgcagtctgaaaatattaaatggaaaattccagaaataaacaactcataagttttaaattgggcactgctctgagcagcaggataaagcactctcctactctgccctacctgggatgtgaaccgtcctttcgtccagagtctccatgctgggtgcactgcccacctgctagtcacttgggagctgccatgtttatcaaatcaactatgcagtatcacagtgcttatgttcagtcacccttattttcctgaaccatggcctcaaagcacaagagttgtgttactagcaatctggatatgccagagtgaagccacaaaatgcttcctttaagtgaaaaggtgaaagttatccatttaacaaggaaaaaagactcctatgctgaagttgctaagagctatggttaaaaaaaaatcttctatccattgggtaagttgtgaattagtgaagaaggaacaagaaattcatgctagtttttgctgttgcacctcacactgcgaaagttccagccacagtgcatgaacagtgcttagttaagaaaagaaagggcattaaatcccagcactttgggaggccgaggcaggaggatcaggaggtcaggagatcgagaccatcctggctaacacggtgaagccctgtctctgctaaaaatacaaaaaattggccgggtgtggtggcgggggcctatagtcccagctactcgggacgctgaggaggagaatggcgtgaacccgggaggtggagcttgcagtgagctgagatcgcgccactgcactccaacctgagcaacagagcaagactccgtctcaaaaaaaaaaagaaaaaaagaaaaaaagaaagggcattaaatttgtgggttgaaggcatgaacagatacgtgtccttaacctgattgccatcaatttggtaccatccagggttttgggcatccacttggggtcttattcccatggataagtggggactattatattccaagaagaggagaactaacaggcagagcagggtgtctggccatgacaccatcctcatttttaataaaagtgaacacaggaaacacactatatcctttgtgtttattaagaaaaaaaagcaatgtgatgatctccttatcttggttttgcaaagcttagatgtaacatctttgggcttgagtgtcttcagacagacacagggcagggcacgacaggacgtgactacgaaggggactatgcacatctacatctagaccatgcagccctgggactctacagtcggactaagatgactcaacaggcaatgctttaaaataaaccacacaaaccgagagttacagcaatcagaggatttctttaaaatcctgggccagctattagtgaccagcactgcaggactataaataaaagccagatatgaactttaagtgtgaagcaaatgtaaggtattattatcaccgtcacaaagataatgggataaccacattctacaacctatatatctatctcataatttccaggttcaaaatttctattacaaattattgcatcctcctgtgaagactgcagcctctcaggtgtcttccatacgactaaaatgaagaggaagcacaaggtgtgtctcttaccttctcagcctcattccacatctcaatctctcctaggaagttttccggccttgttgacaggtttaattgaaaggagaagccaaatgttgagtaaacagattgcaaaaactgcaaacacccctttatttcttcttcaatctgaaatcaaagcaaatgaaacattcaaatagaacatcaaattcatttatgttttaaaaaatacaattcttcatgtcagacagaaataaagcatgtttttaatggagtacagttgatgatcctgttttggttgcttatccaatcctgagctgaaccttcgtttgagtgctaggcacgtgcagggaatggagaaggagtaggcgagggaaccgtactgtgaaaaggcagcgccgcgcacaggagagcggcacggaggggctgcccagaggaagtgagactgagctgcagcaggggacaagcaaacgctctgcatggagcggaagctcaggagctctgtgagcagaggacacactgagttgaaggctccgtggacagaggagcagactaagtcggggggctgcatacgatgggctgaagggcagaggggcagtgtggtaggtgggcaggggccagagaaaattaagtgctttcaaagccaggcgaatgtatggattttttaggctgagaacaacggggaggcaatgaagggtttttgttttgttttgttttgtttaagcaggggactaacatgagtcaatgtgttctttcacagtatgtggaatgaactggcaagattagaagagagccccatcaggaagctggctgagtcaattaggagcaagatgacagtggcttaaaccagagagaggcagctgaaatgcagggaatttgatggatttgagacatcaagtctttcattcattaactgcaatggctagttttttgttttgttttgttttttgagacagtcttgctctgtcacccaggctggaatgcagtggtgtggtcttggctcactgcaacctctgcctctcgggttcaagcggttctcatgcctcaggctcccgagtagctggaactacaggtgctcgccaccatgctcggctaatttttgtatttttttttttttagtagagaaggggtttcgccatgttggccaggctggtctcgaactcctggcctcaagtgacccacctgcctcagcctcccaaagtgctgggattataggcatgagccactacacccttttttttttttttttaagttcctgggtgcacgtgcaggatgtgtagtttgttacataggtatatgtgtgccatggtggtttgctccacctatgaacccgtcacctaagtatttaagcccagaatgcattagctatttatcctgatgctctccctccctcctcttccctccgacaggccccagtgtgtgttgttcccctccctgtgtccatctgttctcattgttcagttcccacttataagtgagaacatatggagtttggttttctattcctgtgttagtttgctgaggataatggcttgtgatggctacttttaagtgttaactcgactgagctaaaagatgccagacagctggccacccttacaacatttatttctgggaatgcctgtgagtgcgtttctcgaagagatgagcatctgaatcagtggaattggtaaacaacttccaccctcaccaatgtgggtgggcctcatccaatctgttgagggcaggaatagaactcaaaggcagaggaaaggcaaattctctctctttttgagttgggacatttattttctcctgttctcagacactggagctcctggttctcaggcccaccaactctgggacttacaccagctccctcctttgctcaccccactgaggcttttggccttagactgggagttataccatcagctttcctagttctccagcttttttttttttttgagacggagttttgctcttgttgcccaggctgcagtgcaatggcacagtctcagctcaccacaacctccacctcccgggttcaagcaattctcctgtctcagcctcctgagtagctgggattacaggcacatgccaccacgcctggctaattttgtatttttagtagagacagggtttctccatgttagtcagtctagtctcgaactcccaacctcaggtgatccacccacctcagcctcccaaagtgctgggattacaggcacgtgccaccaagcctggctaattttgtatttttagtagagacagggtttctccatgttagtcagtctggtctcgaactcccaacctcaggtgatccacccacctcagcctcccaaagtgctgggactacaggtgtgtgctaccatgcctggcctttctccagcttttaattggcatatcatgggacttctttttttttgggggtcattttttttttttttttgagatggagtatcactgtcacccaggctggagtgcagtggcatgatctcggctcactgcaacctctgcctcccaagttcaagcgattctcttgcctcagcatcctgatagctgggattacaggtgtgtgccaccacacccagctaatttatgtatttttagtagagatggggtttcaccatgttggtcaggctggtcttgaactcctgacctcatgatctgcctgcctcagcctcccaaagtgctggaattacaggcatgagccacctcacccagcctgggtcatattttttaatctactatgtcaatctcttttaattggtttatttagaccatttacacttaatatgttagggctttacactgcctttttgtttccttcttgttctctcttgttattcatttctgttttatttttcctgtcttcctatggattactttaacatttttctggaattcaattccaatttatctataggttctcttagtgtatccctgtctatagcttttttttttattggtttctctaggtattatataacttatcagtccagatattgtcactttaccagctcaggtgaagtacaaaaacttttattccctataccttaccccatttatagtataattttcttaaacatttcttctacatacatttagaacatcagaaagaacatgtgatttttacttcaatgatcaaacataatttagaaaacgcaaaaggagaaggaaaatatattgtatttacctgtttttattttcacaatctttttcttcctaaagttccctgattcctcttttcatcatttcctttctgtttagaaaacttcctacagccattcttttggtgggtccaatgtcttgatttcccctcaattgctgaagggtattttctttagacatagaattctgggttgaaaattcctttttcttttttcagcactttaaaagtattgtgccacttccttctggcctccaggatttttgttttttgttttttaatgagaaattgctatcattcaaattgtttttctctttaaaggtaatgcataatttctctctcattgctttcaagcctttcctttgtctttagttttcagtttactatgatatatcttggtgtaggtttcttggagtttatcctgaacagctttcttgaatctgtagatgtcttttgccaaatttggcaagttgtcagctattatttctttgagtactttttcactcccaccttcagtctcctctccttccaaaattatgatgatatgaatgttagatatcttgttatatcccactgttctcaggctctgttcttttctctttcagtctgttttctctatgtttttcagattgtgtaatttctgttcttgtcattatgtctgtcttcaccattctgctcatgaatctattcactgaatattatatttctcagttcaaaatttccatttggttcttctttatatcttctatttctttcctgagattttctgtttcttcgctgactttgtaatttttgtttgtttcaagtgtgttagtaattgctcattagttagtaattgcatttttatggtggttgctttaaaatctctggcagataattgtaacatctttgttatttcagtgttaccgttcatagattgtctttttaaattcaagttgagatttttcttgttcttagcatgatgagtgattttcaatttcttaaacctggacattttcggttttatagtaagcctctggatcttaaatgttgttttagctgacttccactgacactcttccagcagagggaggacagtactggacagttactggcaagtgggaaaagcagtccaagctccttttagaaaggaagtaaggggagaggagctcctcgttacttctgggttgcacaggtgttctagcccccctccatggcctttactgcacacagaaagcatggcctcatgaccaattggcagtgagaaagtcttatctttccactagacgtcttctgacactactcaagcaggactggaagaggcacctcattacttccaggggagggcaaaagtccaggctccccacatagtcttcactgacactgctgggttgggggagggggatgggatcttgttaatgcaggagtaaaattcccagcttcctaataagccttctcttacccattccaacaggtattgaggtacttatttagagcctgctgagagttaaaatataagcttctcaatcagccttagctggcatataaagggccacagttttttctgtggtgtctggttgaaatagagtagatattgtctaaaacttttctatctttctaggctgcccctttcctagtcctttggctacagcaagcagacttctgttggcctgttttatcgatgcctgttggcatctgttggttgccaagtctggaatatatgtggcaaaacaaaacaaaacaaaaacacctaaggaactcactaccatgttgtttcttaggtcctgatgtccatagccagtgtgccctttttctcaacacctttcagagtctcgtgtttgttttatatgtaatatccaaggtttttacttgttcttagagggaaggaaagggaaagcacctgcttcatcttccccaaagcaggtcttttttgctcattgtttaactgggttgtctgttttcttattgaggtttgaatatttgttaagtattctggattcaagtcctttatttgatatatgcctcacaaatattttctcccagtctgtaacctgtctttcctgtctatgatcagtattttttgaagagcagaagttttaaattttgaggaatccaatttatcaacttttttcttttatggattgccctttggtgtcatatctgagaaatcatcacctatcacctaattacaaagattttccccaatttttattctagaagttttgtatttttatgtttgacatttaggcctgtgattcatcttaattttttcatatggtatgaggtatgaatcctcatacctcatgttttgcatatggatacacaatcattccagcatcatttgttgaacatattacctttcctccattttattgccttcgaatcttaattaaaaatcagttgtccatatatttgtgtctatttctagactctgttttgctgatttatctatctagaccagcatgattactgtagtttctcataattcttgaaaccaagcatagtgactcttccaaatttgtttttatctttcaaagttcttttggctattctaggttcttgtgctttctatacgaattttagaatcagcatgtcaactcttacagggaaaaaaggtctgcttgggtattgactgggattgtactgactttatagatcaacttggggataactgatattttaataatatttagtcttccaaaccacgaacaaggtatatttcatttatttaggccttctttaaatttatctcagcaatgttttaaagttttcactgtataggttgtgtatgtatgtattactcagcttgggctgccagaacaaaaatccataggctgtgtggcttaaataagaatcatttattcttcacagttctgcaggctgggaaatccaagatcaatgtgccagctgattcagttccctggtgagggctttcttcctagtttgccaacggctgacttctcactgtgtcctcacacggcagagagaatcagaaagcctctggcatctccttaaaagggcactaatcgtatcatgagggttccatcttcataatctcatctacacctaattacttcccaaaagccccatttccaaacaccatcacattgggggttaggacttcaacatataaattttgggagtcacaattcagtccatagcaacatatttgtcagtcttatcccaaagtactatcatatgttttgagatgctattacaaattgtttcttatttgcaatttccaagggtttattattatgaaatgcatatacaattcatttttgtatgttgatattccatactacaatttttctaaattcaccttacttctaatagctttctgtagattccatctgatctctacatagatgatcatgtcatttacaagagttttaattctttccaatctaggtgttttttatttctctttcttaacttactgcatcagaaagaacctgcagtacaatgatcagagaagtaatgagataatccttacctaatatctgattttaagagtaaagcattcagactctcactattaagtatgaggttagctgtaggtttttcatagaggccttttatcaggttaagaaagttcccttccattcctagttttgagagtttttatgagatatggatgtagaattttgccaaatacttttccctgcatctactgagaagataatatgctttttgtctttttgtttgttttcttttttttagtttgtgaatgtggggaattacaatgattcattttctaatgttaaactaccttttcattcctgggattcagtccatttgattaagatgtcctttttaaaaaattactagatttgacttagtaaaatgttgtttaaattttttgattttatgttcatgagagatgttcagtagttttcttttaatttctttgtcttatttttctatcacagcaatattagcttcattagcttcatgaggtggtgaagatttcctcctcttcaattttctggaagagtatctctagattggtattattccttctttaatgtttggtagaattcaccagtaaaaccatcttggcctggagttttctgtgtaggaaggtttttaactatcaattcaatttctgtagtagacacagggctattcagatgatctacttcttcttgagtaaagtttaatagttttgtctttcaaagatttatccatttcatctaagctgtcaaatgtatgagcataaagttattcataaaactgccttatctttttaacagctacagaatctgtagtgatgacatctgtctcattcctgacatttttatttgtcttttttccctcatcagtctgactaaaggtttatcaattttattgatcttctcagagaaccagcttttgttttatttttactctttattttctatttcagtgatttctgctctgctctttcttattttctttcttttgcttccattacattgggtgtaatttgttcttctttttctatcttaagtaaaagctaagtcattgatttttcttttctaatgcaggtattcagtgctataaacatccctctaccacttaaatcgcatcctacaaattttgatgtgtttttatttcatttgttatataaaattgtctaattttcctttggattttgtgttatctatttttaattctattgtggtcagttaggattagggttaaacattagggttaattaaacattttattttaattgcatccctttcaactcactgagacttgttttatggtccagaatatggtctattttagtaaatattctacgtgcaatttcaaagaacaaatactctgagctttttgtagttcataagcgtgatgactgggtgtacacacatgtgtaagatgtacctccctcacacctcggtacaacattggcatattacccaccccacatgaagcacattggatacaacactggcacattacccatccaacatgaaaccaaagaatgtatattctgctgttgttatataaacatcaattaggtcaaattgtttgacagtgaaactttgcatggcaattttaacttgaattaacacaaaaacttgaaaaagtaaattttaagttctaggcgatactgaaaaacaaaacatccagaattccaccaaatcccttaaaatactccacttaatggaatttaggttaataaaatcactgaaggaatatatttcatgtcaagagatgattaatctattgacctaatttagagaatcacagcaggttagagctgaatgaatctcagagactagaccaaacgtctatgtttcagtaactctgaaagaatacaagatgtgtgcggggcatcacactcaatttgtgaccacactgcttcactctgtgttattgtttacctgctccactgtgcaaaaaatgtgagcatcgtcctgctggaagcgcctcactctggtcaagccgctgagagtccccgacagttcatttctatgcagaactccaaaatcagcaaatctaataggcatttccctccaagatcgtggacgatgggcaaacattagactagaaaagatgtggtaacacacagcttttacacagcacagaaatattaaataattatctaaatataaagaaattacaattaagcctcaagattcataaactccttattctagttcttagatcaccaggttaaaaaaaaaattcttccacaaattagtgaaccttgcatttacatcactgcagcactctgagaaagatgcttgtctattatctcttcccagaaatgctgttccctccccttatccacacagtgaatcaccatttactgtttatgattcatttcaaaggctacttcttaaatgaagccctcctagacatttcccagacagggctaggcagtttctcctcacgttcctggaacacctcaaacatgccatcattatggcactggtctttttataacagattgtctacatgcatggccctgcccactctgctcatgagttccatgagggaatggtttgtgtcttaatcacctctgcacttctagctccaagcacaaaaagcactcaactatgttctctgttgaatgaaagacttctctcctgcagaaagcactcctagcttccatatcccattgcctctaagccaccgtggtcttgctttcttattctgaggtgtaaaaagacaaacttaaattctctactttcattataaagtacgaggctataattttaaaggatgcctttgagaagatgagttaagaaattgttaacacaagtgttttacaatgcaaaacactagcatagcttctaccttctgtttagaaagagaggatacagaatgtttacataccggtgttcctaaaattaaagttatatatattttttacatgacatcatcataaagttaaatttcttctcatcttcacttaaaagggcaaagagctttcttcagtgttcagttaccggttttaataattatcttctaggtaaatttacttgaaactatgtatgttgataatacaaaaactacaattgttgggattgttttttgtggacaattatgcctattcagtttcagttgtacaatatgtttgtcttacaaggttgaatttgcataccaactttatgataattagtctttcatagaatcaaagacagcattgattgtaaaatgtatcttcattttatgtgctacaaagaaagaaaataacctattaattaaattatgatataatgctaagatgccaccaactataagatgcatttcaacttcagaaatgttgaaatgtggaagaaaaatggtatcttggaatcagtgaaatccagaaacccattgattatgacctcattgatcttgttataatccacccaaacagtatgaaagaactaaatattctgcaaatatgaacatgtgaagtgcattactataagaaagacaaatattataaaacttataaaattgacacataacattatcctttaatcagcacaaaaaaatgcaatggttaccagctaacatcccatacctgccaaagatcaaatatattttcaaaagtaaatccattctccggaatgaaacaacttagtaaaaattagtaatcaccactcttcagattaaagggactctttcattccacaaagcattaaaagataattgtgacgaagcgtgctatgtgctctcatgaaaaggtctgcttcgcttttaatactcaccagtgccctggacaattcatgggtttgagggcaaaagtgtccttttcaatctcaaaggtaaacatgttctcgctgtaatgctgccagtggcctgaggcttcccagagtttactgttgtacatattgggagagagcacctccgtgaagtcccgtttgtgatattcctccttcaagatacatgcattcaacattaaaatctgctagggcagatcacaattccatgcaaagtaacactatgagcaaatattttcaaattgggctcatgtcctatattaattcatgattaatgtaccctcagttttaggtgtggtggtttctggatcttggaagaaagatttacatatgcttagtataatttctattgagtatatttattttatagcatataacagtatatagtatataatgttttagttctttgaaaagtagtaattgaaatacaatatatatagaaactcactgtaactactccaaagtccttctaaacaggttttttcctattaagaggcagaaaaaatttataatttaataagcctgaatgccatgttgcatgttataattttgatttatttagttttaaacagaaataagaattttagtgtataacgatttaagtagttgaaattattaagtcatgagctggcctctctccctccctacctattaacagcttccctaattgaattactggagacaggagaagagagtttttttccaagcaaagttttaactttatttaaactttctttaaaaacaaaacaattaggtgatctttgttgggtaaatattttatgtgcactttccaaaaatgcatattctgctgttgttttacaaatgtcaattaggtcaaattgttttgacagtaatttgatagggaccctttgcatgacagttttaatttggatgaacacaaaaagctgaataagtaagaattctgagaatccttagattctcaacatttgtaaaccacttaatggacatctggcccaaatctagaatgccatgtatactttgagcacatttgaaaaactgttttcacagctaaaaaaacataaaacataacattttaagattactaacaatggttttatacaactgaaaggaatgttgtctgttattcttcagcagggcatcctggcagtccacggtagacagcttaggtctcggccattcagtgagctgctttacctatcctttgtttttactaaattagaaaaccttaacaggtagggtgtggtggctcacgcctgtaatcccagcactttgggaggccaaggtaagtgcatcacctgaggtcaggagtttgagaccagcctggctaacatgatgaaaccccatctccactaaaaatacaaaaattagccaggcgtggtggcacacacctgtaatcccagctactcaggaggctgaagcaggagaatcgcttgaacccaggaggcagaggttgcagtgagccaaggtcacgccattgcactccagcctgggcaacaaagctagactccatctcaaaaaaagaaagaaaatgtttaacaaaatgatgtcattaagaatggcagtgattattggctatttcagatggttccatatattcagattaaacaaggtcccagaaattaagggtgagtgtgtgggtgtgtgtgtggcagggtgtgcgtgttcgcttttactaaaaactacttttaaagtctagctcaggagatactgctcaatgcatttttaattcactctgaatgcaaccatgttaggaatgtatgtcttcttgagatgtttagaaatgattttaaactatccctgcaatggactgaatgtgtctcccccaaaattgtgatattgataccttaaccccaaggtgatggtattaggaagtagggcctctgacaagtgattaggtcataagggtagagccctcatgaatgagattagtgtccttataaaaggattcgcagagagctctctggtcctctttctgccatctgaggttacaagaagtcagcagtctgcaacctggaagagggccctcaccagaacccaaccatgctgggaccctaatcttagacttactgcctctagaactgtgagaaatacccttatgttgtttataagctacccagtctagggtactttgttatagcagcacaaactaatgaatataatccctatgagatgaagtgtcagcaactattatatttttacataaatatataggagatatctatatatattatgctgctgtatctctccatattgtaatatacatattgttttgtctctcacacacacatataaataacagagagataaagcaaactggcaaaatattaccaactaatgaatccaaatgaaggaaatatggatgttcattgcattgcattttagtttttctctagatttgaacttttcaagagaaaaagttggggagtaaaatatgtctcatgccatgccattaatttctttctctaatgctgggaaagagtaaactctcagtgactgagcagttcacagctcagtccagtctcctgaagaaatccagataacttatctggaacattaaaaatcatatttcatcctggaaataccagtttaggttattgaaggagctgagtctctacccatacctagtgatctggccacttaaaaacatctaaatagcttctaagaatcagtgtcataaatttgttttcaagtaatttctcattgtaaaaaataaggcaattccacataaacagctcctttccaaaaccccattaaaataagagtaaagaaagtttttataagagcataaatctaccaggacaaagaaaataggagagaagatgaatgctataataagttagaatctgcaaagtaggtgatcaagtgttaattgcctcagaagacctaggaaagccaaaactaaattggcagtgggagaaacccagaagcaagctactttaactgggtatagatttctaggcttcgcattactaaggcattgttcctgtcttctgtttttcagtgtttccactgaaaatttcaatgccattcagatacccagtcctatgtctgtggcttttttctctctggaaacattcaggatattttctttatccttggagctttggaatctttcgataacatgttttggtgcccaaagtatgttttcaccaaaaactgagacatgcttgggagttgagattgtccattgcccattatgggctccctttactatagaactgatagacagaaaaggacttactacccttgatcccaattacttggggaaagacttactacccttgatcgcaattactgggagaagtcgtattgcttacaatggagtaaggaggactgtgtctggaattcagtggggagcctttgatatcaacacatctagcaacaaccatcagtgggagccctgaaaccccacaaagagcattactaaaaccttggatcctaaggacagactgaggccatccactattattggtttaactgtattctccaaataagatattttgaagtcctaactcctagtacttcagaatgtgtccttatttggaagtagggtctttatagaggtaatcaaattaaaatgagatcattagggtagatcctaatactatatggctggtctctttataaaaaggagaaatctggacacagagacagatgcacacaaggggaagacaatgtgaagacacgcagggagaacatcacgtgaagacagaggatgggaatgacgcttcaacaagccaaggaacactaaagatgactggcaaccaacagtagctaggagaaggcaaggaaggattcccccatgggttttagagggaacacagcctcgtcaacaccttgatttcacacttctggcctccaaaactgggagataataaatttctgttgttttaagtcacctagtttatggtattttgttataataccctaggaaactaatgcacccaccaaataaaacaatgcccatctggggtgccaccaggataaggcgaatgtggaatgagtgatgggaaaagaaggctctgatgtatcagcttggccctagcgtccatctacagaggctgaaacagttacatttagttatgacttttccttgcattcttacatgaagggcactcatggtggccaatggcacgattcagatttaggtgaaactgaaatgacatcaccacatgatgacacatcggctgatcggagtttgtgggaggaaaccaatgtcctcagtgtcctccaagcaaaaggcaagaatgtgctgagaggcacagggggtgagccaggctggttattttccatttgccactgcctgtctcgcctcatcttggcccattttccttccttctctgccctgcactgtgttccccaaagctgacttctgtgggctccgcacaaggcttacttgctgtgattattatttttttattttataaaatatatacttttaaacacaatagtataatacaacatgcttaaattatgtttcatgtggaaaaaaataaggtgtataaagaaaacctgaacattttctctcattccaccctttactgccctgagataatgctaatggcctgctgttcctgtatttcaaccctctcctccatgactgtgcaaacacaaaacacacatacaggattttgttgttttttgcttttacctataaaaagaaaggatacactatacatttactctgtcacttccagttttcaatggtgaggtatactgaacccccttcaagttagtatgcatagatgtatttttgtactaactgcatagtgctttattgtgtggacatgtcacaaagtatttaatccttctactattgagaaacattagacttttcatttttgaatactacaaactattctgcagtaaagtttttttctatgtgattttaattgtatattttagattcctttctaagaatattgctaggagtgtgcatttttttcacattaatatttgttaccagattagtagcaatttaaactttctctctaagtatatgataactgtttcctcacatttccttcagcaatgaaaattatttaatgggtatcaatctttttttttgaaatggagtctcgctctgtcacacaggctggagtgaagtggcgtgatctcagctcactgcaagcttcgtctcctgggttcacaccattctcctgcctcagcctcccgagtagctgggactacaggcgcccaccaccacgcctggctaatttttttgcatttttagtagagatggggtttcaccgtattagccaggatggtcttgatctcctgacctcatgatccacccgcctcagcctcccaaagtgctgggattacaggcatgagccactgcgcccggccaatgggtatcagtcttagaactattacctcagtatttatatatatatatatatatttttgaaacagagtgttgctctcttgcccaggctggagtgcagtggcacaatcttggctcactgcagcctctacctcctgggttcaagcaattctcctgcctcagcctcccaagtagctgagatcacaaatgtgcaccactacgcctggctaatttttgtatttttagtagacacagggtttcaccatgttggccaggctggtctcgaactcctggcttcaagcgatccacccctctcagcctcccaaagtgctgggattacaagagtgagtcactatgcccagccttttaaattttcttcaataaattttatttcacatatttgagattcacaacatgatgttataggacacaaatagtaaaagagttaccttttttgtgtgtgtgacaagagcagttaaaatctaattacttaacaaaactccctgataaatataattttgttaactttagtcctcatgttctgtattagatctctggccttgttgatcctagatatctattttgtatcctttgatctatatccccccatttcttccccccaacccctgaccatggtaagcactgtttaattctctgtgtatgtacctgagctctctcctttttttagattcatcagctcccctggttctcaggcctctgcactcaggcgagaattacatctccaactttcttggaccctcagatcatgggatttcttggcctccataatcacacaagccaattcctcataataaatctcttcttttctatgtatcttgttggttctgtttctgtggagaatcctgacatgccaatatactttccatatggtttctgattgggtctgaccaatgggaagttccaaaggattcacagggtagtggaagagagaggtctggatatttctttccctggttctccctgctgtgggtttactcaggttctggctgtgttccacagttacagcttctgttgtgtggcctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccatggctccaagctctctgtgggttctggtattactactccatctcctcacttctctcctccatggctccaagctctctgtgggttctagtattactactccatctcctcacttctgcaggcctagtgatggaggggaagggattcttgctattggtaatccctgggcgctctatcatcccttgttagttaccttagccaggcccatatctccataaatacttccttcactagactctcttcagttaaacccttggagtgcatctttcaggactctccctgcagaagagctgaatgttttgaggcctgccatgttcacaaagacaagcttggtctagaaattcactccatctaaggttgtgtgaagaggaagcaaaaattccccaagtgggttattaatataacaacaagagaagccactcccctccccactccagggtttcaagacatgcatcaacaagtcaggcagattccaggaaatgcaaaaggtgtgactgagatgagctttacaaaagcaaccctcatgcacagctggtgggaatgcaaaacagtagtcattttggaaaatagtttggcattttcttataaacttaaatttaccatatctattctcacactgctaataaagacaaacccaagactgggtaatttatgaaggaaagaggtttaatggactcacagttcagcatggctggtgggggggcctcacaatcacggtggaaggcaaaggagaagcaaaggcacatcttaaatggcagcaggcaagggactttgtgcgggggaactcccttttataaaatcatcagatctcaagagacttattcaccaccacaagaacagtatgggggaaaccacccccacgattcaattatctccgcctggccccacccctgacccttggggattactacaattcaaggtgagatttgggtgtggacacagccaaaccatatcaccatatgaccctgaaatcacactcctaggtatttactctagtaaaatgaaaacctatgttcatacaaaaaactgtacatgaatgacaatagcagttttcataactgccaaaagctgaaaacaacccaaatgcccctcaactgcaggatggatctgaagcagtggtatgttcatatgatggaatactgcccagggacaaaagcagaggcccgctggggacactcaactcggatgcatctccagggtgttatgctgggtgaaagcggtcagtctctaaaggttttataaaagtatgattccatttatatgccaatattttaggggtagagaaaaaatcagccgttccctgaggtcagggctggggaggatttgattttaaaagggtagcatgagggagttttgaggggtgacggaactgttctgtatcttgattgctgaggtgataacacagttctgcatgttatcaaaaaggcgtacattttactgcatgacaattaaaaaagttaatttaaaaaaaggtaagaaaagtacagaatcagctgacagatattttccagaatgcagggaaaaaaaaattcaaggagactaacaaaaagatctatttattcactatcagttgtccacacagtcagtaactaatatacaaacaaaagttcacttgcctttacttaaacctaagtggaagtcattttacctgagtcaaaaactcagaaatcctgaaatttccctcagtgggagcagtgtgcacacccagcccatcctggcctcctacatcccttccacagaaatgcagcagttccagttctgaggaaaaggatgcttcctggtagaatgcggccatatattccatcgtgctcagcaccatgtatccccagcactctggctactactgactggtctaggactcagcaccaaggcaaaggctactgatattggaccagaccatggcccctgaggcagcccagctgtgactgagagtctgtcccacaagcacaccctctactggctggtgactaacagaaccaactggaacctcagggaggaccttgaggcacatggaagagggcagagaggaaaaaagacacaggcagatagactgaaaaatatcaagacccaacagtattcttttctccagcaacgtactttaaatatagaaacagaggcagaaaataaaaggataggaaaagatatatcatgcaaacactaatgtaagaaagctagcttgcctatgtcaacaccaaaggagacttttaaaaagatagttttattacaaaaggtcaaatagcctatgaacccatttatatgtgacacctagaaatagtcaatttcatagcgacagaaactagagtggtggttaccagaggctgggggaggcaggcatggaaattagtgtttagtgggtacagagattaagtgtaggatgatgacaaagtcctggcgagtttcggatttgcaacgtggaaagagttctggagatggaccatgacagttgcataataacatgaatgtacttagtgagaatgaattgcatacttaaaaatagttaaaatggtaaatttttatattatgtgtattttaccacaaaatggcttgaggtaaaatttacacgccataaaattcaccaattttaagtgtacaattcagtgactgttgacaaatgtatacagtcatgcgacttctgccacagtcaagatatagaacatttccaccctccaggaagttccctcctgaccccctggagtcaatcccctctccccacccactggactcctgatcatctttctgtcactatagttttggcatttctgaaatgtcatataatggaatggtgccttatgcattctctgacttatctggcttagtacgatgctttcgaggttcctccttcatgtgtatatcagtatctcactgcttgtaaatgctgagttgtattccacagcatggactttccacattatgtttatcttttcacaagctgaatctggggttgtttctggttctgtgctattataagtaacgcttctatgaacatccaaatacaagtctcagtgtagatgcgggcatatgtttttatttatcttgggataattagaagtgggggctggcgtggtggctcacgtctgtaattccaacactttgggaggctgaggcgggcaaatcacctgaggttgggagtttgagaccagcctgaccaacatggagaaaccccatctgtactaaaaatacaaaaatattagctgggtgtggtggtgcatgcctataatcccagctacttgggaggctgaggcaggagaatcacttgaacctgggaggcagaggttgtggtgagctgagatcatgccattgcactccagcctgggcgacaagggcaaaactccatcttaggaaaaaaataaaataaaaaaataaaaggccgggcgcggtggtggctcatgcctataatcccagcactttgggaggccgaggtgggtggatcacgaggtcaggagattgagaccatcctggctaacacggtctctgctaaaaatacaaaaaaattagccaggcatggtggtggcaggcgcctgtagtcccagctacttgggaggctgaggcaggagaatgcatgagtccaggaggcggagcttgcagtgagctgagatcgcgtcacggcactccagcctgggcaacagagcgagactttgtctcaaaaaaaaaaaaaaaaaaaaaaaaaaaaaagaagtggggcacgtttatctttacaggaaatgccaaactgctacaaagtagttctaccattttacgttcctaccagcagtaagtgttatacttgcttcatattcttgccaatgcctgatgtttttagtctttctatgatgggaaggggacattcttcaatcaataaccctggcatgagactctacctgaatacagtcatgtaagggacccaatgcgagaaccacccacaggagcctaaaatttggaactatgaaagacagtaatgatgaaatggcagttttaaactattaagttctgggatactttgctatgttgcaatagccatccagaacagaattttgcactggatgtaggtactgctataactgagaaataaaaataaaatcctaagctccccaactgactgaacagacaccctcttggccaaaggaccccagagaaaccttaaaaactgagttactggcagtgacaagaggttggacatgcctaattatacccactctgtcactaacaaccattaggctttctttcctaagagttaatcagaaacaagcccttttgaaagacttgttccaccactgatttacacaactgagcagcatttcttcctgttaaaagaccactcaccatgcactggttctggttggtttataaaggctgcacatgggatgcctccgtgtcctccatttgaccttttggttatacagcctaatttaaatgcattgtctccaccccaaagtgaacaagggatgcatgtaacatgcatgtttgcttactatgtatataaatgtcccccctttgtgaatattcatagctcttcttataacctgttaaatatttatacttggccaatctcatcagcataaattcctgtcttacttttccctcccttgaaatgcctgcttctggtttctgccagaagctatgaagcttcctagcctgcaagatttcaggctgcaacccctcagaagaaatgaagctctcctttacaattttatgaacctcatgattcttcagttgacataacaataacctaaaacatgtagctttggggccaggtggtgggcagaagctagaagggattcttattacgaggtgccagaaacagatggtgggtaacactgtcaccagaagtaacatggaaaacagaaagggtacccaaagaactcatggacttagctggggagacgtccaggcagaatgtagaaaatgacagccgatttttggctccctatggtaaaatacaagaaaagaggtataaaccaaacgtgaaactaattaactttttgagccaagtttagaggaaatataaagccaccaggacctgctgggttcaaaaatgaaaccttcttatccttagactgtaccaaaaaagactcacgaggcttcaggacacggatcaaattcagattataatcatcaaagcacagccttacggtaaagatcttaagggcggggctgtaagacactgtgaaaacctcagaatgatctactgtaagtgcacctagtaaggcttctgaaagtcttaggagtgtgctttgtagaccctttccattaaacacgaaggctctgaagactctgcagtgtactattgtctcacagtagcctcccaggcaaagaaggatcggtgtcagaaagatgtggatgtggcttttatctaaccgtgttgatgataaatttatagaaaaggactcgcaaagtttttaaaggaattgtactagcttagattgaaaggcagcacaaaatgaaataagggctttggattcccccagccttctacaggaaggaatcaggttgagaacaaagctaccccaggccgggcgcggtgactcacgcctgtaatcccagcactttgggaggctgaggcaggcggatcacgaagtcaggagatctagaccatcctggctaacacagggagaccctgtctctactaaaaatacaaaaagcctggcatggtggcaggcgcctgtggtcccagctgctcgggaggctgaggcaggagaatggcgtgagcctgggaggcaggaggttgcagtgagctgagatcacgccactgcactccaacctgggcgacacagcgagactctgtctcaaagaaaaataaaaaataaaaaaatacataaataatttttttttttttaaaaaagaaagctaccctaaggcacatatgggccatttcttatggaagagaaaggatgactcagagggcagaatcacagccaggcagagcaaaactggatcttaatcaaagtgtatcttttgaccctggggcagtgatgaccggtagataccagaatttctacagatggtgactaccatgtgcctcctactctaccccactcctttttgagtaagactatctattgcattattcctcaagcaccattttacaatgtgagggagatgagaggatgaggtggctgatagataacttgagtttttagttcacaggtcttaaactgtagaggaaatgtacttgataatctgttcccaacaaactgcacccgaggagcctcatctgcagctaggcctgattcagaagatgtcctggatttttgagccaatgtagtaattagatgagccttggaattatttgttaagaatagaacactttggaagagtagaatggacttccctacagtcctttggggctgaaaagacataaacccaccagcctgtcaagtggaaacccaagggggtcatgacctagaaacaggaatcaaaagttgaatcttattaaagtggaagccggccctaacccagtgcaatctctgatcgaattcaatgatcagtccttaatagtggcagagggtgaatgctccagtgggagatatcatctagagcctctacacctaaattacatgtaatacttggcatctaacaaaatattacttgatatgggaagtgacacaaccataataacaaaaaaccaacagaaaaaacagctgagttctccaaaaggtttttttcatggtaaggccaattccttcagacaaaggtatccagaaatgcaaagttctcagtgtcgcctgtgtctgtcaaatattcccattccaagcctcagggacccttcccaaccagtgcccttaccttagaataagagatcactgggtttgtgcatttaagtgcctttacagtttggtgaccctcacaatcaggccctgctcctgttcatcagccacatctgtcttgcatctataaaaaataagagatccccttaatgccactgtaaaggctttctgttcattctccatctattgtactcccaacttgagagtacaaggtgccaggggccatgctgattttccagagaagacagcacatccaaatcagcagctgtgatggtcatcaccacctgcctaaatgtaaatctctgataatcttcagtgattcttcaagtctcttccactgccctctgatctcctaccattgcctcgcattggccagtccctactggaagatgtgtaccccaggtgatagaatacagacatgtcagcctccaggggcacagcacaagaagaaaaagacggagaacaagactggagaagcaaacagagaataaccagtgcaggccacatgccatggattgtcttctcagaaagttactgaagaaagtgatccccaaatgagaattaaagataagcaacgaagagatatacagggaccaggaaaagagactcagcataggaagagacatgaggggagtggccaagatgatgatgaaaagaagtcctaagccatcagtttgcaagaatcttagtagcaagttaattctggagtaggaccaaatttgaaaaaaaaaattactgagcaattacctgaatcattgcagaatatgttgcaaggagatttgtagtttttgagagaaattggagcatgaattagtggtaggcacataaaaaaactaagtaaatgaaaaatttaggtaatgattataggaaagacaaaacagtgcaagcatggaaatgtaatcccagtagtccacccggatcacctgtgaacactatctacacagtccttatcatgtaaatactaaagactttcccacctatgaacttgtaatacaagtaggtattttgcactgttggttttttcctctttcctctggaactgccaaatcacctgggagtcatgctataggcaaagggaagcatcagtggcccatggagcacatttggagaagcaatgcttcatggcttaacactctgtaccagagacgacactttctcctttcttctttttcacagggagtgccacacttagtctaatgcttacctttatattctacatggtttagaaacttatatggacaaaaagtgaattttatgaaatccaggaatgtattcaggggaaacagaaattatctccatgttattattagaaggtacaatctagtacctcactttttttttttttttctttgagatggagtcttgctctgtcaccaggctggagcgcagtggcacaatcctggctcactgcaaactctgcctcccgggttcaagcaattctcctgccagcctcccaagtagctgggattacaggtgtgcaccaccacactcggctaatttttgtatttttagtagagacagggtttcaccatgttggccaggctggtctcgaactcctgacctcaggtgatctgcccaccttggcctcccaaagtgctgggattataggtgtgagccaccgtgtctggccagtatctcacttttaacctcaaaattcttattaatgttaccaaagtaaagttaatggaaacgcttgaccactttattatgagagaaaatagtaaaaatgtaaactggaattgaataagaataaaacattttaaagttaacttactcgtatgaaatctgtaagcgtattataaatgaaggctcctctgggaaggaaaaaacagcttccaggactcaaatcgtggaaaaagaaaagttcttgttcctagattgaaacaaaaattgcatttcaaatgtcatctgctattgcttaatatttactgcacacacatataatactcagttatttccatcttctctagtaatagacattccaaggccattcaacacttatacctaaatgcatgcaacagcatatgtaaaatttccaatcatatttatgcctaattagctttgaacttagcttttacttcaccttctgctattctctgcgaattttcttacttggcacacttggagtacggcactcatggggagacaacacggtagaaagaccaaaaaagttcattgcaggaggtgggctttaggtgatgatgatcatcatggctgctgcctactgagagcctatcctgtaccaggcaccgtcacccagtttctgtcttcacagccaccctgcaaggctacccagcaaggaagacaaggacacggagcttgcccatcatctaacacaactagtgagtacaaggactgggcataaagctcaggccgagctgctttccagtctgagcttttccttctacacgctgctctgtctcccagatacaaaggatgctataaagtgcacagaatgtaaaaaacaactctttttttttttgagactgagtctcactctgtcgcccaggctggagtgcagtggagcgatctcagctcactgcaacctccgcctgccgggcccaagtgattctcctgcctcagcttccagagtagctgggactacaagcgcgtgctgccacgcctggctaatttttttgtatttctagtagaggtggggtttcaccaaaaacaactttattttttatcatgacaaaaataagagaagggtacaattttcaaaaattaataaaagatacaggaaggaaagaggttagaagacatctggggtattaaaatgaaagcactgagcagcggactgtgagtgccagcaaaataggagagaagaagaagaaatcttatttttaaagcaacttagttttgtgagacagaaacattcctatgttggcttatgattacatctccagtgattaagatgtggggcataccttcccgatcttcctgtgatctcggttctttgcttcctcttggaacttttcccagtctctcatcatcttgttatcaggaaaggatattccatagatcctctgcaatgtttccatttccggattgccctcccaatatgttgaggaattctaaatatcaaagaggattttggtaaatatatcatacattcagttgtaagtaaaactgctcttaaatacaaatgcaattttccactatcatatcaacaaagcagccctgcatggtggctcatgcctataatcccagcactttgggaggccaaggtggttagatcatttgagctcaggagtttgagactcgcctggacaacgtggcaaaaccccatctgtacagaaaatacaaaaactagccaggcacgatggcacatgcctgtaatcccagctacttgggagactggggcaggaggactgtttgagcccaggaggtcgaggctgcagtgagcagtgtttgtgccactgcactccaacctgggtgacaatgcaagaccttgtctcaaaatcaaacaaacaaacaaacaaaatcaacaaagcttaaagaagactatttgtagtgctgggaacaatcttaaaatggattctaactaaaccttcccagcctaaattataccattaaccagcaaattatgtagagtctgctatggattctaggaatgacagtgagagcacacagaaaggagggaaggctaagcagcaatcataatcaccaaggatggggcagaacagacagtaggtatggggaagtaaaggtcggtcttgctgacctacagtcaatgattaagaacagtgccattagccagccccattttacctgtaagaaaatcaaagccaagaaaggctgggactgccaagtcagtcccatgcctcctaatcccagagcgatgttttctccattacaacatcatatcccctcctgctgttttctttatgccgcaatacattactttcacatgcagacaaatattcttgcttacatcagggctattcaagaaaaccatagtatatagaacaatattttaaaatagtgtatgaaaaaggccaggcgcagtggctcatgcctataatcccagcacttcgggaggctgaggcaggcggatcacctgaggttaggagttcgagaccagcctgaccaatgtggtaaaaccccatctcgactaaaaatagaaaaattagccgggtggggtggtgcaggcctgtaatcacagctcctcaggaggctggggcaggagaatcgcttgaacccaggaggcggagattgcagtgagccaagatcacaccactgcactccagcctggacaacagagcaagactctgtctcagaaaaataaaaaataaaataaaatatcgtatgaaaaagaaatgttataacacttacaataaggtaaaatgataaacaaaagccacctatagtgttctaattatcaaaattctaaatgattttattagttttcatcaaataagaatgaaatattttaaaatatcatgatgttcagactacaaaagatatgattgaataagatatgattaaaatcctttaatagctagtgcaccttaagtttactgtattaaaaaaaaatcaatccttaccttaaaaattttgatggttttaatttttccagtgtgtcttacatgtggacctttgcaaaggtcaattaatggaccgcacctataatgaaatatttaggacatgctcaggcacagttacagtgttctggactattcattataagccataatatcctatgttttaggtagagcttcacttatttatatgtagcaatgccatttttaatttagggtgaaggagagaggtgattcatctagcctcagagtccactctgccctctagattcaaaaaccacagaacatcttctgaaagaaactaggcaattctctgattaaaaacttaaaaattacaatgaatacaaaaagggactggcttacagagtggcaaacacgaaaatgtcatctctctcaatggtcagtctttgtgtattgttctctagggagagagcttgtaaacaacactcagatgaagggaaggaatgccaaattagcatgaaaggcttcaatactctaatctttacatagaaagtcacagggccgggtgtggtggctcacacctgtaatcccagcactttgggaggccgaggcgggtggatcacgaggtcaggcattcgagaccagcctcgccaacatagtgaaaccctgtctctaataaaaaatataaaaaattagctgggcgtggtggtgggcgcctgtaatcccagctacttgggaggctgaggcaggagaatcacttgaacctgggaggcagaggttgcggtgaaccgaggtcgcgccatcgcactccagcccgggcaacagtgcaagactccatctcaaaaaattaaaaaaaaaaaaaaaaagaaagccataaaagaaaagctttatttttttttcaaaaattaaatacaagccattcaaattgaaaaactacaaaaagtgtcaatgttgacgtaagtaaggttctcaaacccaagagctcaagcattagaagccagaaatttaaaacttggcctgttttctacattttcatttatttttaagctttaagaaatgcaccgtgcatagctttgcacaaaggggatatgattttacttacagtacaattaaaccagagaaccataagtccttgactgtcgaaagtaagtaccatgagggagaatatctgtggttataattaaataaataccaggtcttctaaggcggtactgtgatagtcctagcagcacccagatggccggaacacacggaaaggggaacagcaatgacatataaggcgtatacacacgaataaagaaaaaggtgctcaggaacctgaggttaaatgaacagagctaagtgattctggtattaacttcacttgtctcctcttacatttgatcctgcctttgtttcccagtattttcttttggtctcatcatgagtatcctgctaatgcatgaagactgtacacttggactctggacaatggggcagactcttctacacttgcactctggacagtaagtatgaggcagagaatcactgccgaggagatggcttgtaatggcccccactgccacattaataagaacgtggaaggacagaatagaaactcctttcccaacagtatcactcacatggagaaaaatcctgttatagctaacacccaggaaacaaaatatgggtctcagtactgtcctgattactaaaaaggggaaaataatcatttctctttagtgaaaacattttgaagattgtaactacggtagattatcaactacacaacttgaaaaatcgatctccaaccagaaaacaaactcggcctctactgctaacaccttcaagtttaccactgagcagcgtttaccatgtgtggacacaaacctgtacacggtggtagttgcagtgttaactttctcattcagaatgcggcatttaaatttattgtactacgaagaaaaacatatttacacattattacacacaatgttgaaatgaagaaaacaactctacttttcttcaagaaacattgaaaggtcatctactgatgttctaggtgctgagacacgagggatacaaagagctcacagccttgagcgacaccgtgcagcatggaggccacaagccacgtggctactgggcatttcaaatgccattaatttgtggttgttgttgttgtttttgagacagagtctcactccctcacccaggctagggtgcagtgccaccatcttggctcactgcaacgtccgtctccctggttcaagcgattctgcctcagcctcccgtgtagctggaattacaggcatgtaccaccatgcctgtattgtatttttgtatttttactatgtgctaatttttgtatttttagtagagacagggtttcactatgttggccaggctggtctcaaactcctgacctctagtgatccgcctgccttggcctcccaaagtactgggattacaggtgtgagccaccacacctggcctcaaatgccactaatttgaaagaagatgtgcagtgagtataaaacacactggactttggaagtataatgttgcaaaaagaagaagaaaatcattcgttaatcattctttatactggctaccattgaaattatactttttatatattgggttaaaaatttgttaaaattaattgcaacttttacttttaaaatgtagctgccataaaattataggttacacatgtagctcagactagtggattccattatgtttctattggacagtactgttctagaagatctaattttaacattaatcaataaaattctgacaaggacacagctatattattaatttgtataaaaacaaaagcaaagtttatcgtaatgatgatatatttataaaactaagggtttttttccttttcctttcttttctgcttccatcactactatcggggtatacaaggcactttatattaaataactacttaaagaagctagttgttgggagaaaaacccgtatctgcatgatttaactgtttcgtatctatatattcacaacaaatcattttccttaacaaagattaattgtgtttagttcttaaaagtagctgcaaaaaaggcaacccacagaattaaatatttgcaaatcacatatctgttaagaaatggatatccagaatatatcaagaactcttataactcaaatacaaaaaaacctaattaaaaaatgggcaaaagagctcaacagacatttctccaaagacatttcttcaagaaaatacacaaatggccaataagcacattaagatgctcaccattagtacgtcatcagagaaatgcaagtcaaaacaaaaccccaatgagataccacttcacaaccattaggatgtccatgattaaaaaaaaaacaaaacaagtgttggcaaggatgtggaaaaactgaaccccctgtgcatcactggtgggactgtaaaatggtgtagccactgcaccaaacggtatggcgagttctcgaaaacttaaaaacagaattgccataggatccagaaattccccttctaagtatattcccaaaagaagtaaagcagagactcaaacagaactttacacacccatgttcacagcagcgctgttcacaatagtagccaaaaggcagaagcaacccaagtgtttacaggtggatgaatggatcaacaaaatgtggtctatccgtacaatggaatattatccaaccttataaaggaaggacattctgacacacattaaaatattaaaatatggatgaatcttgaggactttttgctgagtgaaacaagccagtcacaaaaggataaatattgtcatgattccactgatatgaagtgcctggaggaaccaaattcagagacggagagtagaatggtggtggccaggggctgggggcagggcgggaatggggagctaatgtttaatgggtatagagtttctgactggcaagataaaaagctttggagattggtgatggtttgacaacattgtcaatgtacttaatgccacagaactgtatacttaggattaaatggtaaattttatatgttatatattttactgcacaaaaaagaatactgcaattttttaccaaaaccaactctatttttttattcaagcccacaaaactgataatactgtgttttcaaagtacatgtttttggttgggcgtggtggctcacgcctgtaatcccagcactttaggaggctgaggggggtagatcacttgaggtcaggaattcaagaccagcctggccaacatggcaaaactttgtctctactaaaaggatagaaaaattagtcaggcacggtggcacatgcctgtagtcccagctgagggactgagacacgagaattgcttgaatccaggaggcggaggttgcagtgagccaagatagtagtgagccaagatagtgccactgcactctagcctgggaggcaaagagagactctgtctgaaaaaaaaaaaaaaaaaaaaaaaaaaaacccaaaaaataaaaaacaaaatgtatgttttctccaatatgtatgttttaaaacataaaatcaggaatatatttaagtacgttggtcaaaaaaatataaagagaaagttactgttttacacaggttactctaggttaaaatctgaaacaaaagttaacagaaaactcccacagaaaagagaaaaaggcagcattttatatgggattataaatattgttgaatttaggtgacagatattcacaatactcagaattaatcagatttataaacacacatgtgaaaattattcacctggccctttacctacctatgtctcccctcaaatgttcaggaaatagatggggagggaaatgtcacagcaagtaactggtaacaacctcacagtagcttaacaggattggaataatttggtgagcaacaggtaattatttgggggaaggtggggaagctagtctatattgatttttaatattcctagtaagaggtttaggagtttccccaagttaccttaaacatttccaggaggatttccttgctgacttctagtctttcaaaaggttgcttttcttttatgatggctttacatatattctccagggctgacaattctgtgctggacactgctctaaaaagaagagcagagaaccgacatccatcttccagacattatgcattccctctttcctttgtcctggagcctcagcagccataaatttgaatctgctgtcttattgttccaggacttcagaaagtcaaacgttcatacagtcactactcttgtgtctcagtgagggagactgggcatcaacagttgccaagacctgcctcatttctcctctgctgcaaggggagaaggaagccctgctaggagacacccaggtggactgtgagctcctctgaggcctgttcttttgtgtggtcttccttacccttcacatgctttagttttgctcaagagccagatgcagtgctcatcacgtccctgccctcactggctatggaaccaaggctgggagacatctgtatggactgcagagtcgcggtgctcccagcagcactcagcctccgctatgcatggactaacttcctttcagtcaccccctggtcagtgctcactccctcctgccacactagcttccttgccactcctcaaacaagccacacatatccccacaccaggacagtcccacagaggcctggaaccttctccctgcagatgtcataagtatccccatcctcagggcttgctccctccctccactccggtcggcttcaatgccacctgctccttcctgcccacctgcctgtcatggcacacacctcctacacctggctgatgttcctatagtcatcaccacccggcagcagatggctgcttgtgcatttgctgtcttcccccaaacactgttagctccatgaggacagactggttccttcactgctgaatcaccagcacccagcacagagcacacagcaggcagcaaaaacatcttgttgaacgaatactggagccatgttaacaagagatgaacgggatgtgatactgtgatacagtaagaaacacaaatttggtcttcatccagatttctggcacagggtttttaaaatcctgaaatctctggagtgatacgagtgtcttttgtgtgctgatgagatgactggtggctaggtcccctaggtagcttcagagcaggaactggtcaccacaaagaccaaggcatgattaaagggttgggactttcagcacccccacctgcctccttaggggaaaggagaggggctagagattgggttatcaccaaaggtcaatgatttaatcaattgtgcctctataatgaaacctccattaaaatccctaaacaacaagattcacagagcttccaggttgttgaacacatccaggtgcttggggcatggcgcccagagacacatggcatctctgtggtccctcccacatacctcaccataagcatctttcatcaggctgttcatctctatcctttgtaacatccattataatacactggtaaggtaagtaaagtgccttcttgagttctgtgagccagtctagcaaattattgaacccaaggatggggtcatgggaactcccgatttgtagcctgtaggtcaaaagtatggaaggcccagacttccagctggcatctgaattggggccagtcttgtgggactgagcccttgacctggggaatctgcattaactcagggtagatagtgtcagaattgagttcaatcattagacacctcattggtgtccagagagttggagcactggccattgatttgggaaaaaacccacacctttgagataagaattgttgtaggtaaacacagtttcatgcttgtgagtaatagtggttcagattggacaagtctgtaagtagtagctacacagcattgggtgctcggttggggaggtcattaagcagcgtgcaggagaaggtaaagacaaaatgcaccatagtcatccaggccagagatgccatggggctaacttaaggcagaaacaagagaaggagaggggggtgggagaactatttaggagataaaattggcagaactggactaaacaactggatggtggcgtggtggtgaagaggagggaggaagtagaaggatcagaggttttggttgtggcagttggaggtaccctaggagctatgaggaattcagggcaggaggtggacggggctggctgtttgctaacgattcaagcataggcctatggaatgtgaagcatctgtgacacatccctgtccggcactcaactatgtgagatgtttggctgaggttaatgaggtccttgattatcacggagcgaattaaactagcctctctctaggaattaagctttcaattctggtcttaattaataccatgctctagcaagtccaagattagataaatagcatatcatattcttctggggacaaaaaagaaaacaatcttagaagtatctcttgaatctaaactagatttgactaaaaataattttcagttaaatgccttagaccatttctaaactaaaaataattttcaaaattggtcaaccaatctataatcatcttatgcaatacagttgacccttgaacaacaaaggttagaactgcatgggtccacctatatgtggattttcttctgcctctgccacccggagacagcaagaccaacccttccacttcctcatcagcctactcaacgtgaagatgaagagctttataatgatccacttccactaaatgaatggtaaatacattttctcttccttatgattttcttaacatctcttttctctagcttatttcaagaatacagtatatgatacacctaagatacaaactatgtgatactcaactgtttatgttttcattaaggcgtctagctaacaacaggctattagttaagtttaggaggaatcacaagttgaactcggattttcaactgcatgggcgtcggtgcccctaaccccacattatgtaagggccagcagtatacagttactaggctagtatgtaaccattacagaacaatacaattgaaacacatgcattcacaagccagtattcagtgtgttacctgtcttcaatgaacatgtcataataaaatccattttcaatgggcggaccgtagcacaggtggcctccatagtaaagctccatggcctccccaagaatgtgagcactggagtgccagtacacctgcatggcatggacaaagaggccattagctaccaaaagtatgtcatggaaaattagtagtaaaatgatgtaaaccagtagaaaattttaaggagatacatggcaagaccaagggcagcaacatcaacttgaaaggaaaatcttcgatgcccacttagaagagaatgctttctgagccctccctgacattccaccggagtcacttgctcagtgccagtgtgaagctgctctgctgagtggcagctagagctcggccacaaccccatttcctctgtgcatgtcagccacgagagatgaacacctctcagaacagccagcagagcagctgtgtgcaaacctgattgaagcccagagtaggaggaaggccgaggagtgccagatgctagctgtcttctttttctccaggggcaccctctctgagctggacacagagcactgaagtgttcctgacaccactacagttaacgagatcctgcatctccagagcagtcttcgtgtgttgaatagcatgtgactgtggaagtttgaaagatgtctcaggaagaaaaaagtgttgccagggaacgtctgctggctgcctgggacgcctgagaagtgtatatatgggctcattagccacagtccagagcccggttgtcagtcctccaagttcaaaaagttgatactgttttgagttcccaaggaattcattttagtttatggataaactgaaattaaccaaagtcaccaaataaatataggtaccaaaggagtaagataatcaactcatctttcagcactttctttctttttattaaatagaaagcaagttacaattaaaaagctgtttgataaaatgaatcagggcagaaggagtcagatgatggagcactatgtgcaatcccagcccacagcaataggctgggatatgatttgcagacagacccagagggtcagtccttagggcacagcactgctcctttggatgctgctaggatggcaggctgactgctagcatcagcccaaatctcccatgtggtgcactgtccacacctacacatttgttgagccaaacactgtgctgggtatacaatagtgaaagaaacagacatagtcacagcccccacacaggtacagcctattggcgaagacacaggcaataaacaaacctggacgtgcataattctaagatgagaagggtgtttaaaaggagatgaacagggctctgtaatatagaaaaatggtgagtgtcctgcattcatggggactcgggaaggcctgtgtgactaacacgtaggggatgtgacaaagcatagcttgagaaaggttagagaggtaaggaagggccagagaccatgcaggccttggggaggagcttgcattttactccaaatgcaatgggatgcattaaagggttttaagcaaaatgattaaatttacatttacacacatcatttgatagctcgatgggaatgaatttcaggggacaaaacagcaagtaggcagtttcttgggtggttctataacaaggtgagtgcggattctcaggcagtggcaatggacagattctagatatttttaggaagtaaaatctactgggcttacccctcactggagatggagttgagggacggggaggaatcacacaaaacctccaaggttctggaatgagctattgggtatgtggtggagtaatgcactgacttaggcaaacaggaagaaataagttttggggttaaaatcgaaaatttcatggtgaatgtactgaagattcttgtacaatatctacatgcagatatcacgtagacagtagtgcataaaaactgaggcatggctagctatggctggagagttgtgaattcagtctacagtactgaactttctgaaaatcacttttaaatatggttttattaatagtgtactgtttacatatttaatggttatactttgcatattttaaacagaaattataatatggttcttatagtttaaagaaatttagcataagccttgcaattattgtaacctaagctaatcataacttaggtttcatgaagataatggacagcttgaagggcgactgcaacgttcaggcgacaacgtatatcagaaatcatatatcacatgcatatgtgaaaaatgtggtatttattttatagaaaattatattaagtatttaaaggatatctgagtcttgtaatttcttccaattctcctatacatattaaattataaagtagacccatttttaatggcctactaacaattcatttcaaacacacattgatttaataaccaaagcattctaacttaaggaaatgattattgtaagaaatgataaggctgggcacagtggctcacacctgtaatcctagcactatgggaggctgagggaggcatactgctcgagcccaggagtttgagaacagcctgggcaacatagcaaaaccctgtctctacaaaaaatatgaaaaattatctgagtgtggtggtgtgcacctgtagtcccaggtagctgggaggctgaggtgggaggatcacctgagccaggggaggttgaggctgcagtgagccgtgattgcgccactgcactccagtctgggtgacagagtaagactccatctcaaaaaaaaaaaaaaaaaaaaaaaaaagaaattataaatatgggctactttaaaaactgacatgtatttgtatacattcatgccacaaatatttattaaacatcaataatcaaattttaaatcttagaaacccccaaaaaactcaacattcgtgacttcaatatgtggcctcttatataatgtagtttacaacataactacccaaagtttggctgtctggtttttaaatactcacagcttgagcttcctcattatcaaatgtaagcagctctagagaagagtccccttccaatgggcggtccaggtcccacagttcaccattgactttggctattaccgtgctttcagccagttcctgactaagaagacaaaagccacttgggagttaactttatcactgttacaatgattccttaaaatattaaaagaatttctagggttttttttttttgaagtgtataaaaagtacaaacataaactaataggacagatatttcttgttttgcaatatttattttatgtagaaaagtaatatacattcactgtttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcgcggctaattttttgtatttttagtagagacggggtttcaccgttttagccgggatggtctcgatctcctgacctcgtgatccgcccgcctcggcctcccaaagtgctgggattacaggcgtgagccaccgcgcccagccacattcactgtttaaaaaaaacttggaaaactgagaaagcccacaagataaaataaaaatcacacataaatatcataaatcactacttataacattttggtacatttctatccagtggtttttctacctccatccaccccacgcacacatatgtgctgtctttaaaagcagctgccgacataattgtatagcttgcattttctgtcatgcctcagattgccttccaaagcagtctggaagtattgtatttattaatgaagcctccactgctgcacactgaggtcgcctaagtcttgctatcatagagtatatcacacagacatctgtacacaggcatcttgcgacttctgtgactgttttctgggaatacatccacagaattggaattactagatcaaaggggatgtaccgttgacagatttctgatgtcaattgaacgcatcacttccacgtaccccgatttttaaaatctttatcaatgtgacattgaaaattgttgttttgatttaattattagttttggttcatgcttacaagctatttttacttttatgaactatccgcttcctttgcctattttctttttttttttgagacagtctcactttgttgccaggctggagtgcagtggtgcaatcttggctcaccgcaacccctgccttctgggttcaagcgattctcctgcctcggcctcccgagtagctgggaatacaggcgcaggccaccacactcagctaacttttgtatttttagtagagatggggtttcaccatattggccaggatggtcttctagtgaggtgttgatctctttctttctgtttttttgggtatcttttaaataacatttattgtttgaaaattgttgacaaaattacaagttaagaaaggaaacctggaaagcacagaaacacacacacaaaatcacctataattctaccaccaagaaattaccattgatgttttgtttatatctttccatattaatatataggaataaaaaatatttaatagtatcataattatgtgattttataacctacttcttaaacttcacaataaatcacagcatcttccctaacaggagacagatttccaaaacgtgatatttaatagtcacagaggaaccaatatttgctaggcattttaattattttttatgggtactttgggggacgagtagcaacaaaaaacaatgctgcaatgaacattcttgaacatatatcttactcaattattttctcaggaaaaattctggaagtacaactgctaggtcaagggaaatgcattttcagtgatttctgtcagaatatattgcaaaattttcctactagcagagttacaagagtatcttgtctctgagttctcataatgttaggtactattaaattgtatcaactctacaatgtaatttttttttttttttttttgagacagggtctcactctgtcacccaggctggagtgcaaaggtgcaatgtcggctcactgcaacctctaccttccgggttcaagtgattctcctgactcaacctcccaagtagctgggattacaggcacatgccaccatgtccggctactttttgtatttgtagtagagacagggtttcaccctgttggccaggctggtctcaaactcctgaccccaagtgatctgcccaccttcacctcccaaagtgctggcattacagatgtgagccaccgtgcccagcctacaatgtaatcttttaatttacatttctgtgattaacttgagcagcagtactgcattgaggttgggggcacacaggtaagaggccaacctgagtttaaatactggacaatttactcagcttctttaggcctcagttttcttatctacaaaatagggattataggaccttcctcattcatctatactcaggattacataatgtgtacatatgataacaagaacttaataaatgttagatgttattaatcaagtagaactttcttttcatttttactggctgtcatagatggctagtgtttcgcaaaccgattctgcccttcttctccagaaggagttttccagccttccttgcagctacatgtggccatgtggccaggtttggagccaatggatagaaggagaagtcatgtgtaacacttctgtgtctcatcattaaaacagtggagggcacttctccaacctctctccaccttctgtagatgggaacccatgtgctattctttctggaccatgtagacaacggcaacattgtaccagacaaatcagcaacaagatgggagaaatctgggtccccaaaagaccgtatggagacatgtcacccagtcaacctggccacccacgtctagactgctatatgaaaaacagactttgaccatattcaagcgacttgagttttttgtgatgtctttgttgtagcagcttagtatatatcttaagtaatacagaaataaggacctggaagtaaaaatccaaaacaagtggcactggcttaacagactggcagtgagtaacaaggaaacagattctaacatatggagagccaataacctttgtgatagtatatcaaaatatttgataaaacttgcaggcaaaccatgtgtcacagtgcttgtagcacacaagaaagcaggtataaaaggggagagtagggctgggcgtggtggcttacatctgtaatcccaacattttgggaggctgctgtgggcagaccacctgaggttggaagttcgagaccagcctgactaacatggagaaacgccatccttactaaaaatacaaaattagctgggtgtggtggcgcatgcctgtaatctcaactactcgggaggctgaggcaggagaatcgcttgaaaccggagggcggaggttgtggtgagccaagatcgagaaaaggggcggggtggaggtggggggacagtgttggtataccctgggtaactcttgttgctttcagcaagaagctacaagaatgagttatctcagatgaaaacaatctagtttgccagcagaggtggaagggatagggaggctccctctgcccgtgtcctgtaattcaactgactaaaagttcagaaacgtggagctatgcaagatgggaaagacaatcttctttcccaaaccgcaggagggacaggcattgatagcccttctcaaaggccacacataaatccagacaatagaggccagtggaactgcaaggattagagagcaagagtgcctccctcccacaagcctctgcttcatatgatctcagtccattaaacaaggagacaggagtgagccgaataaaaaagccatgcaacaacagggtgagaagtctctatctagaagattctttaagtgagattactttcatgtggaacggattagctgcaaacagaccagagcctactatggctaactgatcatggtaattgtattgccaaacaaatcataagctcagctcacaaatatctgtgactatgtgatccttaagggaaccctcaggccccaaatgtgcaccacagaactgagctgtggaaactgcacagatcccaagaggacaaactcgtgcacttcagatgtgacaagtgagggtaatggacaactccgaacttcccaaagtgcaaaatcagggcccatggaggatcatgggataagacagctgcttccagagaacaaaggatgaacaggtgggctgacacaagcactaactgctgccaggctgtggggcctcaaggtggcttcaagcagaatctgatgacttctctataccactccctgctatatttctcctccttcttttttccaagcacacactttgtgattgtcttctgtgtactgtatgcacgtgtggtgtgagcagacttgtctatcagtttatttgttgctagaatacaagtggtcagcctgatggggggtgttctgtacatcactcagaaatcccaggctttgagctatggaacataagagttgtctcacttggggagtgagtgtgtcagatgttgaaagaagagtacccacagatatctggatgtcagaggggcagactgtggcagactctctgttgttccataaaccattcctctcttccatggtatgaatgctttagctggacatgtggctgggcggccaagggagctatattccaattctctcttacagctaggcatagccatgtgactaaatgtgagctaagaggatgtaagtggaaactgaagccagccactatggggtcttggcctcaaagcatcattgctctgcagcttctcttcctcctgactgcaggcaggcccatgcaaggacccagcttccaccgctagacacaaagaaaccctacctaggagacagcagatcaacaagatgggaggaagctgggtccataaataactgcatggaccagagatgtccactaggcttgactggtcacttctagacggttagcttgcattagaagcccctggagagctcataaaaacactgatggctgatcaattcagggggtttgaggtgggatccccaaatttgcttttctaacaagtttccaggtgatgcccatgctgctggtctggggactacactttgagaaatactgacccaacacatttaacatgcaacctgactctccatgagaaaacaaacttattcttgcctcaaaacctgttttctcctagcacatcattcctcctggaaaacatgaaaacaggctgggagagcatttaacaatataataggatgaatcagaaatacaatcttagccatagttttcaaagaaaatctgagaatttcagttgttgaaacagtttgctttttaaatgatgaacatttatttacatggcattaatacaattgtatagaagctatataattgtatttatacaatagcttctatacaattgtatttaatgctaagaattaacatgagtcaaaacaatataagttcactaatgtatctaatttctagaaaagtcaaagcacttttccaagactgataatagctctaaaacatttatcttcaatctatacttaaaagacctgtaaaaactcatggaaattacttgattgacgaataaagtcagtgtaaaatggcctatcaagaattacagatttttttctctcctatatatttttattagaacaggaaatgattgtgttctgatattcaactacttatttacatggcccttggagaagccagaggaaaaaaattaaatacatttaatttattcaactgaataaaaaaaaaattagctgatatggtttggctgtgtgcccatccaaacctcatcttgaactctagttcccataatccccacgttttgtggaagggacccagtgggaggtaactgaatcacaggggctgttacctccatgctgttctttgatagtgagtgcattctcatgagatctgatggttttataaggggttttccccccactttgctctgcacttctccttgccgctgccatgtgaagaaggacatgcttgcttccccttctgccacgactgtaagtttcctgaagcctccccagccctgcggaactgtgagtcaattaaatcttcttcctttataaataacccagtctcagacatgtccttttagtatcgtgagaatggagtaatatattagcggtccctaagaaaacattttcaccaggcttcagtataattacttaagattgaatatcttttccacactgcggtttacctaatttcagcagccacttggtaaggcgttgttttccagacttccccttgcactgtttgcccatcagccactcttactgtgatgatgttgcttgtatcccccttttttccataaatggcaagtaagagctgatggtctttcttcagtatttcaaaaagcttcaatctttcttttatgaaaattggttgatgcttcacctggaaattattagaacataatgagattaatatatacagcctactgttttccagctgctcagctctgaatcaggctcacccccttactgccttctcagttctacagatggtcccaagcttaccatggtttgaattacgattttgttgttgttgttgttttttggtttgttgttgttgttgctgttgttttgagatggagtcttgctttgtcgcccaggctggagtgcaggggcacgaaatcagctcactgcagcctctgtctcctaggttcaagcgattttcctgcctcggccacccgagtagctgggattacaggcacgcaccaccctgccagactaatttttgtatttgtagtagagatggggtttcgccatgttggccaggctggtctcgaactcctgacctcaaatgatttacctgccttggcctcccaaaatgctgggattacaggcgtgagtcaccgtatccagccgcaatttttcaactttagtgatgtgaaagtcatatgcattcagtagaaactgtactttgagtatccatacaaccattgtgtttttcactcagtacagtattcaataaattacatgagatattcaacacttcataataaaataggctttatgttagaggattttgcccaactgtaagctaatctaagtgttctgagcacttttaatgtaggctaggctaaactacgatgatcactagcttacgtgtattaaatacatttttaactcacattggttttattgggacataacccaactgtaagactaagagcatgtgtacttcccacctccaaaaggctcctctctgcctatctaacttctccttagctctaaaggtccacctcaaagcctgcctcctctacctattttacccgctggcatctcccttttttttttttttttcctttgagacagccccacgcccagcccccatgacacctcccttttctactgtttacagaacgtgtacagagtcacacattacagcacttacttgtataccatcgtactctgttctctagttgtttgtcctgagtctgcctgaattcctcaaccagactaacttctttgggcctaggtattccttcttcactcctaccaaatgttgatgctagataaatacttactgattgttttaatgctttatatacaaaagcaaagtagctagtttctcgaatacaaaaaaaaaaaaaagaccgggggcggtggctcacgcctgtaatcccagcactttgggaagccaaggtgggcggatcatgaggtcaggagatcgagatcctcctggctaacacggtgaaaccccatctctactaaaaaaaaaaaaaaaaaaaaaaaaaaattagccgggcttggtggcatgcacctgtagtcccagctactcaggaggctgaggcaggagaatcgcttgaacctgggaggtggaggctgcagtaaccgagatcatgccattgcactctagcctgggcaacaagagcaaacctccgccttcaaaaaacaaaaaaaaaccaaccaaacaaaaaaaaccaactctagtactctagtagcacaacttaaatagattaaatacacgtgtttattaaacatgggcagctcatttctcaagacatctcatatttaaggcttgaaaagttttaaatacactaatgtgacccaaataataatttaatcagtaatttttattggaaatcctaggtaattaactatatacacatatttaaaattacaggtagtattttatattgtttccacagcaacaacttacctcgctgtcagcctcgctttccttcattttcttctttttcatgtccttgtcttggctttgactaggaggaggctgaaagataaattataaatgactcacatcaatggcaagaaaaagcaacacattttaagaagagagtcatgccagcaggctgcaagtgccccgtgtttagaggctcatagctgggctctcctgaccaccagctacagctctcagtgggcaagtcattctccagggttcagtccttcctgtcacactgttgctaagcacatttaatatattgtgctcttgaaaaccttttgtcctgaactttaaacaaataatgtggctggaaaatgtgtggttgctgcccgccacatcaaatgcactatttcctgaagatgttgctagttcaccgcagctgtccttcctaaaggactgcagaacatctcagcctgagaagcttcaggactcagaaagtatgatgttaaaagaagataatttatcctttctacaaatcataaaatactgtattaaataaaaatgttaaatatacagctatcctctcaagatgaaccaccaaaacaagagcacaaaaagcgaaaacttctcgtccaaaaaaaacccaacaacaaaaaagaaccagagggaatgagagtttacatacgcagctgttagtctttctgaccaaggaaagaatgagttttaaacactccagcattttttcaaacaaatgaaaacactatttctgctactgaaaaagatgcgtggcaggctctttaatggacgaattgagaaatcaacagcatttggttaagtctggcgactgctggaaatccggcggctccccaggccacacgggaccaccgagcagggcagggcgggccagccgcagggcactgggagggcactcccccggggcgcccccgcacctgcccccgcagttgaaaacctttcggtgcgcaccgtctcggcccgccccgcccgcgtcctctccagtgtccccaccgcccggttacctgtgcgccggcctcctgcgccgcctctagctccgcgctctccagcgtggcctggcggctccgctcctcggcgaggcacagccgcaggctgcacaggcggtggcgcaggtcgcagttctcggcccggagctgcgccacctcccgcgtgaggcacggcccctccgcctggcagctgtagggcgcgttcagctgctcgtccctcaggcgctcgacctccgaccacagccagcggatgtcctcctcctgccgctccaggcgcgacgccacggcctccgccgccagggcctcggccgccatcgcggcctccctcaggcaccgacgccgagcggggtgcccgcgactgcggcgagggcgacgcggacactcagcgcacggcagaagacagggctcccgggaggggcggggcgatggggcggggacggagccatggggcctcgttggagccgaggcctacacgttgcaggggcggggcgctgggcggggaggggcggggcctaggccagataccctgcaggggcggggcggggcggggcggggcctgaggccagataccctgcaggggcggggcggggcggggcctgaggccaggcccaccttagggtcacgggcagtggggaaatggggtctgaagggcctcccctgcctttcgaggcctgtctagaggctattggcagtagtttttagtccgttgaaacgaaaatcttccaaaaccttgcaaaaaggccatcgtctgcgttctccaaaaaggcttcaccctttcttcctcttgaattctggcagtcaccattcttttgccttgcaaacaggttctaaaaagtggccattcattataaatggactttctggcctttcgtgccaaacttgcccaagtactgaggcctctgggccagggcatatagaaaatcgctgtgaaatctaaatccgaccagcacgaaattactggctccttgagtctagggcaaatgccacatatatctttgtatccctcttaaccatgagcgtgaaacttcctggagcaggaacagaaattgatttttatcactattcttagggcttaggatgtgacaaacactgttctaaactctgtaacagtagtaactcctttaatcttcataacaggagatactgttatatccgcttatagctggagaaattgaagcacagtgagactgtgttacttgactaaggtcacacagccactacatgacaaagggggaatcaaactcagatagtctgatgccagtttctacacacttaacactagtacttttcaactttggcagaatttaattgagcatgtcatataatgtgatacaggtaataatgcccttataagagtcctgaagtggaagagcttagcttggactggtgtggtttgagaaagggagaaaattttgagaaaggggaaaaggtttattttgctctggaaaataaaggttgggagatgttagcaaggaggaaaagcaggtaaattccactccaggagcagaatcagtgcaggagaaggagcggagggggacaagctcattggattaagctaagtggaatcccaaacagcacccaggaggagattccatgaagtatgttgctaaccaatatcactgtatcttttttagtccttcctcaggaagcctctggatacagttacataggacccactgactcctcattattcatcatttctcaatccactgccatggagtttctgcttctgccattctgtcatgaccaacacatcactgaatgtcatggacccacttaagccaccccagaatttcctcgggaccctctggaatttgtctctcttgggtctccattcccaatacctaggcaaccaccagtctgcttcctgtcactataggttagtttgcattttcttgatttttctacacatggaaccacaccgtatgtcctccttttgtttagctactttcagtcggcacaataattttgatatttacctatgtttgtgtgtatctattgttctttttttctgagtagtattccattgtatggatataccataatttgtttattcatttgttgatggaaaatttgggttatttccaggttttagctaggatcacacaatacccagtgagcccattgggtttccaaactcacactgtagttatttcgtcagttccagaatgcagagtttgaatagatatactccaaactggcagaatccctacagtgtttccctgaccctcggacataaggctattattctggtaggaaaggccaagcagaaaccactagaactttatcaacatacaaaaataataaatcaaaagtaatactgcattcctgaaggaattgcacagattactgttgccttcaagaacttgaaagatgcaggggtggagattctcatcacaccccatttaccttaccttaccatcccatttacatttagcctatgtagaagacaaatggatgttagagaattatagtagattaatataaatttaattagatggtgattccagttgcagctgctcttccagatatgatttcattgttggagtaaatcagcataacccctagcacctgatatgcacctattgagctggctaatacttctttctttatatctattagttaagggctatcgagcaccattttatttcagctgacaaggctggcaatacaccttcacagggtatcaccacaagacaatataaactctttagttttatgtgataatctagtccacaaggactttgattgctgctgtattccataggatatcatgctggtgtcctatcattgatgatagcatgctgattttccctgatgagcaggaaatagcaaatactatagtcaccttgataaggcatgtggaggtggtagagaaggaaatatatccccaaatgtaaaaattcagagggctgtcacctcagtgaaacttctaggcattaagtaattcagagcatttagagatgccactttggaggcaacatatacctcatttggacattatttttctaaaccaattactatgtaactcaagactgccagtgttaagtaagactgagaacctaacaagattctgaaacaggtaatgctgctatgcaagctacttttctatgtgggccacatgagcaacagatctgatggtgcttgaaatgtctgtggcagataagagttacccaacctagagtgcagtggtaagatcttggctcattgcaacctcgacctgctgggctcaagcaaccctcccacctcagcctcctgagtaactgggactacaggtgcataccaccatgcccagctaattaaaaaaatttttgtagtgatggggtcttgctacattgcccaggctggtcttgaactcctgtcctcaagtgatcttcccacctttgcctcccaaagtgttgggattaactattctgcttttgagaagcagcttctggtttgctactgggccatagtagagattgagtgcttcatcagggaccatcaaattaccatgctacccaagtttccctccatgaattgaatgttatttgacccatcaagcctaaggttgggtatatacagcagcatcctatcattaaataaaagaggtgtatgccagatcaggctcaaacagattatgtacgagtttttggcataaacaagtcacccagatgatcacaactcctgtggcctcatgaaaagttttatatgaccagttgactgaggaaggtaaaatttggccatgatttacagatggttctgcactcttctggagcagaagcttctttaagttgacgcctgagaatttaattgcttccttgatttttggtttgataaaatgtttcaggctcatcttatattcaaggaatctatcatttctccaaggtggcctagtccattttaatgggaattgtaatttaaatcacacaatgtgggtcctggcagcagtctttgtttctaggacttttctgtatttaggattgccagataaaatacacagtgcacatttacatttgaacttcagataaacaaaaaataatgtttatataaatatgtcccatgcaatatttgagacatatactaaaaaattattcaagccaaaaagcattaaataagacaaagaaggacattttgtaatgttaagtgccacattccacaatgaaaatatagcaattatgaatatctatacacctgtaatttgaaaaaaactacaggaaactaaaggagaaagagaaacacactaataagaggaaaataacaaggctgggtgtggtggctcatgcctgtaatcccagcactttgggatgccgaggtgggcagatcacctgaggtcagaagttcgagaccagcctgaccaacatagagaagtcccatctctactaaaagtacaaaaaattagctgggtgtggtggcgcatgcctgtaatcccagctacttgggaggctgaggcaggagaattgctggaacctaggaggtggagtttgtggtgagctgagatcatgccatcgcactccagcttgggcaacaacagcaaaactccatctcaaaaaaaaaaaaaaaaaggaaaataacaaaccactctctgagtacattcaagtgcccccacaaaaaagtaaggatgtaaaagacccaaacaatataattaaaaagtagatattttgaatatattcacattatcaatatgtatatataaatatctatctatataaactataccctgaaaatggaagatgcaccttcctcttaaacaaatgtatagattcttcatataaattaatcatttgtagagctcaagaaagacctcagtaggtttcataaagtagaaatattaggtacaacactctcagcccccaatgcaataaaattagaaattaaaaataaaacaacaacaaaaagccttttcacatggaaattttaaaactcttaagcatctctttattgaaaggagaaatgaaaaaggaaagtacagactttctttaaaatagtgataatgaaaatactacaaatctatgcaatacacagatcagtaatcagaaaaaaatcataactctaacacctatattgataaaaacaaaagaatggaaataaattctcaattgaaaaattgagaaaaatgacagcaaaataaagcaatgacaaagttctaataacactaaatatacatttctttttcaacccagcaatcccacttctagaaatttattctgaagatacaagaaggcaaaaatgcatatgcacacaaattcaacggaagagttgtgattgtaaagtacctcataggagattggttcaataagctatagtacacacaaaaaatggagcactatgaagctgttaaaaaaataattaagaggatctctgaactgatatggaacgatttccaggagattttatgaagcaaaaaaagtaatgttcaggctgggcacagtggctcacgcaagtaatcccagcactttgagaggccaaggcaggcagatcacaaggtcaagagattgggaccatcctggccaacatggtgaaaccctgtctctgctaaaaatacaaaaattagctgggcgtggtggtgcacgcctatagtcccagctatgcaggagactgaggcaggagaatctcttgaaccagggaggtggaggttggagtgagccaagatcacgccactgcactccagcctggcaacagagtaagactccgtcaaaacaaacaaacaaacaaaaaaaaaacagtaatgtacacatgtagtatgttacatgttgtataagaaaaaagagaaaatgaaaacatgcatatatctgcttatcatcacaaaaagaaacagaaaataaactagaaaacaatgaatttggttatctacaagtagataaccaagagataaaggtcccgacctctaatacctttcctcattaaagggttcctggcagaaaggcctattccagagctgggacattgacttagtccatttatgttgctacaaggaaatacctgaggctggataatttacaaagaaaagaggtatatttggctcacacttctgcaggctgtacaagaagcatggtgccagcatctgcatctggtgagggtttcaggaatcttccactcatggcagaaggcaaaggggagcccacatgtacaaaagtcacatgacaggaaagcagaagcaagagagaggggagagatgtgaggctcttttaaataattagttctcacaggtgctaagagtgaggactcaatcattactgtgaggacagcaccaagccattcataaggcatctgtcgaggacggcaccaagccattcataagggatctgtcgaggatggcaccaagccattcataagggatctgtccaggacggcaccaagccattcataagggatctgtccaggacggcaccaagccattcataagggatctgtccaggacggcaccaagccattcataagggatctgtccaggacggcaccaagccattcataagggatctgtccaggacggcaccaagccattcataagggatctgtcgaggacggcaccaagccattcataagggatctgtcgaggacggcaccaagccattcataagggatctgtcctcatgaaccagacacctcccactaggccccacctgcaacactgggggtgaaatttcaacatgagacttggaggggacagatatccaaatgatatcagacatgtaagttcaagataagcgtagagcactttgttttgctggaaattaacaaagcgctctccacaaaaatgatgggaacatgatacaagggcacaggaaccagcttgaagggatcccaccagccaaaccaattgaacttcaaaaataattaagtaatgaattgtaaaccattaaaaaatatgggaactcacaagtccaaccaataatagaaaaaaatgggaaagaagccagagctcagtttatagtctatgccatggactaaatggcaaacacaggtaaatgggaaattagaaaaccatcactttgccaccttcatagtaaggactggatcagacaagaatcatcatgctcaatctagggggcagtgctgaaaagcagcaggatactggcatggacataaaatgttcccccacaggctgttaaccagttgcaagggagaaaacaaaaagtaattatacaatggagaaatcaggcaatatcttgatcaggtgatcaaaatgaacatcacctatgaggaacaggtggactttatgtacctccagatgtgatattctaaagaaggtataacacccctgtacagaatttataccaagaatacataaccccaatctaatcacaaggaaacagcacataaacacaaaatgaggaacgtttgtttttaacggtggaggggagaaactgaattcttcaaaaatgtttatataatgaaagacaaaatctggaatgctccagattaaatggtactaaagtcatgatgattaaatgcaataccttactccagattggatcctggaaggggtaaaattgctacaaagaacactattagacaaactgacaaaattggaatacagatggtacattagataaaagtattgttcatgtaaatttatgaagttgataattgttctaaagctatatgagatctccatccttcgtaaaaataagctaaagtatttagttatgatgtatgtaactcatgttcaaatggttcagaaaaaaaattatagaaggagagagaacaaatgttaaagcaaaggataaaatgtttgcctcaaacataagcttcttaaaacatccgtaagattatgtttactcccctgggtaaaaccatcaggagctttctactgcaaataaagtaaaatccaaattctttatcaggacctaccaggccagcaagatcgagcctctgatggcctctcttagattataccatgaccccaaacccggcaaacccctgtgctggttcatggagctctcagatcctcagaaacatccctctctcctgcctctgggattttacacattcggtgtcttgccttgataatatcctcgtccactcttaacgtctgacttcttttcatcctggcagttttagcttagtgccacctccccactccatttaaggttggcctgcccccattctctcagtatccttttctactatattgtaactgttacccaacatccaggtgcttaggaaggttatataatctgcagagttcacatatcaaccacttcaattgctgacaaagctacaaaacacatttcagtaaataagcatgttaaagagcccttagaagacaccaataatgttatgactactgtaatcaatccagtaggaaataaaaatgtttgttactgctcaattgcagcttacagttaaaacaatactcttcaaaatattttcaggagcctctagtttaagaaagttactatggcttgggtgtacaatcactacaactgatacctagcagaatgacaacaattaaggcacaggaagaagttccagacattgtccaatttctcattgctaccttgttttcttaggaacttacaacttcagacaagagaacattaatgcattaatgaggctaccaaaaagaaaaagaaaaaaaacacataggcagtgttgctacacatggattataaaattatacattccagtcatagtcagttaaaagtacataagcaaatgtgatctagcagacagagcctgggaatctagatgaccttggatatcgaatctaattccctgagtttgagtctccccatctgtaaaacaaagaaatgaaaactttcccagaatggtaaagattaactgaaacctgtgaaaacactggatacttagttggcttgtaagtgtctgtctaaaaaataataattcactaggaaactgcaaagaataactgtaaatttccaaatttaagtcgaaattgtgttgtaagcatatttactttaagcaagtaacgtaaactatgtgcacaagtatggttttcgttgtttaaaatgattttcaatgtataaggtgactcaaatgggatctaataaggcactcacttcacttggtcaggaacaatttcctgggtgtctctgatcaagaaaagagatgaagagaaagaagcaggtttacaaaggacaaggaaagaagacacaggattagaatgggttaacaaagcaaagaataagccttcccaaagtgagcaatgaagcaagtggaaacaaggaaagttgaacagtaaatttggatccaccaaaaatcctcatgcttaaaaggaagctcgaagccccagtgtggatttgttatgcacccaatacgctgtttgtgctaactacataatgaagatgaggcggggtgatccggacacagacctggacactctgacctctggcacagaattggctacaggagtgctgggggagagaggcagcagggtagcggagtcatatcaagcaacaagaaacacaagttagtacattttccacaaatttcaattttactcccttccctcatgatacacacatacaaagcatttgaaggatgggaagaagaagctgagatcacagggaaaatagtaagagacattcagaagggctggtcttagagatttactagtttggggaggtcagagaacagtagcatatgaaagaacgctaagacagttcccagggttaggcatgggtgactagtttgattatatcattttgtcccactcacaatgacaaggagaattactgagggaacacatgatggggctgatagagtgctaggaggtggatacatgaaaatgtaaatgtcatcattttgaacacccatggcactccaagtgagattccctaacatatatgatatacagacagatatatgagtttgaaactctagaggtgaatgcgaatttaggaatccctggaacacaggtcatgacttcagtaatgggagtcaaagattactcagagaaagcacagaatgaaaagagaagaaagaagtaggccaaggaagaagagattggaggagaccaaggcagggtgataagatcaaaacagaagaaaggaatctgatggaagtcccattagattatcatgtcccttcccagaggatagggacatgccttttttgtcttttatactcaattatcacagggcctgacacagaagccactcaatgtttttttaaattgggttctactattcacagtttgctgtatccaccaggggagaaaaaagtataaacaagcacagatatggatttttttacactgtgtactaaaggggccagattatacacagtattttatgccttacttttttacttaatatatcttagaagtttgcacatgcttatggaaggactggctgcattttttggtctacaacagaatactctattataaaactatacactataatttttatttaaccaactgtttattggtggacattcagaatggaggaatgtttcaacaagggaacaatcaacagtatcaaaatactgcagaggggtcaatttggggactaagagaggagacactggatttggcaactaggagataaattttagtgcaatgatgaaggcagaatccagattataatgaattcaatgaaaaaagctgaagacatatagattatctgctcaagaaactagctatggtaaactggcagaggctgtaagagtgggaggtgagttttctccttcatgtaaatatatttacttttataaacactaggcccaattttatatcctacttcatttaactttatgaacatgtttatgtaatgttttagtaaaaaataactcatttttgctattataaaactgttatctttagatgttcagaagcaacttcctaaaaggaggtagcaataacagagctatgtctatcattctttcccatcaacccccttgctggagaaggaaacatgtgtccatctagcttttaattaatttttacctcttatcttcatggctctccatataaaacttaactctttttttggtatatgtgtatgtatatctataactagagagagagacagagagagaagagggggtcttgccatgttgcccaggctgatctcaaactcctgggctcaagcaatccttccaccttggcctcgcaaagtgctgggattacaggcatgaaccactgtgcccagcctcagccttaactcttaaaatatcttcaaatccctgttcttcatttcttaagaatatatgcgtttaaaccaactataacttattttgacaaaaactggagttaagacccaaacttcctcagatggtcagttctcctaagactatttacagaataatctatcttttccctattaagttaaaataccacctttgtcttataaaattctcattagcatgactctggttctaaacttctattgcctttatctgtctggcccagggctattccacaatattttatttaatatctggttgaacaagtctattctttattattttttattatttactcttctacacaaactttagagtcattttttcaagttccaaaaataaatctgctgggtttttttttttttttttaagacagggtctcactctgtcacctaggctggagttcagaggcatgatctcagatcactgcaatctttgtttccaaggctcaagtgatcctcccacctcagcctcctgagtagttgagactacaagtgtgtgccatcacacccagctaattgtcatctacccgcctcagcttcccaaacttttgggattactagtgtgagccactgtgcccagcagaaattatatttataaattaatatgaagacatggtgataattaacatatttataatatgaaatctgctcatccagggacatagaatgcaaatctttcattccactcagcaaaattttgtcatgttcttgataaaagtcctgcacatctaagtttattcctaggtatttaatttttgctgaaatacttgaaaaaatactttatcactatatctcctatgtgattatagctaatattggggtaggctattgatttttcagtaatggggcttttaaccagcaaccttaaaaattgttgtcagttggttcctttggatatttttaggtaaacaattatgtcaacttaaaataatgattgttatttttctataaagattatgacatcatgggaaaatacggtaaatgcttttttaaaatttttaatttttaatttttttagagatggagtctcactctgtcccccaggctggagtgcagtggcatgatctcggctcactgcaagctccgtctcccaggttcacgccattctcctgcctcaatctcccgagtagctgggactacaggtgcaccagccaccatacccggataatttttatatttttagtagagatggggtttcaccgtgttagccaggatggtttcgatcttctgacctcatgatccgcctgcctcggcctcccaaagtgctgggattacagatgtaagccaccatgcccagcctagtaaatgctttttaaaagaatataaaactatagagaatatgacctcaactatttaaaaatatgtataagggttatgtattttactagcaaagaaaaaatatatactggtagaaaatagccatcatgtcaacagtgattatattaggtagaaaaattatgagagactttaattttttttcttttctatattttactattgattgcttatgagttttataagcttatggttgcttatgagttttataataaaggtttttaaaatttttgcaacatggaaagttatacttctttatatactaaaaacaaaaacaaaactttctatttaaatacctttgacttttactgcagacttacagacccttgaaagaaaaggcaattccctcgcactagttctggtgtgactctacccatctctcccttcagttccaccttggtcttttttctacctcccaccttggctagtcatctctacccaaaatgcttgcttggcttaatggttagcattcaggaaaaggagatcttgaattcctaatctaaactaaggttatacatgtgggaaataataaagagaaaccaggtagtaaataagatttgaaggacttaaaatacccagactttaattcctctaagattatagtcattaatcatgcttttatatcatattatctcttaacattatatcatattatctcttaacatttaatttctaaatataatgttcatgaggaaaagagaaaatagcttggcttctctcttcactgaatggttgttcttagtatcttctagatgttccagaactgatgtcagatttggctcgtcagagtccacaaaacatattggtgagaaagatgaagaggattcctgtttagcacagagacacctatgttaaacatttacatacagactaacccaaatatgcaattaaaccacaccactaaatggcaagattaacatggatttaaacaaaatgtatgggggggaaaaggcaacacattaaaaccaatgtgaggagttggacttttgaggcagccattctctttgcatagcactgtctgctactacagctcatagaagtcaataattttcttcagcactggtaggcagcctctaaatggccccaatcaccctcacctcctggcattcacacccttgtaaaattcccacctctggacctagtgactcacttctaacaaagagaatgcaacagaagtaataacatcacttctgagatgaggctacaaggacaaaacgatgcctgccttggtcacccttctcctgctctttccattgctccctctgatggaagccagttgccatgtgatgaggtgccctatggagaggcccacgtgacaaggtattgtaaaagccctctgaccaatagtcatctagaaacagaggcccagtacaacagcctgtgagataaatcctgccaacatatacgtgagtgagcttggagatggattccctccctatcctgccttgggatgatcatagccgccaccaacaccttcactgcctggtgagaggccaagcaagtgaacccaaggtaaactgcacagaatcctgacccacagaaactgtgagataatgtttgttgttttaagctgctaaatttgttacagagcaatagataactaattcaaacaccataaaattctaatattttattctatcacacaaaccaagtaataccaagaaatgccattgctatacatgtatttttggaacacaattacatgtgattttttttaaaaagctaatgaactaagcattatgtgcttttaccactaacagacatttactctgttactttctactgtttcctattataaattggggagaagccattattattatatattagcttcacaacaactaggttcaagtcatggaaaacaatttcgcacaaactttaggaaacactgctttgaaaactgtaatctgaattatagctgaagccacagaaaccaattatttaccaaaggttcttttaagaaaaacaagttggccgggcgtgatggctcatgcctgtaatcccagcattctgggaggccgaggtgggtggatcacgaggtcaggagatcaagaccatcctgtcttgatcaagaaaccctgtctctactaaaataaaaaaaaaattagcggggcgtgatggcatgcgcctgtagtcccagctactcaggaggctgacacaggggaatcacttgaaccagggaagcagaggttgcagtgacctgagattgcaccactgcactccagcctggtgacagagaaagactctgtccaccccccaaaaaaaagaaaaaagaaaaacaagttttctggaaggaggacatcattaacagtatatctcttcaataatggtttattttactattctcattcttctcattcctctcttactatgtcccaaatctctttacaggctaaaagaaactcttcagaattaatcctattcatgaagaacaccacttactgagtattgcattttcttcttcaaattcttcaacatgcattgggaatacaccctatggaccatttttatgtgtttagttttgggttgtttttttttttttttttttttggctaaagaaactgcaactagatttaggacctcattctattaggttagtatttgtctagtaaacttcagcataagcaaaataaaatacgtgttgttattctggactgaaacccctcaaaaccatattttaaaaattataaaaataaatgaactgaaatcatgtttttaaaaatcttgtagatgaaaagatatgatatatagtaggtttaactacctatttcaacggttcccaaagtggggccctcagatgcccaggtccaaactattttaacaggaacactaacatggtgacatttgctttaagggtgcaaatacaatagtgggtaaaaatgctggtactttagcacaaacagaggcagtaacaccaaactagtcatggtattcttcactatgcacaggaaaggtttaaaaaggaagggcaggctgggcatggtgtctcacgcctgtaatcccagcactttgggaggtggaggcaggtggatcacctgaggtcaggagtttgagaccagcctggccaacatggtgaaaccctatctttacaaaaaatacaaaatttagctggacatggtggttgtatgcctgtagtcccagctacttagaaggctgaggcaggaggattgattgagcccagaaggtggaggctacagtgagctgtgatcatgctactgcactccagcctgggtgacagaataaggccctgtctcaaaaataaaaagaatgtctatgatgaatcagtgaaaattttactacatttttatccttgaatatgtctttttaatatttcaagtgatgaaattggaagtacacatgagcatttctacagactgcctgagaaaaaaccctcgtgtgactaagtcgtgaagtgaattaaccactttaatggaataccatttttacttgaaaggatgactgacaaacaatgttatttcaacttgggtttttgggagacattttctcaaaaaaatgagattctgtcatttcaagaaaaacaacaggcaggccataataaaattcaataataaaattgctaataataaaattcaagcttttgaacaaaaaattagttttagaaaacttatatccaccatagctttccaaaagtattctgatgagattgatggtgatattgatgaatgtattttgatattgtataatcaaacgtatcaacatgtagaagatcttgaaccattattttctaaatgaccaatgcatgatgttgtaatatcatgcaaaggtaaaagatccaaagttcaagaaaaaccaagttttgatggagtatcaaaaaagaagcctaggcaacatggcaaaaccctgtctctacaaaaagatacaaaaaattagccaggtgtggtgatacacacctgtagtcccaactactctggaggctgaggtgggaggatcacctgagtccccggagactaaggctgcagtgagctgtgatcacaccgctgcattccagcctgggcaacacagcaagaccccatctcaaaaaaaattaaaaaaaaatatatatatatatctccacaatgatctaaaatggctatctgtataagattggacattgttcatgttttttaaagcaaatatcacacaataaattgaatgcagatgaaaatgacataccaaacatcaaagaaatttgcaaaaaatgtaagactgtgctacttttggtttagaaatgttttcataaaagcatttataacaatatgtggtgagcttttaaagaatagtttaaatatttctgatttaatttctagtgataaataccaatagatataacctacataaaccaaagctccttgggccctcaatatatttttaagagtataaaggagtcctgattccaaaactttgagaactgctgccttcccctccactttccttccttccctagaatttcttcctgggaagaaacatccctttgccattccatattaacttacagagttccactgaggccagttttgctacctccctcccatctttccacctccctctcttgacacaaaacctaaccaaaggactttaccagcccaccccatttccagtgattagctgtcaaggtgggctaagccaagaaaatctgggttttctctgagactagccctctctttctgggagattggaatcacaggggcaaggctggctaccttgggatagtcagaattcatcttgcctaaatggggagaggttaggcaagtttctagaaagccaaactgctttctagaaagtcaaagataattatactttctgccacaactgtgagaatgcccattttctaacatttttaccaaactgataaataaaagctggtacctagaagaaaaaaaggccgggtgtgggggcttacatctgtaatcccagcactttgagaggccgaggcagacagatcacctgaggtcaggagtttgagaccagcctggccaatatggtgaaaccccgtctccactaaaaatacaaaaattagctgggtgtggtggcaggcacctgtaatcccatctacttgggcagctgaggcaggagaattgcttgaacctgggaggcagaggttgcagtgagctgagatcacaccattgcacggcagcctgggtgacaagagtgagactttgtctcaaaaaaaaagtttccatataatataatttgttccatctctagaaaccaattcagcaatgagaactgaaagccaccacttggaaggtttcaaggattcagctctacctattgatgtctaaagcattagttaaggtagaaacacacacacacacacacacatacagcctatgtattcagtaccaggaaacatgacgggctagatggtataatcatccaacagaaagcgcacaataactgaagccactgcagaggagtaagttacgacacggatctacaatattgttgagtgaaaaagcagattacaaaaaaaatctgatttttcaagggagagggaacatatacaagcataggagaaaagagatgagcagatgactggaaaaatacaaaattctgatagtggtaccttctgagtggtagaattatcagtaatattttctagttttgcctaaaaattttctaaatttcttaaaataaggttttgttatccatattataaaagatccaccaccccaggaaacttaaccttcagcacaaactctacaacatgttcaaagtttgttcagtttaatatttaagagacaatctattttgaaagacatctaaaatgatgaccaatatttaaacctatgcattaatatttttcaatcatatgctttaaattttgtaattttgataaggttaagctttatatccaccttgaaaaggtaagttttctatttgtcttcaaaatatgacctaaaataggccagtttttaaacagcgaatggtgctcaaaaaccgcaatataaattcaggcagtgttccttacatagaatgtttaagtgcttctaacactgctgtttttcaccagttatgaaaacacattacaattatctaagcatctaattattcaggtcccttgtttctcctccattctatcagttttatagtaattttaaggcctgtgaggatgaagttgtctgtgatggctaccacaaaggttactataagtggacaaatttccaacaagtttatctccactaccatccccaccataaaactgtcttgatcaagggcaacacatttcaaggttaaccaagacaacctctttacctgtcactgctcaagaaaaggattttttggtcttatttagaattaactttctgtatctatttttctccataaatccactgaggccaatgtgtggctctatctcaagctccagcaagcaaaactgcctgccagaaggttcagtttttgtatctttccaaatgtaggacacagctctcttttgatatcataattatttgaaaattgatgcacaaacttcttcttgaaagttcagccaggcacagtggctcacgcctgtaatcccagcattttaggaggcagaggcaggtggatcacgaggtcaggagttcaaaaccagcctggccaagatggtgaaccccgtctctactaaaaccacaaaacttagccaggtggggtggcaggtgcctgtaatcccagctactcgggaggctgaggcaggagaatcgcttgaacctgggtggcggaggttgcagtgagaccagatcgtgccactgcactccagcctgggtgacagagtgagaatccgtcttaaaagaaaagaaaagaaaaagttcagatatacagcagttgtaattcttctgaaagctagttatgggacacattactttcacactttgctgttcaataaatgtggggtggagaataaagtaaactgacagaattaccatataaaataaaattctaagtgctctgacaacaaaagaaacttaaaacacacacacacacacactctctctctcacacacagttttccctgctaatcattttacaactaaacaaccaaagtagctaacccagagcccacaacagcagagtaaaaattctaacacttggttaaataaaaatgcacatataccgctgtgagctaaaaaaaaatgcttaagcattcaaagacagacagcaattacagctactgagaacatcattgtaagcaaactgaggcagagaaaacaaaggtgctgatgaggaattgaaccacctaacctgcagaaacccactggatggtttcctaggttccgagttggcattatctttcagagtgatttctaaaagagatcacataatactgttacaaaggatctggagaaagggacccttgctttatctctctggctctccagtcatgctttacattttcacttcttacgctctcatatgaaatcaatttacagacttccttcaagcccttagagacctttttgtactatccatgacaagttcttgatgtagctctgcacttttgacaaattcttagcagttaactttcaaggcagttaagatttctgttcaagcacgatatagctagaatagggtcatatactcaataaaacaaatatttaccaagcatttactgactggaagataaaaagcacaaagcataattataaaatattttcccctgccaccataaaaaaaaaattaaaaaggcctacagaatatagcataacatgaccaaagcaaaaatagtgaggaccaaagaggggaggaagggaaaatatcagcatgaactgaatatgacccaggagagccttgatggtcagacatgtaaagacaaattgggtagggtgaaggggtggaggtcagggacgcatcctacaggggaaaaacagctcacacagaagcctgaaaggaaaagcgggcagacacctgtacgggactcttacctgccgccttgactgtacaatgagcccttccagaacacagcagcgcgcggccaggccccggggagagggatcgctcaaacagcaccagaggctgcattccaacttttcctccgtcaacgaggccgttttcattgttagtttctccttaaacacaaacttaaaaacaactggcttaaatctactatcgcatcttgcgtgatcatgtttgtgccttacagtgacaggctgcaaacgatagaaattcaacccaaactgtcacaagaaaagaaggaaaggcttgtaactacttaaacatattgctaattaaagatgtctggaaaattgactcaaaaacaaaaacaaaaacaaaacaacaacaaaaaattggccgaacacgcgggaacagggaaaacctgactgaagaatgaggccttaaaacttaagggccttgggtcccggcgcggtggctcacgcctggaatcccagcactttgggaggcagaggtgggtcatttgaggtcaggagttcgagaccagcctggccaacacggtgaaaccccctctctactaaaaacacaaaagttcaccagccttggtggcggggcctgtaatccagctactggggaggctgaggcaggagaatcgctttaacccgtggactgtcaagagacataggctgcagtgagccgagatcccaccactgcactccagcctgggcgacaatgagactgtctcaaaaaaaaaaaagaaaagaaaaaaaaacttttttttttttttgagagaagtctcgctcttgtcccccaggtttgagtgcaatggcttaatctgggctcactgcaacctccgcctcccgggttcaaacgattctcctgcctctgcctcccaagtagctgggattaaggcgcctgccaccacgcccggctaatttttgtagtttttagtagaaacgcggtttgaccatgttggccacgctggtctcgaactcctgacctcaggagatccgcccgcctcggcctcccaaagtgctgggattacaggcgtgcgccaccgcgcccaggcaaaaaacgcgagcatctcagaggccttttcccttccgcgcctgggctcaaacgacgctggagcgccccgccccgccccgtcgcggtcccgggagcagtcccgctgactgagggcgaccatgggtcccaagagggctccggccgccgcgggctcccacctcggtgcgtggcgacggcggccaagaggggccagcggcccccgagtcagccccgcgccaggagccggagagacgcgccctccgcctcctcccacccaagcctcgcgcagtcccgggggcggggcggggccagctgagggaggaaggggcggggacccggggcctctacccgttaggctgccgttggtcccgagactcccccatctgcgcccccgccctgccctgcgaggccgccgccgcgcgccccaccgtctgttgcagtggagcgtgagccgcggctgcggctcctggttcttgtggaaggtagacgccagcaacttcagcttggccttaaccctgacagggacatcttccctcatctccggcgggaggggcgcggaaggggagccgctgtcatggctgcgaccacccagcgggaccgcccggccgagcgctcgcggcttcgcctctccccgccgcctcaaccttcgtgggagcgcggatggaaaatgggaaggggcaccgaggcctcggcggggagctgcgcggcggcctcgggggctgctccctttgcgaccgacgccaccgataggaggggcggctcctgtcaagcctcagcttaaaagggcaacagcggccgggcgcgggggctcccgcctgtcatcccagcactttgggaggccgaggcgggcggatcacgaggtcaggagatcgagaccatcccggctaacacggggaaaccccgtctccactaaaaatacaaaaaattagccgggcgcggtggctcacgcctgtaatcctagcactttgggaggccgaggcgggcggatcacgaggtcaggagatcgagaccatcctggctaacacggggaaaccccgtctctactaaaaatacaaaaaatgagccgggcgcggtggcgggcgcctgtggtcccagctactcgggaggctggggcaggagaatggcgcgaacccgggaggcggagcttgcagtgagccgagatcgcgccaccgcactccagcctgggcgacagagcgagactccgtctcaaaaaaaaaaaaaaagaaaaagaaaaaggacaacagcaccaccgtccccgctaccgcctgggaaagggctgccccaaccctgccaccttccctgtcacccctcaacccggcgcgcacccgttttggcggttgcacgagtccagagcgtgcgcgcgctcccggctgccccctcctccccttgacccagcacctttctgcccgacccatctagtccctacattcctcacactcgcctactggaggctcagggcggcacaaccaccaactgtagtgtgtgtgtttctcccgagtgtgtgtgtgtgtgtctcccaagggaacagagcactgctgagttcaggttgattattaggtcgtggactgtcagcaaaatgcagtcacaagaaggctgtgggctgttttgtgttttgcggtgacatcatgttgctcatgttttatgtttttcagagttcattagtttctatttgttctcagttaatatccacctcaatagattgcataagtagaatacccccaaactgaaagtcacctacataaagtgtagtgaaaaatatgtcacccacttaaactatagcttaaactatagttgaagttgtgtacacactagttttgtgtagccaacactaggtaatgggtaaaggcacaggatcctggggctctactgcctggttcaatttccaactttgccatttgctgactgtgaaatactagacaactttaagcctcagtttctttcttttttttaaacttaatcccaaatgtgatagtaagtctcagtttcttgatctgaaaaacagaaattattcaatgagagtctgtgaaaacattaaagtttttaaagccactgcctggctcaggaaagtcctcagctttagccgttattagctatgataattattgtgttggctacacgtgcattaatgaggtaggaaaatgctcaaggataacaaccaagtatccagattatctcatgagaccgagagagatgcatatgtgtgcatgctcatgtttcagctcagagcgctttgtctagaaggctcttgaactcagaggcccaggcactatcaacttgactttgcagtggaggcatcacttttgttgatcaatgaaattgacataatgctcattttttttttagcaccgaccatgtgccgagagctaactgtgtcaagaagagcatgcttcagttggctggagtgagcaattcaacttgtggaggagtgagaaatgttagtgttgagacaagaaacgtaaaaccccagggtaaggtaggaatcagtgaaaggcagaggaactgccgtccagtaatgagttaggctttgctggcttctggccctacagatgactctttggagaggaaaaaattaagctaggcccgagggcacagatcctaagggaatgctggcagcctaggctgtctatggaagagaagcagagggtggcacctggttgaaagagggggttgggggacagagcttgaggctgtgtttacagatggagtcctctgattcctgtgactggggaaggagatcgtgctggatcagggcacctcaaatcagaactcttcccacccacaccccttcttttcagggcgtctttcattgcaaacagtagataaactagttggaaaactcagcagattctcacggtggtgcctagcaggccaggcctagctgccgtttaagctgtgactgagggtgatgccactggcctgtaaacacacattggacaatctttacgtccgtggacacgccatgccccacagagacagctgtgcatggttctttaggtttggggtgctgtgctggcagttgcctgataaatgtgtaggattaaaatgggatgccctggagcttagctaacctttatcccccctcccccctctaaaatgaaggggctgctagttttgtttgctttatgaaagatggatctgttattgtttttagaacctttggagaaagatttgttgggaggaagcgatcctgaacccccagagattttctcatttactggtgcaccagctttcgagtcctaggtcttcatcctggctcagccaccctccagctgtgtgacctttgagaagttgcttgactacactgagtctcattgtcacctatgagtggaggttgctacattgctactgtgtggagcacctacccccagccactcttacagggtgatggtgacgattaaatgcaataataaggctgaaggaggaggatcgcttgaagccaggagtttgagactagcctgggcaacaaagccagaccacatttctatgaaaatgtttttttaaaaaattagctggacttggtggcttgggcctacagtccagctactcgagaggctgaggtgagaccacttgagcccaggagcttgaggctgcagtgagctgtgattgcaccactgcactcccgcccaggaaacagagagagaccctatctcaaataaatgaataagtaaataaataaaataataaaataatgcatgcaattagtacactagtacatgatcaggcacatgataactgctcgataaatggtagcctcagtaaactttataatgttttaaaggagaatgtcctttggactcagcctttcaaatgacagagcatttgaaaagactgatttgtatgatggctatttcctacagatacaagactgtacctccagggactcaaggcattggctcagtggggcaccttgttctgtttactcttgttttggtcagcaccgattgccctagggctaagcagggctgccaccacagactcagttgccaagagtatccccctccccaagctagccatgggaaagccactcgcattgtaagactacaggaaatcaaagggaataaaaagcacaatttagtcacctactctccagttgatgggcaataggtttttgctattttgaacagagctgttaggaacattccttgtccacatcccctgttttatataggcaagaatttctcttccacgtagagtagaattactgggctaggaggagtgtgaatattgaaccttatgagatggagccaaactgttttccaaagtggtcataccagtgtatactcccagcagcagttcttaagagatctcaggatgtctatcttctggtgatttcacaagcagtcaaaaagaatgaacgccagcaataaacaacaataagaactttagcaatataatattgtgagaaaaacaaattccagaaggatgcatacagaatactttatataacatggaaaagaaaatgtatagacccagcatggtggctcatgcctgtaatcctggcactttgggaggccaaggcaggaggattgcttgaggccaggagttcaagaccagcctgggcaacatagcaaaaccctttctctacaaaaactagaaaaattagccaggtgtggtggtgcaggcatgtagtcctagctactcatgaggctgagacgggaggatctcttgagtttaggtgttcaaggttacagtgagcccatgattgcaccactgcactccagcctgggcaacagaatgagaccctgtttgcaaaagagaaaaacaagtaaataagtaaaatttaaaaacaaaatgtgggctgggcacggattctcatgcctgtaaccccagcactttgcggggccgaagtgggtaccttatgaggtcaggagttcaataccagcctgatcaacatggtgaaaccatgtctctactaaaaatagaaaaattacccagggtggtggtacgcgcctgtaatcccagctactcaggaggctgaggcaggagaatcacttgaacctgggaggcagaggttgcagtgagccaggattgtgccattgcactccagcctgggtgacaaagcaagattccatctcaaaaaaaaaaattatttttttaaaaagataacattgacaaacaaaaggaaacatgacaactgataccacaaaaactcaaaggatcactagtggctattatcagcaactatatgcaaacaaatgggaaaacctactaaaaatggataaatttccagacacatccagactaccaagactgaaccgggatgaaatccaaagccagaacagaccaacaacaaataatgggatcgaagcagtaatgaaaagtctcccagcaaagaaaagcctgggacctgatgattcactgctgaattctagcaaacatttaaagaagaactaataccaaccttacccaaacgattccaaaaatagagaaggagggaatacttccaaactcattctacaaggctagtattaccctgataccaaaactaaagatacatccaaaaaagaaaactacaggccaggatcactgatgaatattgatgcaaaaatcctcaacaaaatattagctaattgaattcaacaacacattaaagttggggtgcagtgtcccaggttcactcaacccttcccgttttcttgtctgtgtgtgtctactttgctctgttccctggtggcagcggcggtggcaatgttggtgcatgggcctcctaggacaaggggaaagtgagtatgcccttttcttgcttcctgccaggcatctgcagcctggcgcaagctctggccaggtcttcaagcaaggtacctggagatgttcttttccaatttctggattggtaacttgaggcaaattctgggcactagagtcaggactaagatgagacttgaatcaggggagtctggggtcctgagaggcagaggcctgaaaccatctagagcatgtggggacctgggtgtgtgttcaggccagttgcctttctctgtgcttcaatgttccaggtacccttggagggactgagatcctagggattgctggagcctggctgcatggcctggccaccctgatgcgcttgcattctccgtgacaggacagcaaggctgaggagaatggctcccacagcttcatgcactccatggacccacagctggagcggcaaatggaaaccacccagaacctggtggactcctacatggccattgtcaacaagaccgtgtggaacctcatggttggtgcgaagcccaagaccatcatgcacatcatgatctacaatgtgcatgcaccgcctcatgggggtaggcggctcctgtggcactggggatgcaggtggccatgttggcctgggggagatgctgaccagccctatgggaccaggtccagggagggaggcatggtccagaccagagctgtctcatagaaatataacatgggactgaggacagtggtccatgcctgtaatcccagcactttgggaggccaaggcgggaggatagcttgagcccaggagttcgagaccagcctgggcaacatagtgagacctggcctctacacaaaaattttaaaaatagctgggcttggtggtggcacgtgcctatagtcctagctactcgacaggctgacattagaggatcactttgagcccaagaggttgaggatgcagtgagcggtgatctcgccctctatactccagcctagcgacagagtgagatcctatctccaaaaaaaatttgaaaaacctgagtagacaggtgtcctggtagcatgataggtccagggtcccctcccagatctgtgacttgcacaggcgacctttcctctggacctcagcgtccctatctgagtgagaaaagggcaatggggaggcagatctttgagtttaagctgtgtagaagccacatctgaaaagccatactcagggcttcaactccagcacacagtcccagcaggcgccagcgggaggccagggcagcacgggcatcaggacccaaactccttccttctttgcccactctcagaccaaggagttcatcttctcagagctgctgtccaacctgtactcgcgtgggaacaaggagacactcctggaggagtcggcagagcaggcacagcggcgcgacgagatgctgcttctcagagctgctgtccaacctgcactcgcgtgggaacgagaagacactcgtggaggcgtcggcagagcaggcagaccaaggagttcatcttctcagagctgctgtccaaactgcacttgcgtgggaacgagaagacactcatggaggagtcggcagagcaggcacagcggtgcgacgagatgctgcttctcagagctgctgtccaacctgcactcgcgtgggaacaagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagcttctgtccaacctgtactcgcgtgggaacgagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacaagatgctgcttctcagagctgctgtccaacctgcactggcgtgggaacgagaagacactcgtggaggcgtcggcagagcaggcagaccaaggagttcatcttctcagagctgccgtccaacctgtcctcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagcggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcttgggaacaagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagacctgctgtccaacctgcactcgcgtgggaacgagaagacactcatggaggagtcggccgagcaggcacagcggcgtgacgagactcgcatgggaagaagaagacactcctggaggagtcggcagagcaggcagatcaaggagttcatcttctcggagctgctgtccaacctgtactcgcgtcggaacctgcagacacttgtggaggagtcggcagagcaggcacagcggtgcgacgagatgctgcttctcagagatgctgtccaacctgcactggcttgggaacgagaagacactcgtggaggcgtcggcagagcaggcagaccaaggagttcatcttctcagagctgctgtccaacctgtactcgcgtgggaacgagcagacactcgtggaggcgttggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaagaagttcatcttctcggagctgctgtccaacctgtactcgcgtcggaacctgcagacactcgtggaggcgtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcgcgtgggaacgagcagacactcgtggaggcgttggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacactcgtggaggcgtcggcagagcaggcagaccaaggagttcatctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcacgtgggaacgagcagacactcgtggaggcgtcggcagagcaggcagaccaaggagttcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtggcaacgagaagacactcgtggaggcgtcggcagagcaggcagaccaaggagttcatcttctcagagctgctgtccaacctgtactcgcgtgggaacgagcagacactcgtggaggcgttggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacactcgtggaggcgtcggcagagcaggcagaccaaggagttcatcttctcagagcttctgtccaacctgtactcgcgtgggaacgagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcatgggaagaagaagacactcctggaggagtcggcagagcaggcagatcaaggagttcatcttctcggagctgctgtccaacctatactcgcgtcggaacctgcagacacttgtggaggagtcggcagagcaggcacagcggtgcgacgagatgctgcttctcagagatgctgtccaacctgcactggcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaacaagaagacactcgtggaggcgttggcagagcaggcagaccaaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatgtaggagtcggcagagcaggcacagcggcgtgacgagactcgcgtgggaagaagaagacattcctggaggagtcggcagagcaggcagagcaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaaccagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcatcggcagagcaggcagaccaaggagttcatcttctcagagctgctgtccaacctgtactcgcgtgggaacgagcagacactcgtggaggcgttggcagagcaggcagaccaaggaattcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggcagagcaggcacagcggtgtgacgagactcgcgtgggaagaagaagacactcctggactagtcggtagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaacgagaagacactcgtggaggcgttggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcatcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcacgtgggaacgagcagacactcgtggaggcgtcggcagagcaggcagaccaaggagttcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaacaagaagacactcgtggaggcgttggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatgtaggagtcggcagagcaggcacagcggcgtgacgagactcgcgtgggaagaagaagacattcctggaggagtcggcagagcaggcagagcaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaaccagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcatcggcagagcaggcagaccaaggagttcatcttctcagagctgctgtccaacctgtactcgcgtgggaacgagcagacactcgtggaggcgttggcagagcaggcagaccaaggaattcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcggagctgctgtccaaactgtactcgcgtcggaacctgcagacacttgtggaggagtcggcagagcaggcacagcggtgcgacgagatgctgcttctcagagctgctgtccaacctgcactcgcgtgggaacgagaagacactcgtggaggcgttggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcatcggaacctgcagacacttgtggaggagtcggcagagcaggcacaccggtgcgacgagatgctgcttctcagagctgctgtccaacctgcactagcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcgtggaggcgtcagcagagaaggcagaccaaggagttcatcttctcagagctgctgcccaacctgcactcgcgtgggaacaagaagacactcgtggaggcgtcggcagagcaggcagaccaaggagttcatcttctcagagctgctgtccaacctgcacttgcgtgggaacgagaagacactcatggaggagtcggcagagcaggcacagcggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaaccagccctcgcgtgggaaccagaagacactcgtggaggcgtcggcagagcaggcagaccaaggagttcatcttctcagagctgctgtccaacctgtactcgcgtgggaacgagaagacactcgtggaggcgtcggcagagtaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcacttgcgtgggaacgagaagacactcatggaggagtcggcagagcaggcacagcggtgtgacgagactcgcgtgggaagaagaagacactcctggaggagtcggcagagcaggcagacgaaggagttcatcttctcggagctgctgtccaacctgtactcgcgtcggaacctgcagacacttgtggaggggtcggcagagcaggcacagcggtgcgacgagatgctgcttctcagagctgctgtccaacctgcactcgcgtgggaacgagaagacactcgtggaggagtcggcagagcaggcacagcggcgtgacgagactcgcgtgggaagaagaagacactcctggaggagtcggcagagtaggcagaacaaggagttcatcttctcggagctgctgtccaacctgtactcgcgtgggaacgagaagacactcctggaggagtcggcagagcaggcagaccaaggagttcatcttctcagagctgctgtccaacctgcactcgcgtagggacaagaagacactcctggaggagtcggcggagcaggcatagcggcgcgacgagatgctgtgcatgcaccacgtgctgaaagaggctctcagcatcatcggcgacatcaacatgaacaccatcagcacagctacgggggcccgtggacgactcctagttgcaggtacagagcgtcccggctggacccaggtaccagggctggcccccactagccccaaagccccccagcctccatggctgagcttgtgggctcttggaacaggctctgtgcccaagctggcagacatgggctctctctggagctgtcagagagctcgtggtttatggtgtaagggctgagagcttggagggggttgtgtgcagggctgtactctgaggcggccagaggcctaggaatgtcatcctgggcacgctgtagctgttgtgaagtctgagtcatgctgccagggagggcatccagctcccagcctgggagtgcttagagccaaatctactgcagagcaggggtgatagtcagggtcccacctcctctatctgttgacaatccagtggtgatctaagataaaaccttgagactcccatacacacggtcaacccacaacacacctcacaggccaggcagggacacacagtccccttccctccctcccaggtaccatcatagctgctagcgtgtggctgaaggcagggtccctggcccccgctgaagcactaccgccagccagcaggctcacgcaccttggtctgttgcttctagaggttgcttctgctattcagccgaggggaccatagtgcatgctggcccggctgagctccacccagcaagcccacccacctcccttgccatggactctccctcttctgcttttcccagccctcacctttgtgacctgcaacccccaacaagctgaggctcccctcttagacttataagtctatagccagtggcatccagctgcctgtcctccctacctcccccagggtcccttcagagggtcctgggctttctgactgcccaaaaggggctccggcgatcactccagccatccatcccttttagcttcatcatcctggttcaagcagtgttccttctctatcaggactggtggctgttgttttgggttcccaaaagcaagagatggccccgggccagtgggttcaaagacagggtgaccagagaagagggacactggagggggctgagcattgctctgaacggtgggtgcaccgccctgggtgccctgaaagaggccagcgtgtgtggggtggggagggccgccggagcccccaggcactaactgtggagcattgctctgaacggtggctgcaccgccctgggtgccctgaaagatgccagcgtgtgtggggtggggagggccgctgcaacccccaggcactaactgtgaagctctgcctccctccttcttcctctcctttcctttccagccccactttcccaggagcctcgccatacccgcacctgtgccctccccacccctgccctcccacagctgctgtggcatgcctgtgctctgcacttgcctcatcagctctctgctcacttttctctctcctgcttctctctgcttgcttttctctctcctgcttctctctgctttctctccaactgccagctgattgggtccggcaagaccatcccatcctcagagccccagcccctccttcaacgtctaaacagatccctcctcttctcagtgacctccctttccaagcctgcctgagcggctgttctgtgacttgacagtggctcccccagccccaaagccagccccctacatctgcgacttagtctgttgtagtggtgagctgacacatccaggtgtgaccactgctgaaaacttgtgccccctttgtgatatgtcccgtcctgctctataaatatctataaatacatatatatatatatatatatatatatatacatatacacacacacatgcagcaacacctggccgaccgcctcgtctctagcgctgggaatcagtcaccctgctgtccttttggagtcttgtggcccaacaagagaaagctgtcccctgacattgctcctccaaagtgcgccacctccagtgagcctccctgtcatgcccagcctgtggacagccagcccctccatccctcccaccccccaccaagcatgggggtgctgtgcaggcctctgtgtggcctgacagtctctaccagtcctgctgtcccttggctgagaatcaaacccatttctggatggcagggaagtgtgtcctctgctggctgtgttctgtgtggagctcagaggacgggaaaggccaagccatttctagggtgctgttgggagctgtgaaaaggtcacaccctttccaagggacacttttcctggaaagcccctggagcttagctggctcttatcctgtgaagccggctctggccaccagggggcagggccgtgaactcagcctggagggagcctgaggggcagccggcactctggagggacacagacataacaggccaccaggtgcagacaggagagggaggcaaggggatggaacggaagacacctggggtgggtggaaggcagtgcccttaggtgctggtacctgtcttcccagccatggctagatcacgcttctgagcctgttggctgtcagggccgggctgcgccccataggtgccatggcagtccccgtggaatcccccaggcgtcaccaggcagcatacaggtaacaggcctggaaggtccccaacagcccagctggacacactcagacactccagggcttctcgttcagtggcacaaacaccaggacccagtgagggaaatgggaacacaccaggctgagcagtatggctaaatccgtttattccaaaataaaaagcaaaataaacaggagtcgcatcaccaggagccatgaccccatccccgcctcctttctctgtcctgtgctagcaatacataagtttcccagccacaaataatgatcagaccctcctccccatgtgccagctccaacctcctctaggtatgatacaggggcggccctaccctctggaatatacaaaacgttacatagatacaatatgtaaaccgggaaggggggccaccccagcagcccgtgccctcacctggtccacagttagccccactgtcccgcctcagctgcctctctgaataagaagatgggagcccccccgagggaaaagttactatggtgagagtaaggaggccatcagacctcctccaaacaaaccacctctgccagcctctggctcttaaataacaatcatcatcatccagaaatttgaggactcagccctggtcaaggcggcaaagggtctgtctttccccattagacagaggtcttgtgtggctaccctaattgtaaaggggtgactgggaaggggtggtagggtcatggtggcagtggagactccagccctacttctccaggctttgctgacagaggcctgcttttaatttttgtttttatcccatgactttttttaaaatcccgtaacttctttttcataactttttttgtaacttttcataaaatttttttctacttttttgccacaacttttttacattttttatcccataactttttcactctgtaacattttttaatcccgtaacttttttattttgtgttcttttaacaaacacttgcatagctatattacaattttgtaaaaatgaaacagattatctcatgccaagcgtgcccagcatttgcacactatcaacacctttaatactatagtttttcaagacatgcaaaacaaaattttaagtcaaaaacagcgctttgcaacatttaataatttattacattacagtagcatcacactagcagtcaataatgccactttaggcaaaagtttttcagtatttccattataccttctgtttacaagaattcataaattggtaaaattcattctaagaaaacttggcaaataaagctttggactggaattggcatttctttctctacttttcctttccaccatttctttcttttaaactatagcattcatattttaaaatgttttatttcagaactttaagatagcagttacattttttaatagttacattatttttaaatgactctttaagataaagttttagagaaactgtattatggatagggctgatttacattttcaaattttctaaaaatcagctttggttttagaactgatttctttttttcatttctggaaaacctatcaggtttaatcaaatactttaaaaataattattatatattgcaatctttaaataggtgttttgattattcctgcagaaattcaaattgattcagttgaactagcattttaaaattctatgtttctgatgaactctaaccttccttctaagcaaatcaaaagctgcattgtactgaatgaggaagagcacaaatacttggctcaatgaggtatcgcaaaagactgtatgcactttgaagaaagacaagttagtcatatgatttccattctttttagctttctcttaaatatatgacaaatacttacacaaagagtggtatttcagttaatgtagtaaatttatttccagactgacgttcagcttaaatatgccagtatgtgatttaatccataggcacctgatgaacacattattgtcagattggttacagatgctaaacgctatctgaaggtcattcgtagtcattgatatttatcagggtaaaagtgaagtgatttcaacaataaaagtacctttgaaataatttaccaatgtattagataaacccagtttcagaatgataaagaaaaaacgttaggccaaatagatgtggctaattaacagtggtatgatttctagcctgagggtttaaaatggacttaaagtaactgtctttaaactgaactcaaagaatgcaaaagcagcaagttcagaaaataaaaggcaagaacagaactttaggtccattttaaacccatgggctagaaatcgtaccattgttaattagctgcattatttggtctaacattttttctttgtcattctgaaactgggtttatctaatacattgatacattcatacaatttggaagagtcagttgaagtcacaaggacccaatatttgcgctcttgcagtgaatgcaggcaaatctgttattccatcggtaaaatcatattgttgctctcctgttaatgtcatatttagaaaagtatcatgaggacgccaaatgctaaaaatggagatggtctagtaactagaaatccccaccccagggagcgcacatacacatctccctacatcctaataatgtgatgtgttttggaacacagacattagaacttcatgaagtttgaactgttgagtctttcccaagcatcatcaagttatgatttaggcaatgtatgactgaaatcatttgttcatcatgcataggcacaatcacataaatattgcacaaaatatgtccctaactgaaaccgagaggtacaaaaacatatttcactcttagtaaacaagtttgtcaggaaatataactctgtgattgtatagacacatttcctgataatacattgacattcacaaacagtagattgcactgcagtttataaacattttaaattgcataaacttctccttgattttcaaatataatatgctgtctataaaatactgtctactaaaactcctttttatttcaactaagtactctcacttatattagtttataataatgtttgttattattttttaaagtgttttccattcaaggaaaagaagtaaattcctatgtcagagtaagcaaggtggttgaagaataggtattagccacagaggtctagatggtaaaaatcaatcttcaagcctcaaagaagctccatgaacagagaggaatgccaggtgtcacaagctttccttcactctaattcattcttgactagagcctgtatgcctgttccagggacatttaaactcctaaaggatttcttatgatctttactaaataagaagaatgccagccagcactcttttgtgtactgggacatgtggtcatgtgattaaaacaggtaacatcaactctgactttaaaatgtattatagacacaaatgctctaagctaggaaatgttttccacatctacagtcaacgaagggagcctttcgttcctcagaaatgatcggtttttaggtcatcgagaaagagtacaactgctgcagctcatgatgcaatatcttcatgagcccagagcacatacaaatccgaagggaactaccatagtacagcgctaactgttggcaccggaacaaatgaaacacactctatcctgcacatacctgccacggcaggccactttcctcttctgtgagattttaaaagctcccccaaaatgttattactcccatcgccaatacacagaaaataggggaaaggctgtttccagttctcagcctttaaacaactctaaatgtcagtactcatagtgccatattacaaagtaataaaaagtgcacacttgggggcaaaccacatattgagctaatgaagaggtcactgtgattaagattagatcaaacaatagcagaacataagcaaattttatctgaattccgtaatgaatatacatgctgcaataacattaaaaaagcatggcagcctattccaaaccagcaagaataattttgtgcaaatagtgggtctttgtgtatttgaactcccaccacataagggcaaactcgatatgcatgctaatgacctacaactatgaaactaaaaaagaaaaatgctgaaggatgccagagtgaacatcagtgaaagccacagagacccactctcctttaactttttacaaataaacttaaactataaattacaaacacaaataatcatgagtggctctaacattcaagtgaagtaaatgaattgggtaggagatgaaccccataactttttttccttttttaaaatttcttgagcagctctttgatgatggtgatgtttatctccttcttctcagcagccaagcccagcgaaagaatggcatacgggagttgctgcacaagcctgggtgctccacgctgtcagtgaggctcacctcacaaagatctttggagagaaggaggtggggatccgagtgcagtgagagcctcccctgcccctgcctgcccaccctgcctgaggactctactcaccaccatgcttgtcagcacccacaagctcctggggggctggggctcctggaccaggctcatcagcaagcttcagggcagtggccgggaaatttgctgtgtccctcgttgtagtcaccacaagccacaacatcgtctccagcagctccagcagcttcacctggaagggaggggtgctcagctgttatgcatctaccggcgcccaccctcacgcccacccccacccctgcagagatgttgcacaccctaccttcatctcttccttgtcctggaccagcctgatgatgtcctcctccagttgccgcatctttggtactgccccctggctctgttcaaaggtgatgaactttcctgtgggaggacaggactctgacgctgaggcccctccaacagccctgcagctcccgctgccgtgccctggcctcccgctcactgatggcttctgtctttccagtactggatgaatcaaagttctagcttctccactcgctccctcaggtccgccttctcctccaggaggtccataaggccactctggagccaaaataatgggttcacatctcggcagtgacctgccccacccctgcccttcttggtccatgccaggactcactcacctccagcttctccatgacctcctgcatagcctggtgggtctccccactcacagagtcacccccagtcactggggctgggaccgctgcctctggcttcttctggactgaggccaccaggtgagccatgcgctggcagcacaccctctgctctttcacctgctctcgtaaccgtgcctgctcctcctgggcattggctccagcggagttgaaaaatgcaacctgagggcaagaggtgagcattattgtagaggcatacacagaacaaacagggcagagaggtggagtgcagccccttcccttggggtctcagagagtgcatctgttggtcacaggtgaaatggtgtctgaccactggctcccggaaagggtgagtgtccagagaaatcagaaggcagggaaaccaagagcataaaggggtcttggagggaccacagagggaggtggcaaaatgggtacagggggagtcaggctcaccgtggcctcccagctctccaggtgctccgggttgctcggcatgggccgaggtgcctcctcctcctcactgtccagatgtcctcctccatctcctgtggggggtggccagaagggtcctcagacaacccaacaaggggggtactgtgggcccaccgctgcctccaccctcactgtgtaaccctgagccagccactacccagagagaaatgagctgctgttctttatttttacttttaagaaccaagatcaggcataatcccactacggtcagtgcgggagttctgacctgctccctttctgacctgggccagttcagccatccttaggcaacttggtggccccctgctcccaggaggtcaccatattgatgctgaacttagtgcgggcacccggtcggcataaggaccagctgttctaaaggtctcttccatctcctcaatcctatgctgctaacagtccccacttcctcctggagctctctcctcttcctctgggcagtctcccttaccttccccagggagagccatgaggctcaactgggcctgtaggggctggttttgctggctggcagcttccaggcactcctaaggggccaggaaagggtgagaaggcacagagtttgccaggttgtcccccttagggccccagcctcagcagctccctcccctgggtctcctgcaacttttggcgggccaggtcggctatcgctttgcctcgagcttcctgctgatgcagctggttcattagctgggtctgctgcagtaactggctgtgcagtgcctcctcagaggtcagctgctgataggcggccacctgctcctgacaggtggccacatactgctgcaggtgacccaggtaataatctgggtgctgctgcagactctgagcctctcggctcttcagctccacctgcaggaagaccctgggtgtgagggcttgtggttgctggcttccagattctgggcccattaatagggtagtgagggcattgtggggctctgtcgcctgcccaggcccctggccccttgctccaggcctaagtgactgcctccttttcctagaaccccatgcctccttccccagcctcaaatctcatatcctcttctcaccatttaaactgtaggccacagactggtggaaaagcactgggagccaaccaccatctgctaatgctttccaagtattatctcagttaatcctcagcacgtctgtaaggaaaatgttaacttccttctgaagttaagtgaacagagacttagagatgcaaagtacttgaatggtgaccagtggaaccgaggctggaatccagttttaacctaagaagcctttttgttttgtttggagacagaatgtcactctgtggcccaggctggagtgcagtggtgcaatctcagctcactgcaatctccacctcctggcctcaagtgattctcatgcctcagcctcctgagtaggtgggattacaggtatgtgccatcatgcccggctaatttttttttttttggtaattttagtaaagatgaggttttaccatgttggtcaggctgatctcaaactcccgacctcaagtaattctcctgccttagcctcccaaagtgctgggattataggcgtgagccactgcacctggcataaggagcctcttataccactgtctcttcccctgtgactggggcctccatgccgctagctgagatgatgatgtctagacctgggaggagcccagggctacccacctctaaaagtcagaaggcaggaagcaagaaatagtcacaggactgccctggagggtgctgaggtcacctgcccacaggctagtgctgcctctggcctggcacctcccctcccaacaggctggtgcccgcctcccagcccttcttggatggggcagaggttactgtctccttcacctcgccaagcttctcctgcagctcctctacttgctgctccaactgcagtgcacttttgttcttgttctggacagagagaagcaatcagcagccacccattgcagctggagaccccagaacttggtgtctgcctcccatggcaccgggaagggtggaggcaggttagaaaaatcatcccgtctcccacagccaccagagcacggctctggctcacaggtgcctttagaagtaacgtttcacttgagggctacactgccccattttacaggtggggaaacaaaggcctggagggctagggaggagggcaggctccctaggtggggcaacgcaccagctcctcgaagctactctgtggctcggccagctgctgaggcctcgcgtcctgctcccgaagcctctcatcctgctcctgaagcctctccttttgccccaatatcaggacactcatgcgcttattgttgtccacctgggcttggagttctgctgccactctctcaacctccttcctcaggtgctgcagctccacctcagagggcactcctggaggctccgggagcaggggttcagctgagaaaggaagcagacaataaaggcctctggattctcaaaaaaacaaacaaaagaaaaaccctcctcttggtgcacagctcctctcaggctccccgaacttggcctcactgctactgattcctcacacccagatggtagccaatcttccaagccactttcagatagagagcactgtgggtggctgacaacgggccctctttgctgatggggacactgaggatcatggagatgacaagacttgctgtctctggcacagacctctttccttctgcctcaaagcccttccattgacccacctctctggggcattctaagccactcccacagccctctgatgccagtcctgctcccaggtcatgccagccccatcttacccatctggtttttgagtttggacaagctcctctccagcttctctccccgatgtgtttcatacttctccttcttcaatgtgtgaacctgcccaaaccacaggggtaaagagccctggagagaggggctggtggctggacaggctgccatctccctctctgcccccacctccacaaagcccagacccaggaccacctctggctgtactattcccattttacagatgcccagaaagatccagtgacttatctaaggtggggggttgaagggtcagatctcacctcctgcgacattttcctcatcctctgctgctctgctgccactgggccctctcttcttttatatgttgagcatattcatctctctctagccggatttgtttaagcaactccttcaactgcaagaatgggcacagaagttaggaagggctgtcactggtcctcagctgctcctggccacctggctcatcttccttccacatccctcccactgcaaaacctcacccatgtagtgtgtgcattcagcagtgcctgctcctgtatggaccactctaactaccactcgataactgctttactgcggctcaaggtctgaaggtgaagagtgagaagtttcgatctggagagcccaggccattccacacagtgccccttaaaaggcctgggctaggctcagtatacaactttgtcagtaaagatcaaggcctttccaagctcgtggtatggttttttaaaagaactcagtcaagttggaagggacagggaaagagattgaatttacagctggctaacagaggcccagagagatcagataatattgctttgtaattactgttattgctaccactgtttgaacatttatggagtgcttcaccagataccatgctggcaatcccatttaatccttgcaaccaccataggagacagttactatgattacctctattgtgtagatgaaaacacatggagtattcgaggttaagtgcttgcctaagatcacttaggcagagctgggatttgaacacccaggtctatgcaattctctaagcccatttttcttgctgggggtaggggcatagattggaaggggaaaattaatcttttgttcactttttgaatggatgatacattcgcatagtccaaaactcagaaggtacagaagggaagtatctcccagccaccctgttgctctctcctgagttttttatgaacccttgcacacatgttttatgtatattatcatagtacgtgcacacacacacactcatgtttcctctctctacagaaatggtaacatattaaaggtactcttctgtaccttcacagtagaagtacctaataccctatgtaggacttggccaacaccacagccaggtaagggcagggcaggcacttggcctccaagctctgcgtccagtgcttgctccccacagtggcccccaactcacccacagcagctgactcagccccaggctgctctaacaaccatacacaaaagcagcgggaaatggccatgctgcattctgggcaggacagtccatcctgcagaagggaactttaggctcactcctccatctaggaagccaagctgccaggggatggggcaagtggctgaactcacactgtcctccttcttctcctgtgtggtggtgacagcaaagagagcccgctctaactctgctatacgctgcaatgaatgttgcaggcgaatggccagacccttggactcatctgtaatgagagatttgagatgggacccaaaggactctccctaaagacatgtcaaagtgccaggcggaaaggtgacagggtgcccagattcctaccttcaaaatacttgagagaacgtttcgtatgatataggtccatatttagtttccctttctgtgtgttcaatctctggatttgaacctttgggagaaaagccaagcaagtgctgaaagagaaggaaagaaacattctctggaggacaggagggaactgcacaccctccactcacctctagctccctttcggctttctgtttctcattgtttgctttcttttcctatagaaagaggaagacagagctcttaccagggggaggcagagatggcacagcaagagacatgcccccagaatgccaccaatgccccaggacaggcccatctgtgggaccaggttatcagggaccctgtagagatggggtggaatctgaggggtgagccttctttcccaggctgggagtggacaagatgagactggggcctctacatctgagtgccccccaaacccagcagtcatgtcatgagcaaacacagaaatcacgttacttcttccagctgatgttccacttgtttcttctgttgctcctgtggggagagtcaaattaaggtgatggagggtggccccctcagctctattccccagaccaggaagtggtaggcagggaccaggaatggattttaaaggcaaagttctcagacccaatgggaacatgaactggtaaactctcttcaagctcccaaggacagaggatttgggtctttgttggctttcacctacagccacaaaactcaaagtcggaatctggaatctcttgagaggagagtaacataaacctctagagatggagtttgagaaaggcccctccttctgccagcttgtgatttagaaaagtgcgttcattcaataaatatttactgagcccgtacgggccaggtacggttcttcacagcagatatagggtggaaaaggactgacaggagcccttggccctgaggtttccattctagggggcctttaaatctcggactttcagagctgacagagacctttgatactcactacctcctctcaaaacacaagcccaaaaaggaaaggtggcttgtccagaatcaaagagcaaattagggactgagtcatggcagaaatacggggccgctgaaaaccagtcaggctagcacttccccgagaggcaacaaccccagggcgtgtgtagcaaggactcgagcaggggtgtctggagaggagagagtcggcaaagagggcagcaaaagaagagccatgctgcatgttctggggtccctccaggtgaggcctggatgccccagctccctatttgcccttggcaccaggggcccccagcccctttcttcagggccccaaggggaaacgagcccaggattggcagcgtggaattgggggaccccactggactcttaccaaagatttgatggtgttcttcagttgactgatttttacagacctggagtctgggactactgctggttcttggcatgggctctgaggcacatgcagcgaggaggaggtgcaggaggagtggagtaggggaagaggtagagagaacaatcattagggctgaggtgtgtgtggactgtctcaggaggcagaggggcacctagtccccgctgtgggaggaggttggagggctggcctgcagggtcactgcacctccgcccagagcctcttacctccagatccttcagggtagcagatgatgtagggccctccccatggacacctggtgctgactacaagagatgagagtgcacgtggagatgttctttcccccttagtgtctaagccctctgacttcctttcttccccatcaactggcaacattttcttttctgcctatcttggaccctttctcccaaaactcctttgtgccaacttctctcatggttcttatctccccaccatcccaccctggggccctttcagtgactcctgatggcaagtggctgttctcattgtcctggcttccccttgagactggggatgaggaaaatcaaacagcaatgaccatatcctgggtgtcctcagtgtttacagcaggccatgtactagggattaacataaaaacaacaataacaaatctcatttaaacttcacaaaaggaagtcaaacaataccacctctatcatacagatgtgaaaagagaggcccaaagagctcaagcaacttgccctagcagatggagaggcaggattcaaacccagaattcttaaccagtacctaacagtccatccacaatcctaacaattatcctctactgccccttgggtcccctgtccccaggagcctggccagccaagactcacatccccaggtgagtggccaccaccagaggtggctgtctcagggccactgccatttgttttcctgttcctctctgctcctgctggaacaccagggctgtttctctgccaatattcttttaactgtgggaaagaagagcagtaatactcatgagaactatcagccacatcctcctttataatttttacaaaatactcttatacaccatctgatttaatgacaccaacaactgtacaaggtgttgtcacaatcatttagtgactgagagggattgatatcatggctagaaaaaaaagaagaaaggaaggaagagacagagaaagaaaaagaaagaaaaagaaaaaaagaaagaagaaaagaaaagaaagaaggaaggaaggaaagaaagaataaagaaaagaaagaaagatagaaagaaagaaagagaaaaagaaagaaagaaagaaaaaggcaatactggaactttgaaactcagccttctgactccatgctctggggttttgccaagaattagcagctgccagagaccaaaaccagaggcagaggtagaaaagtaaacattaagtaggcaggaactgtatgccatgtggtttagagtcatacatcctcacacgtctgttagtgtgaagaagtgcaccagtacctctcaaacttttatatcaatgtgtcctcatggcagaaggcagcctttctgttaaatctgggaatttatcagaaagaggacagcccaaccctcatttaagagagaaatctggtatattcttagaaacctatgtgactgtcatccataagtacattaatgctttttctcatgatctcaggagaatcaagggaaactgatgcttcaggaagatgtcccacaattatcctgtggcactcaaagtaccccaggttgagataatatgaggaagattcaagctgtcatgttcattttaccaagatctattccacagaagatgagccaatctcacttcggagaccactgaatgaagggcagtctggtcccagaaccatggagaattagaatatgaggtggagaattcaggaaaaaaatgttaaaatctctctggaaagtagaagcctgggagaaaaaccaaacccaacccattcccccactgccaaccagagatactgtgaacattttatgctcatggggaaagtgtaggcttttcccactgtcaatgtctatgttaagagagtaaggcagcctgaaacctcttgctcctaggtcccatagtccattccccttccagctggaaatttgtgctgtgaccagaggaaccagaaatggggaaagaatgcttaggggctgggtcataagatcaaatgctggtcttgcagtaatgacagttcctaggcagactgtgacatcactacattccactcctcctggtggggtggagggaccacatcagcacgatgtctgagttgccgctctacaacaggggagggaaacacagggttgggacccaggtctttggagacaccagcgcaaagagcccagggaggtcgaccttgaggcagcaggaggggagggcacagtctgcagcagggagccccaggagtcaccagcccaaagtcacccagggatgactgacgagggtggggccaggggctgggggacccaggtccttggagatgcaagcccaaagagcccagggaggttgagcttggggcgtctggaggtgagggcccagtaatggagtggggatccccaggactcacccgcccaaagtcaacctggggcaattggtgagggcagggactgggctgcttgctgaaggagtggggctgactgacaagactttgttgggggaaccccagaggtgccacagttggggggcccagtccagtgtgcctcaggagtggtatggactctggcagtggtcttgtcgtcagaggggatctgtggttgggttggcgggccgtgatctggtgcgtttttacctttttctttgctgcggccaatttgctctgttgagtttcttctgccatcgcggggtggggagggaggtggggtggggagggaggcggggttggggccacgtgagcgaaatcccagggagcactgatgaacacctccacttgcctaccaggcagctgtgtgactgagccagaggaggtgtaaccagggccccaatagaatgcagaacaggggcgtggccttaatgctccaagcccattggtcagtgacaaagatgaaagggaaagggggcttggccaggcagcagtatgtccagagggccctgtggctcacaaggaaagctgcccatgcaactgctgtccccgcccactctaagagagtggagggaccacccactctgggacaggggaggggctggcttttgctttaaaagttttaaaactttaaaaaatgtatgtgtgcatactttatatatatgtgtgtctgtgtgtgtgtatctatgtgttcctccagagctgtcttcattatccagcttctatgcaaggtctatgattttggcctatatttttcaccttcaaacacagtacaaaaattaccagtattaccataaatgagataaagatcctataaaaatgaaaaattcatagcacgcttgatgattaatgaagcagactatattatccaacattccagtaagataaaataatcacaatagtttctcttttttggaaaaacgtttctcttattctcctatgttactgttaaaaagttttttcttaaacaagaaacatgtctaatatctgtaacaacataaagattttgggccagatgcggtggcttgcgcctgtaatcccagcactttgggagcctgaggcgggtggatcacctgaggtcaggagttcgagaccagcctggccaacatggtgaaaccccatctctactaaaaatacaaaaactagccaggcatggtagtgggtgcctgtaatcccagctgttcaggagctgaggcaggagaatcacttgaacctgggagacggagtttgcagtgagccaagctcacaccactgcagtccagcctgggtgacagagtgaaacttcatctcaaaagaaataaaataaaataaaatacaaaataaatttaaagagctttcaatttaataagcactcaaagctctttaccggtttaaaacaaatacaaggcccatttttctagaatcacctggcctttctaagccttgcaaatgaaactgaatttctcacttgatacttgcctgtgacttgcaatcatgaaaaccaagaattgtgttatgtcactgtgtactgcttgttacctgaaatccacactaggctgggatcaagggttgaatctttcagatttgctccataacctgtgtgcttcttatcccagaccaaaccaagtttttgtctagagttctgcaatttatagttagtagagaagagtaatgtagtctctggactagcagcaccagcagcacctgagaactctttataagtgcaaattcccaggccctaccctggacctggtgaatcagaaactctggagtagggatcagcaatctttgctgcagtaatccctccagctgtttaagaacctctgccatacagcaggtagaaaaatgtgtttccttctgtaggtccaaagccagggataccatatgttctgtcttgatacgaaacaatgacatccaattaaaacatataacacataactctccttcctactcccaccctccatccaatgtgttttatttttatgagttccataagaaaacaagtggcaatcagaggtttactctaaaaagtatgtttacaagtatcagttctcatccagcctgatctcatacaaaaccatttacatcctcttactgctaaagctttaaaaaagtatcttcacaatgtaagactcaggcacactaggagttctgtaataaaacaccaagtagaatggaatgtccaaacttactagagaagaaaagtggaatcattggctgtattttcaaattgcattcaaaggaaatttaagttctgaatttgttcaccttcatacttccaagttaatagaattcaaccagaacactccattccttcaaagcctctagcctggcaaagttttactgtattacttcttactttcaatggatataaagcagagtcctggtaggcacattttgtatacctgcaaagatgcagaactaaacagttccatctcttccatattaaaacaaaagtcctgtaaaccttgggtgttgagtgtaatacttcagcactagcaccaaagcctcaaataagaaaagataccaagaacaccactagtgaacaaaactaaactctcggctgggagcagtagttcgcacctgtaatcccagcactttgacaagccaaggtgggaggattacttgaagtcaggagttcaagacaagcctaggcagcatagcgaattcacatatccacagaaaattttaaaaaatagctaggtgtggtggcgcacatctgtagtcctagctactcggcaggctgaggtgggaaaattgcttctgcccaggaatttgaggctgcagtagctaagactatggcactgcactccagcctgggtgacagagcaagacctagataattacattatctcctgctcctgtttacattaaaatcaccaagttaaaatgctttgaaatttgacaggataaaaattaagtgaaatgtgactctggagtttggagagagaaagaaagaaggaaggaaggaaggaagaaaggaaggaaggaagggagggagggagggaaggagggagggaaggagggagggagggaaagaaagaaggaaggaaggaagaagggagggaagggagggagggagggaaagaaagaaggaaggaaggacaaaaggaaaaggaaaaaggaaaggaagaaggaaggaaggaaaaggaaagaaaggaaggaaacgaaggaaaggaaggaaacaaagaaaaaagaaaagaaaggaaaggaaaaaaaggaaaggaaaggaaaaaaaggaaaggaaaggaaatgaattaatatacatccaaccattaaaaatgatgacgccagaaaatactgccacagaaatatgcccaaaatatagtaagtgacaaaaggctatctattaagattctactttttaaaatgtttacatgcataaaaaagtataaaaagcaacaaaccagaatgttttgagcggcagagatttttctaatatttgtcatccaaattattataatcagggagaagtgttttcatttatttatatttaaatctcttttctttttcttattttttctcccatatgtatcccatgtaggctagaatccccgcctcttgagggaaaccagcccatttttggaaagtgccctacataaagctgcccatcttcctttgaagagatctggagacatttttgtttcaaattgttttattgttctcagtatatatatgtttttaatatatgaaattgaggaaaagagaaaggaaaggctgactccctaccaccctcttggggctactcttccaatttttgctgctattattatgtattaatattcactgggtactaagaagatgggcaaccccttagatccttttttcttatctctttctcataatcctacttcattccttcattcacttatttttaaaagggtcatatgtacaaatatatagtccagaaaaattttaaatataactatctataaaagtatgtgacaaaatcccattcacagtcttattctccttccacagccacttttaattcatttcttgtatatcatttcagaatttatctttgcaaatacacatgtatattcttattctacccttctctctcaacacaaaaagtagcataccacacatacgataccattccttctcccttttaaaaaaacacacagaatacatccaagttctaggtgagtacagagtctttctcattcttcttttcagctacacagtatgcatcatttggatgtacctcagtttacttaaccaattcccttttggcagacactgaaatcatccctatcatactattacaggcaataatgccaagcataaccacctacacacaccaagttcattgctgaatctgcctttgatgaagcctctgtttgaatcaccataacgtcacaaggctgaaaagttagccccttttttagttttcattatgtacagcagtatgtagcaaaagactccctcgggcaaaggaaatgtactctttggggatttacttcataacaataaatggataaacagaacaccaaggagaactgtttatatttaaccatgaacatgtatgtatacaatacatgcatacgcatagaaagtataaaataaataaattcatcaaagcattaagcattgtctcagtatggtggatctagggagtgctttgtagaccgccctctttgcctatcctttctaatttcacaacggtaaatacgtatacttttgcaatataaaatttcaaaaaatgttaactcaaattaagctgcatgtagcccttcggtctgtcctacatttgtatgatgctccagagtgctcaaataacacttcataaaaaaatttatttcttcaaaaacttacttttgtgaagatttctgtgaatgtctatgtgttagatattcactatgtgaacatcaaagtgaagaagctcaggcatttgcatgcttgactcataaggagactcgaaatgtggagctggagggtgaaataagggctcacctgttcccagacttgccacaataggtggttctgtttttacagaaagtgagtgatgcagaaatattttgacagctcatttgttcaatcattgtgttcctttggacttagattccagataattgggaccctcttagctggtggctagcatgaatgaagtattgttgtaaaaatgcgaacgaaggtacatatatgaatggaagcgtattttgcccagaaaccatcggtttgggattctgaaagatcaggaatgaaatgctaggcccataacttcctccagtgtgatcttggacatattactccttctgtatttattttagatttttcaaccttaaaatgagtacaataatatcatcttaatctttcctttcacttctatccgcttctctttctaggaatatttattggaagtttgttctctttccacttggctggctgctttaagatacaagttgagtaaaaccagtgctactcctggtctgctgggaatttcaggctagtaaggttgttatgaagattaaataagataacataagtaagttagttcatgtgcagtgtttcaataagtattgagaccctttcttcttctgaaaggtttatgaatctcttagggcattctattcagaagatccaaatacctcttgccagttgcccaaatagaacaacttgttcagagcctaggagagcagggtcaatagatgaatactttacaacacctaagaagtttaacagacacttaattctggtctttaaatgactttattttgttgcttatttgtagatgactatatagagtgacaaaaaagtggaatacactatccgagctataataagatagatcttgtaagtgtaagcattttagacatcaactcagtataaattttgacttgaatggaaatgttatgtctgagggttcccagttttgctaatgacacacttaattgacaatataattgtgacactgaagagtgtgaaattaaaatcttaagaagtatgcaaactaatagcatgattctctgtgtgaacaaagcggtttaactgaatagtaccttatttatgattggcttttcatacctagataattctgtctggtatctaatggaaaaactgatctaaaaatgattaacgaccatttgccactttaataaaaattgtcaaaaacagatattgatgatatttctaaaaattattaaggggaatagagcagcatttcacaactagattccaaggattgtggtctggacagcacaaaccacatattttcatccattgtctagatctttattaggtctaatgcatttataatatttttgcaagcttatatttttaattattgctagtacctcaatgcccaatacagatgatacaactaaccagtaaccaataagatacagactttgagttttgtgtttcaggagttatgggttgcagtgtttttatttatactcggtgacactgtttctcttcagctccagtgtagtgattgaagccttctaccaggcagaggactaggtgactaagtatgtatggcatgggccgcagaatagacaagacttagtcctgtgcttttggactaatggtctggtgtgctgaccaaataagcatttcaacacaagtgattctcatcagtatcatgatgtgttctcttaacagattgagaattttatttttcaaataggaaatggctaatttattttaaactatgtatcatattatactttcaaattccaaacagtatcttaaaatgatatgaataattaagtttataatttagctttaaaaagctatgtaaattttatattgacactgatgggatagaaatctacattggaacttttaattcctttatgtttttatagtgtcatcataatacaataaaattactgctctattgcattggaagtatatgctcattaaggaaatggccaggaaaaaaatattcacgtactcagggaaattttaacatgagatattttgccttagtgtgtatatcacttgaacttcctttgaactctgtgcactacttgctatttatgacaaagaaagccattgctcacaaagtattgggtttgcctttgaagcggtatcaggagatcattgacaaaaggcagggctgagattagatgttgagggttattgccttgctatagtcccaaagctatgtgaaatgtcagctaattgaaaatggtaattattctaaataacagcataaactgtttctttctaggatatgtgttgctttcaaattaatagccattgatctgtgttttttttttttttttttttttttcaccatccttctctgtccttttgtcaaattatctagccatcggtccttgggacaaaacccgttgcaccatttatattgaccatggtttaatgagtgacctggtcttcctgtttgcatagattgtaataggcccacccacctgagagtctgtcagccagactgagatgtgtaacctctatgtataacttagtttctaagtggaaagactttaaaatggaaaccaagtaattgtgttacagtggccatttgcatttatttcagatactggtcgggagaagtcctattaatcacagtcataatagatcttcaaattatgacctactgagcaaggtcatcctgtatgagatgaataatatatattcaaaatgttcagcttgcttctaatgggcagtactttgtaccaaatggttttgagggaaatacgtacagtataatttttcagacaaagaattaaaattcctagttgtgatggttaaaaaaaaaaccctctaaagtagaaattagaaatacatattctccatagctataaaatgagccacaagtacactttgattctgtaaaattgagttactttggaaaatatttcagagtaacctaatcccaaatcaaggctctctattggaattggtagacaacccaaaaatacttgggcttgatctgtttcaacaaagtgaagaagacaggaagagtatgagaaattattcaaatatattcagaaaaaatatctgctgaggttggaaaactaatatacagtgattacagaaaagttatactccatccgtagatcaagccttgccacaaaatcataaaaccaattttctttttgagtgtgaaggaaatgagtacctgtctttctaattgtagtaaaaatagtaccattagtgcttcctctaactttttttttttttgagatggagtctcgctctgtcacccaggctggagtgcagtgtcacgatctcggctcactgcaagctctgcctcctgagttcatgcctttctcctgcctcagcctcccgagtagctgggactacaggtgcctgccactgcgcccggctaattttttgtgtttttagtaaagacggggtttcactgtgttagccaggatggtctcaatctcctgacctcgtgatctgcccgcctcagcctcccaaagtgctaggattacaggtgtgagccaccatgccaggccaactttacttttaactagtaaattgtaaccaggaagtatactcacaaactgtggagcaaggacacaggaacaaatgtagcattgaaaataaacagtagaagatagtgaatctgacacatttaataatgagcaaatgctgttgtgttccacaatatttaggcacacctatgcaaaaaatcacttcaggaaaccacggctttacatcttaggaagcaaaagtggagggaaagggttggcagtgaagaacaacttgtacacatgccttgttaaagcaattccacataatcttattccatttcaaaccaagactgtttagaatcttacgtcctgttgccacaagaactgagctcaatactttagaatcctaagcccaatatctgagagtggtgaaggcatttttggaagaacccaggcatgtatctgtaggaccttagtaaacctcctgttttgcataattctctcctgcctccccagtctgtctgagggctatgctttcttcttccctctcccaagtgaaggtaattgactgatgcttaattgttatttctttctaaaattgataacataaaatgagggcattaggtttcttccttgaaaatcttctgtttttataataaaagtagctgtagccaaaacctgccccatgtaaaaaagtatctgctaacaattacagaaattgtcatatgcatctgttttttgaactcagtgaagtcccagaaatctttttagtgctctgataccttgtaataaaggacctctagaggttactgaaatgaaagcatgcagagttactgtagcggtatgttgttacaggggaaaagaaaaccagcagccattcactgtacagcctacactgctgtaaccggtgttgcccagtaaactatctggcatgcaaaatgctaagtattcaaagtacctggcattcatgatcattgtgatagcaaactgttgacatttggtttatttcccaaagccggaccattcgtacttctcttaaatattttggctttagagctttgttgttgatacagataatgtatctccttgttgccctgtttcccttcttgctgccctgcatttagctgcaatttgctttaatggagtcatccccatgatcatggagaaattgttcagtattttgatgtttagctttcatctcattttggatcgtttatcttgataattaacattattgcatgaagacccagttgagaaaaaatattctgtaggaaattcattctttaatagttaatataagccttcacatgctgagtgtcaaaacctgcaattcctcttgatccttaaaaggcttgtaaataaagacagttcagttgaagaaactatactgttaaagtcaaatatttttggaaatcagctttgagtcttggggatttagaaatttacgtaaatgatctgactctcagcaagctctaaataaacaataactatttgatggggtaattgaaagagagcctcccatcaagtgatcactatctgcaaaagtgataattcactaaaaacttatgcctcactttgtaataacaatatcacagtgggaatttttaatcaataaactggaatataatcagattggggaatatgtaaatctatatcagtccagtgaaacctaccagcagggagagaaaagataaaaatgtaaaaatcagattgaattttgggggaaagcttaaaagaaatgcagttatgcctcggctgccatactcagcatgggacataaagagccccaccacagggcttgaatttacaggagtctgtccagcacagctttatccgacactgaagcttcctaacaaacagaaagaaatcttacactcttgcttgttagtatttaatacatgcattatgtgctttttaattttttggtcctactaaggagtagctgatagcgctgttttgaaggcatatctactgtgcctctgactagcaataggaaaccggttaagttattcaacctctctacatttcagtttcaggaaatgaagtggacaaagaagatcatcattaggcaatatgtacctccaatattctgtattatgtggagatatcaagtccgtatgtgattacacaaatcatagtccaaaagagttcagaatgagacatatagaattgaaagtcctatttatacagatactggttaaagcccagggattagatgggtttaaaatgctttaccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggcgaaagagcaagactccgtctcaaaaaaaaaaaaaaaaaaaaaaaaaatgctttacctctatatagaaaggagtacaggaccaggaaagggcccaggggcataccatgattgagccgaggagacagtaagagagtttcagtgacaaaggagatgcaaggagacgatggggtttctgaaaccaggagaagaaagccttcatcatagaagcaagtgataaacttcactgaacacttctaagacatttcggacaagaatagaagagcgacctttggatttcactgcacgtagcttaacaaacgttcataaaggcagtgaaaacggaagctcggttagggtggtcttaggagagaatccaggtgatgacgtagagaatgcgactatagatggctctctctagaagttttacttttaagggtagcagagaactagagtagagctgcagacatagttccccctcctccctctcctccatctccagtttcttcttctttccatgagtgtaacagaatgaaatttagggcataatcctgtagaaggtaagaaattaacgatgcaggaaagagattggataattgtccaaaataaataagttctcagatgatgcaaggcagtgggctctagcacacaaaggggctgacatctgataggaatttagttgttttatccacataacagttattttttcagagaaaaatcgaattgtgaaaatatagctgaaaaccaaacattacccctatgtgtgtggtaacttgtgatgtaaaatgcatttctcaataaaggtcctggtcataaattttaaaagtaaaataccttgagggagctacagttagaggacagcaggatgaaggataatcatcagaaagaatacaaagtgggccaggcatggtggttcatgcctgtaaacccagagctttaggaggtgttgttgggaggatcacctgagatcaggagtttgagaccagcctgggcaacccagacccccatctctacaaaaataataattaaaaaaagactacagagtagaaaaagcagagtgaaacagaatcttcaatacaaacagtagggggattttagcaaagagtagctgacttagatggtgctaagatttgtatggagttcagtgctgagaagtctttttaacaagtgatttaaatgggaatattgccttgtttacatagctcaaataaaatgcagtataatgtgcagaaaacaaaaaaaaacagtaaaaagcttaaataatctttattcttaggacaatgtttttcaaataaggattatggctcactatttggtcataacataaaatacatttcttattgtggatggctccaagaaaaagaaaacccaagtttaagaaggctcaccaatagagagtttacctatgtcatataagaagtcccagttatacatccactagtaatagctccatggccaggtacatgctagtatttgcattttggaacggtttttctctcccgtttgttgtctcttggtcacaagatgacagattatcccaggcctcacgtttacattcgaagactaaaaaccactgtggtgagtaggaaatgcccctccccagagatgactcccaagccctcattcccagacctgtgactgtgttgccttacattgcagatgtactccgcagatgtgattaaattcaggagctcgacatgaagggattaacctgtcttatctgggtgagttcaatggaatcataagagtcgagtgagccaggagattcagatagggaggggtgaccatggaagcagaataatgtggagtgagaaagactattcatgggcttatgaagttaactgagcagaatgtagggttttcaggatattggcaatgagaaaatgatagcggtgagtgaaatcatctggatgttccaggggagaacctgaatagttttctttgcagttggtcagctgttcattttactcagaaactgagacattatgctacctttttgcacatccctcccctgcctttcttgttcaacagatggccgcctgtactaatgctttcaggaatgtgaggttactggacacgaaagccatcagctcctccaaactcatatatatatatatatatatgctatctatctatctatctatctatctatctatctatctatctatcatctatagctcactgaaacctttgcctcccttttcaagcaactctcctgcttcagcttcctgggtaactgagattacaggtgtgcaccatcacgcccagctattttttgtatttttttgtagagacatcatgttggccaggctggtctcaaactcctgacctcaagtgatcctcccaccttggcttcccaaagtactgggattacaggcatgagccaccttgcctggcctccattatatttttaatccttcccacccccacaaatcctcttgcactttgtcagtcatttgtctctcctgagtctttaatgtctctcgttctaatgatgctttccccttagatcaagtcatactcaacattctctgtctgtctccctttctaaatctactgtgcttaacccttaaatgcaaagtgttcccagattttcatcttatctaaactctctcttcacactttaattaggtgatcttttctctcacctacaactctcaaatctgtatctccagctctgacaatacccatgaatcccaggtatgtatacctgactgcctgctggatagtcacctgaagttaaaaaaaaagaatatttataattgaaattattcccactcttctttcatcccacccaaaacatgtgcattttctttgttccttctctctaggaccatctccactctgcagccgacaactgaagccagacattagggcaccatggttaactctcattagctggaaacattattgttatttgtttagcataacttaaatatgatgtattttatatatttaaaaatataatttgtgaccccacatagggtcctgaagttgatgcagatgcttgaggtattgtattgcatatgtttattttcagctgacttagtcactggaggcagatgtgtgaaggaagtctccttcagtgactcatcagagaaactcaaaatgagttgccaggaataaaacagcataattttaaaggaattctctgcttagacattgtgcatctgtcaaactcagactggataaattaattacgctctgataggatagccccagagagccagcctttcaagatctattcttctctataatcaatatagtaatttaacatttgaacctgcctccaagcaaaagggcatacaaccaactgtgaaaagtctttgtattctactcagaattctttgttggtaatgggaaattatttttagttaaaaaatcaaaaattaaaaagaaaaattattattatggctactattcttttcaagttgaacataaaagttgagatcagcctgtaaacttctacgttcaggcaaagaacacaaaaattgatgaagataaaaaatgtggttggtttattgggaataatagtcatttttaattaaagaaaataaaatattaaaagtaaatataccaagcaagaattatagaattaatgttatcaaaatgacatgaatggtctcatatactaggcaatacctccgcctcccaggttcaagtgatttttgtgcctcagcctcccatgtagttgggactacaggtgcaagccaccaatgtctggttaatttttgtatttttagtagaagcggggtttcgccatgtttgccagactgatcttgaactcctgacctcaaataatccacctgccttggattcccaaagtgctgggattacagacgtgagccactgtgcccggattgggggtgggaaaccccagcctccctctgtgctctttgataacaagctggtctgtgatttttgagcatatcttctctcattagtccaaggcacacatggttatccaggaaacctcatctccctttgcaaaccacagccctcccatgcacaaactgctagtaaacacctgagcatgctatgctacttcagatttttgcatttctgcatatgcagctttgtctaccacagctcaaagccaagctatcattcagctgtcacctctttggtaaagcctctttacattttccagtcatattttattactttgtcttttatgtggacctttcaatactatacttatcactctatttaaaaatatttctttacctttctctcatctgcactgtgaattctttgagggatagtccatgactcttcttcctcgtcttccttcttcttttttatgatcatcttctatataatagaacttggtatattacaattccaattagtgtttgtagaagtgatttgaaccctggtcatctcctccttttccctaccatcttactcaataacgtataacattaaaaaattttgtcaagagaattaattagacactgcaaagggcataactgaaacagaaaatataccccaaacctagaaatgcaaatcaaaaccatgtggaccaagcaaataaatgtgatacctccttattcctgcaagaatggccataatcaaaacattaaaaaaaccagatgttggtgtggatgtgttgatcagggagcacttatacactgctggtgggcatgtaaactagtacagccactatgaaaatcagtgtggagattccttaaagagctaaatgtagaactaccatttgatccagcaattccactactgggcacatagagataaaggtgtcattatatgagaaagatacttgtacatgcatgtttatagcagcataattcgtaatggcaaaatcatggaatcaacccaaatgcccatcaacaacaagtggataaagaaactgtggtatatatatgtgatggaatactactcagctataaaaagtattgaattaatggcatttgcagtgacctggatgagactgggaactattattttaagtgaagtaaactcgggaatggaaaaccaaacatcatatgttctcactgatatgtgggagctacgctatgaggatgcaaaggcgtaagaataatacagtgaactcgggaacttgggggaaaggatgggagaggggcgagggataaaaatctacaaatagggtgcagtgtatactgcccgggtgatgggtgcaccaaaatctcacaaatcaccactaaagaacttactcatgtaaccagataccacctgtaccccaataacatctggaaaaaaaaaaaagaaatcataagctgaacttgtggcagcctgacaaacttgcctaaaccagttcatacaaaacttgatacactgcttcttgattctataccattagacatgtccgaagtactccaacaaaagcttaaagaaaaaaacactaagcttcaagcacagctctttctggtgtatataaaacgcttcctccttagctagtatatttaaccagtagggcttctctcctcctttcggctaccatttattaagtgctgtgtgccaggcactatctaatgtatacataaaaattatatggagcaggcattgttatgccctcatttagaaaagaaaatctggagaggtaaaacgatttcctatcattttgcctaaagtttccctgttgcatcttttaggtgctgtgtagagtatgatccgagacacagtcatccttgtgctaaggtcagcctgtttgcagcagcaaaacccagatctgtggtgatgtcaactgcatgaatcctgccattgggtaattttaaagaccttgtgtaacttcgaagaccttgcgtactactcctaatgtgaggatgaagttattctgttccaactccagtgctagaatcataatgttgcttcttatggaaagtacaatttaagaactgtgtcttaggttaaataaacagaatctaggatacctttatagactatctatgataggttactgggtgagcttttattttttaactgtctggagatggggtagggaacagaaacagagatagggatgattggcagggaccttggggaagagacagtgatttggcagccttgtatggaaacgtcctcttgtattatgcctcagtttttgttatgccttatgtattcccagatttccaaaggagcttaaaacttctctatactcctctacaaccatttttgatggtgagattttctttagtatccatttccaagtgaagtgcttatcacaattaactatcaaataaactatttgggcagagctttctgctttcctcaagttacccctagggaatggccaggggaactaacagtaaccaaatatctactatacttcagggccttcatatgtattctcattaaaaacacataaaacctatgaggtaggttttgctatccctgcttcataaatgagaaagcctcagcctagaagtcacacacctagaaagtgattgatttggggttcaaaccaaattctgtcagtttcttagtcacagcttcttgttgcaagtaacagatatgagaagaggagacatcttcacacagaagtatttggtggaattctagagcagaaccaccaggaactgcaccatgaatgggagaaggagaaggaactaaacccactatttcttccaatgctcgaggtcgcgggcctctcatttgtatttctttctgtgtcccatccctgtagctacatcactttagtttaagggaccagcagaatctgaccagcatttatgaaccccaaatttcaaatttccaggagggagaatatgattggttaggtgaaggcaggatccccaggatgcagggccctttctgtggttgagttatagatctcatcctctgccacctcttcaggacttttgctctttcagttactccctccccctgctatatttttaaaccatcctttcttttggtttgtttatatcagtattcaaacatggccacatctcttctaagcttgaaaacataaaacaaataaatataatctctttcttgaatccactttacttctaacgacagattaatctctgtattagtttccaaaggctgtcatatcaaattagtacgaatgtgatgacttaaaaatatgtcgatgcccagtgccatcagcagtggattggctaaagaaaatgtggtacatgtacactgtgggatactatgaagccatgaaggacaaaatcatgttctttgcagcaacatggatgcagctggaagccattatcctaagtgaatgactgcagaaacagaaaaccaaataccacatgttctcacttgtgagtgggagctaaacattgtgtacacatggttataaaaatgggaacaataaagttgggtgaggtagctcatgactgtaatcctggcactttcagaggccaaggcagggggaggtcaagaattcgagaccagcctggccaacatggtgaaacccttctttactaaaaatacaaaaattagccaggcctagtggtacacacctgtaaccccagctactcaggaggcagaggcaggaaaattgcttgaacccgggaggcagaggttcagtaacccgagattgcaccattgcactacagcctgggtgacagagtgagtctctgtcacacacacacacacacacacacacacacacacacaatagccactgaagaatgcaagagtggggatggagagaacagggtgagggctgaaaaaaactattgggtagatgcttacctcctgggtgatggattcctttatactccaaacctcagcaccatgcaatatacctgtgtaacaaactgcacatgtacccccttattttaaagtaaaagttgaaaaaagcagcacagaagataatatagtcaggcaacatatggaaaaatgtatatgaaattttagttactatttgtaaacagcaacaaaaaaaggatatcagcaaaccataaaaaagaaaacaaaagttgatgaattcagcatacattttggaagaatagacaagctttctgtgaatttgctttggttacaatagaatcctctcttattaagtgagccaattggcaagtgaactaattgggaaataagctttttctgaaaccctaatgacttcttatggccgcaattaataaacatagatgccatatgtaatagcagacactaaccatgcatctgtgctgtataaggcaccagtaggtggaatacgcaagatctaaaatcagcagatattggtatgctttcttcatgggcattcaaattaagagatttgtaagtaaaaccttcctcatattggcaaattcattttgtagatgtaacccttggctagtaaagataatagtatttggagtaagtaaaatatttatcttggcattcaatattttaataaatgacatcacatgctaatcaacagatgcacactggaataataacatcacacgccaatcaacagacgcacactggaatcaagttaaaataataaaattaagacaatcaaaacaccaggctgcaagacctgctgaatacaaatgtgtcacacttacacaatattcttcccagtctcatttctctgccctgcttgataagcagaattttaatcttttctgggattcttcttcccaactgttctctctagagtattaggatgggagccactctgtggcacacagctatctgcttgagccactgttcatctctcctgaattgcttatctctgcatagcctgcatgccactgcctgaaactgtaggaatctggggactgtgtggggaggggtagagaggctgtgttagagtgtgttcatgtacatccctgctcagttgctgcccatgcagtcaccaggacttgctgctttgtctggtctattctgctagatatcttttgcttttgtaatgattttatttgagatgcatcggactgccctcctttggacaactcaagttcatcaaatcattctgtatatgtttgatctcatttgttgatggtgaaaagtttctttccacagggcctctagacttctttcaagtaatgtgactgtgcctctacctcagtgttcttgaaccttctttgacaagtaggaggctggactgtccttggtggtgaagactctagaaggtcatgtgacttaactgaagttttgtatcgggatataaactcattaagaaaataactataaaaattacttattacaaatctgttgaatctaagacaaaagcaggagtgggagagagctgatgttcctttgagttagtgaaagttggagtaacagcaccttagagccctggataggatgtgtatcacgtgcctatataaaaaatatttctaaatgaaacttagtcaatcgatacaactgagaattgttagctatggagtatttagctgattgaaaatcatggctacaatattttgtagctcctcctgcgaagaggtggagtctatttccccaccttcaatctggcctggcgttatgcttgctttgatgaaggaaatatgacaaaatgtatgttgcatgagttccagaacttaggcataagttgctttgtagcttctctctttgcccacccactcatagcatcctccaccaccatgtaaggaagcttgggcaagactaatgaatgataaaagaccctgtgagagagaggcccagtctatagcccgcattaggcttcagacaggtgagtaaggccatcatagaccctccaaccccagtcaagctgccagataactaacgtctcatgagaaagcccaggcgagaccagcagaagaactgcccagctgagcttagcctgaattgcagacacatgagcaagtaaaatgttattgatttaagctactttgttgtgcagcaatagataagtgatatagtatactctgtataattagaatttatcagtggccctttcactgactctctgcatatttttgatgtaaagaaataaaacataaccagaggttttctgttttgttgattttgttttataaataaaaaaaacttaatctatgagaggttaaatccattactgattttctctatttcagctgcactagcattttgagtccatcctcgtgtgctgcttttataacaccttattcatctccccatatcacacacacaattaagaactaaccaaatgttgactacacaactgtacctattattacctgtaatttagttatccttcctagtggggcatggatcacattttagatgccacattggaggcctctttcccttcctctctccctccctccctccccccacttccttccttccttccttccttccttccttccttccttccttccctccttccgcaatggtaaacttgatttcaccctttgtaaagtatatattttccttcttacggagtttcttccctcataaataaggaaaacaagcaggtaaaaagataaaacaggagggcgcgatggctcacgcctgtaatcccagcactttgggaggcggaagcgggtggatcacgaggtcaggagatcgagaccatcctggctaacacggtgaaaccccgtctctactaaaaacacaaaaaattagccgggcgtggcaggcacctgtagtcccacctgctcaggaggctgaggcaggagaatggtgtgaacctgggaggcggagcttgcagtgagccgagatcgtgccaccgcactccagcctgagcgaaagggcagactccgtgtcaaaaaaaaaaaaaaaaaattctgtaatttttatacacaaaaggtccctagtttctcctcttccttcccttcaagtgacccattgccagctttcccctttaattgctgtggccaaggttccgtggatggcacagaatgaattcccttggccaaatgtactcaggatggcaatcccaggtctctatagcaacatttcagtaactgttctgtgctgctaattagctccctttccccctgtggaggtattacacatgactttttatgccaagtgatgatcataacatcagggagctctgcattttgtgatcctctatttcaacactggtccaggtaggttaaatggaaagaaactgtctttgatggagatcagaactttaaatggaaacacacaggacagtgagagggagaatttaatcaaccaggagtcatgaattatctgctattcaacacgaaaattgcagcagattaactaacaactgaaatatagaaggcagcagaatgagtagagtcaagtcatgatttcatgttcaatattggaaaggttattccagtgacatttgcacagacgtgttgcgtgtgggtctccaggcagagaataaagtcggagtggaaaatttgagtccagtgcaagtaaaatgtgaggaattttagacaatgctaaacaaactagttttggtatgttacggtttcctgggccacagacagcacacaaagatcatcacaaaagaagaaacatgatgtagtggaaataacctgtacagaggaaaccaaaagtcaaacatattctggatttgccaccaacttgttctggagctttagccgagtcatttaccctctttgtaccttggttttcttaaccctaaaatgaaagaattttacaatcgttagcaaagtttcattcaggtcataacaacagacttctataaggcttgctgtattgttgatggcagtaggaacagtaatttggggagcatgcaactccagtgtccattcctgtccctctttttcatattttaagtggtgtcctgagccctttctacccatctttatcggagtgacttcaaacaatgatctacatttaaaaaaccttagaattatcatcctcatttggattggtgataagctcacatgactttaattcatttcccatttctgttgggcagcacagggctgagcaacctgagcagaggacagagtgagttgatcagtagatgatctctggagtatctttttttgttacattctaggcttaatagtaggagtgtgggagaggtctgtgctctgtgttaaacacaatcatgagcttcagaacactgcaaaggcacactgggattgagttgcttatcaccactgataatcttttttccttttgtaagagtgagctaagtggagagcttaattctgtcttcatggaaaagatcagatttaaacaactattctgccctgcttaaaaaagtgttcagtggggactaatacaaagtgtggtacataaagaccttaagttttaaatagagatagaacatgaaagactggctggaaggcagtagtaccaacaatgagtggacaaacctgttttccaaatttttagcaacactaggaataatctaatataaatctttgctaaccttatatataaaaataaagtgttattttaaagataaaacaaaagtcttgtgtaaaaattaaaacagttttaggagtaagtggaaattggagacattgatagagtaactttcagcttctagggagcaatttagaatttaatcattcacttaaataaattgcttcagtaggaaggttgctgatgataatcagtgtgaaaggaacttaagttattccaagctgagttgccctttatgaatgtaaatgccatttatactattatcatgcaaaagtctaaaaaggataatttgaagacatgttgaagaaacatgatttacaatgaccagaaattcaatagtgttctttgttagatcactcttagaacactattaacactattagtataaaggtttttggtttggttaccacagtataaacaagatttatttccacttagtgtatataaaggtaagggtatcaaagaggacttcatggagaaaggaattagacagagtgggtactgaagaaaatgggaagaattagagagatgtaatgatgacaaaggcatgtaggctgagtgaagaatgtggagtgaagacatgagctgaagtgtgtgtgtgtgtctgtgtgtgtgtataaaacaaaggtatccattcaagtaagtaaaggagttcttattctgtgcaacgtattttctggtgacaaaatttacaatagaggaatatgagttgctttgtgactgaaattgtctctaaaggcatatattagcccttgtctagttttctgacaacatatgaattgctcatgattttgccaacatcaatgctttttgtcctaaatcaaagtttctccttactctcctctttcagttagcatgagagttgtcacagccgacagaggcaatggatgaagccaatcactctgtggtctctgagtttgtgttcctgggactctctgactcgcggaagatccagctcctcctcttcctctttttctcagtgttctatgtgtcaagcctgatgggaaatctcctcattgtgctaactgtgacctctgaccctcgtttacagtcccccatgtacttcctgctggccaacctttccatcatcaatttggtattttgttcctccacagctcccaagatgatttatgaccttttcaggaagcacaagaccatctcttttgggggctgtgtagttcagatcttctttatccatgcagttgggggaactgagatggtgctgctcatagccatggcttttgaccgatatgtggccatatgtaagcctctccactacctgaccatcatgaacccacaaaggtgcattttgtttttagtcatttcctggattataggtattattcactcagtgattcagttggcttttgttgtagacctgctgttctgtggccctaatgaattagatagtttcttttgtgatcttcctcgatttatcaaactggcttgcatagagacctacacattgggattcatggttactgccaatagtggatttatttctctggcttcttttttaattctcataatctcttacatctttattttggtgactgttcagaaaaaatcttcaggtggtatattcaaggctttctctatgctgtcagctcatgtcattgtggtggttttggtctttgggccattaatctttttctatatttttccatttcccacatcacatcttgataaattccttgccatctttgatgcagttatcactcccgttttgaatccagtcatctatacttttagaaataaagagatgatggtggcaatgagaagacgatgctctcagtttgtgaattacagtaaaatcttttaaatatattgagaatatacaaaaaggcaaattatactagaatttcagacagatatgtgttaagtaagctatgttaaatttaaccagaatatcactttctactagtatgtattgtgttgtcttttttttcttcccaaattgaattgtggtatcaatctcttgcttatataggagatttaaagattaaacagtgtggctactttatttcaccaacattattacctatatataatgtcaaatagaattactctaaatgttaaacaatccattttgaatgtcggtgtgtggtttattgcccattttctattttttccatttaaggtagattatcttgctttaaagataaaggttaatttttactagacttactgatttgtcttactatgtagctaagttttttttttattttttcagctcattatctgttagctatttatttgtttatcttttttcaaagtccataaagagaaactacacttttttttttaaagaggaattttggtataaagaattaactaagtattaaattgtgttaaataaattttgtgggagctactgttttgggctagcctcctgtattaggccccagccaaccaggtgatatagtttggctctgtgtccccacccaaatctcatcttgaattataatactcatgtgtcaagggaagaacctgaggggaggtgattgggttatgggaacaacatggtttccccccgttgttctcgtgatagtgagtgagtctcacgagatctgatggttttataagctactggcatttcccctgcttgcactcactccttcccgccgccttatgaagaagatgcctgctcctctttgccttctaccgtgtttataagtttcctgaggcctctccagccatgcagaactgtgagtcaattaaatctctttccgttataaattaccaagtcatgggtatttctttatagcagtgtagaatgaactaatacagcaggcaaaccagaacagagtcatttgtgctaggtgccacgtaatcagactgaacttcaaaattagccattttcaaccaccccccaaccccccccccccaaaaaaaacccacattacagtcaggctgagtcactataatacaaaagtcccttctgtttaaagtatctttgaaaaggccaatccattttttgtctctgattctgctgtcttcagcctttttctgcctacaaagccaagctcttctgctcagctcattgagaacgtttattctatttgatagaacgaggtattgcccaattctagaatcactaataaaagccaattgatctttaaaattgtaacttcataattttgacagttgttaactagttatttgaaaaaagtgaactttaatataaaaatgtagcatttgtaggaagtagctttcacccctagaaagggggagataaaggaaagaggttagaactactaggacttaaataaataaaacaccccaaactcttaaagcttggaggaagaacctgtggaggtgaaactcaaatatctcagcagaggcggttgctgcctggctggtgctagtgtctctgagcttagaggaggccctctgtgtcataacacccctgaggaagaggcaccgctggctggtgcaggtgttcctgaggagggtgtgaagagcagagctcctctagcatcggaaaaactaactggattcagctgctgctttggaaaacaaccaaggttgctgaggtgatgagtgtggttgggtgatgctgacaggcacagcaggcagagaggaggcaaacaggaagaagaaagtccctttttctatctccagccttgcaacttccctctagtatccctaatggtgaatccaagcaaggagaagctgaaaagaaaaaagagaaagttggcagagccccagctcctgcatcatacagagtgtagacagacatgttggcactgaaagtacatgtggttacttagtaggatcatagagtttttgaattttaaagtaaattataaataatttcagtccttcctcattttggaaactctcgactactagaaaagaaagtaattagttcaagatgataaaagtagtgtatggaagatccaaatccagatcctagaacccagactgacagactcctggtcttctgctgtcttctatcattttagaacatatttgcatagttgataaatctggtgttcccactggactgttaatttttttacttacataagatatgattcaccttgtatcttgagtgactgtcaaatagcagagtttcaacagatgttcaagcatgattttcacttaatctattcagtcctattttacatttctttttctgattctttggatagttttaaaatgaagcttttattttggaataattttagatgtacagaaaagttacagagatagtccagagggtgcccatatgccccttaccaagtttcaggttcccctaatgttatcaccttatatttccatggtacattttccaaaactgagaaatcatcactggtataatacattactgtaaactaaactctagactttattcaaatttcaccaattttttccattaatgtctttttatgtttcagaatccaatctgaatatcacattacatttagctattaggtctctttaatctcctctgaggtttgtgacaatttctcagtcttaccttgcttttcatggtgtcacatcttagaggaatattggtcagatattttgtagaatgtccctcaatttgagtttgtctgacattttttattatagttatacatgggttctggattttttaaaagaatacccaaaagatgaaaagatcttctaatcacgtgataacagggagtacataatatccacacagcatcgctggtgatgttaaatttgcttaattggtttattatttgatcttgatacaagagaagtgacttcttagatgttacatatggcatctgcattctttcttcctaattaagctcccccaagttatctatgggatagatgatggtttgttgtaatttgagtatgtaacagatttttcttgggggtatgactggggtagagattttcttggcatatagatttttcttggggttcatttcaactccatcccaccacggtaggattgtaaaggcaagctgtgtacatgattgttctacgtcctcttctcttgctccttctttgattcagttacgttttgcttctatacagatggaactcttggcctctctctttttgagtttcctagtcttatgacttcagaactgatgtttgtatttcaaatctttgtctatttatgcttagttttccctaggagttctcactggagaatctttggcagtataaccatcttagccggttcctagtgcctctatatttcaccctctggcctaattctgtatgagtgggcatttgaatattttgtcatgaatttctgatgtgtaattgctagcacagcaacatggatgaattaatgactgctctttaaaaccctaagtctagggtcaggactatggagaagaacatgatatttgtgcccccactttgatataatttctggggttggaactattcattaatttagatcagtcattggctttatttgcagtttttcccataccacaaaacagtggttaataaaataattctcactacttcaaaagatcaatgcctcataatgctttaaaagacatgatccttgtcattgctgatctctagggagacaatgtcgaaggtgtccacggcagtgttggttttggtatagggaagatatgatcttcaaaatattaaacaactgcattgatcagaacagatgctggtcccagagttggagcaagatcctggagactcctgctgttccaggcattaacttttagtagctgattcataaggagttctgaggaagcaacttggaagcggttggaaccttaagaggcttgtgacagtggctatattctaaccagtgtgcaagtattttaattttttacaactggtattattacattggtgtcttctagctaaatattaacattgttggtatgtgagggttgaagttagaagcaaggtccaatacttgcttaatccaatcagtgaccctgaaaaacttgggggtgatctgagtactcagaaaggcagaatgtggtgcatacccaccatggagtgctctgcagtatttagaagtgatatactagatgtacatatagcaacatgagacaagtggaaaaaaagaatcagaatgagatatagaataccattttctatgtatatgcatacaaacaatactacatgtttcacgataacacaaaagcaagacacacttaaaaacaccagaatgactgtctttgagagaaagggattgagaacggaaattaaaggggataaacaagaaaaacaagagtgcttgttgtaacccagtgatcattgcttgttgatcaattgatcaatgcttgttgtaaaccaatgatcattaagcaccatggacagagacacatgattacacctaaggttagaaaaccacacaagtcccgttgcttcctcttaatattttgaaatcaatccttattcatattattcctgcttcctgatgacagacacagtaaaagataatggaattacttcaacagctggattcttttattaaattcaatgaatatagtcttctttgattacaggaaactgcaagttgctttggaaaaaatgaatgtgaattagataaagcctatatcttcaaagtgcttggtacaatatgctacatttataacttataaaagtcacattataagatactaaaattttttatagcttactcttttacttgcctactttattcattatagataaaatttaaaaggattccatatgatttttatgaatatcttgggaagtggatattattagattatctagagacactttcatttatcatgataggatttaaattgttaaagattgtgtcctttgcagggacatggatggcgctggaggccattatctttagcatactaactcaggaatagaaaaccaaaaaccacatgttctcacttataagtgggagctaaatgatgagaacacatggacacatagagggaagcaacacaaactagggcctattggaggttgggaggagggagaggatcaggaaaaataactaatgggtactaagcctaatacctgagtgattaatctgcacaataaacccacatgacacacctttacctatgtaacaaacctgcacatgtacccctgaccttaaaataaaagtgaaaaagaaaaataatccagaaaaatataaagtggtggagattgatttttcttagagattctagagtcattcctttctcctgtgactcattatcaacatttcttctttgttgctttgcatgtatttctaggagacaatttcttggctcattgactttagagttgcagtcccaggtcattatagctttattaggtcactatcctccagtgcagttaattagctatttttccatttatataaagattttaaatacctctgtgtgcttgagatgatagtctgtaaatagctacaaggtaaggatggcatgaagttcacaatgggagcatgataaactagataaacttcagctgcaagaaagactcaggtaacagtttgttagcctggggcagaaagaaacaggtggttgtggtggggaaatggtgatcacaggaaaggcataaatatgaattacctggaaagggagaacaagaattaaccttagtttttaactaaaacttagaaatgacttggagatccaaaggtgcaaaggagtacactacagagtctggagtctgcactgtggcttggttcagggcaggactaggatgcatgtaaagttgtttgtggtatccagagacttttggggaaatctattagccctgaaaatgaagacaaacatgcttgttgtcttcctaacaagcttgttgtttacttctatttctagagaagacccaagatataaaaaggagaaagttcatcagatactagtcataagtgaagctttaaaagatgaaattccagtttcatggactcaagatggagaaggaataattgaaaacatttggaagaaaaacatctgggtttttaactcaccctgaactaaaaaaatgtagtgtctgttaaaattagttgattgaagaatggaggaaaaaaaagtaggaaactaaatgtgtaatgtttaacaacctgcaataaatcctcctatacttgttcatgttttcaaaacatttatgataaatttttaggtctatataatgagaagtttaggtagtgaaatggagtgattagacaaaagtgacaagataaagaggtagaagatggatcctttgaggaaggctaaagcaaattgaggtgaataaaactagagggtacagatgagtgatctttatttgcttttaccaacatcaaggatattaagcacttatctgacagagtacctgacaacttctttatatccacaggggatgaattaagtggatatcagcttagttgaaaggatggagatttcctttttgtaagagaacatttggacttttatgttaatgagaagcaggacacagccgggcacggtggctcatcacctgtaatcccagcactttgggaggccgaggtggacagatcagttgagtgcaggagttcgagaccagcctggccaacatggtgaaacctcatctctattaaaaatacaaaaattagccagatgtggtggtgcatgaatgtaaatccagctactcgggaggctgaggctacagaatcgcttaaacctaggaggtggaggttgcagtgaaccgagattgtgccatggcaatccagcctgggtgacagagtgagaatctgtctcaaaaaaaaaaaaaaaaaatgcatgatacctgttcataatagctaagaaatatatttttgaaccttgaaaactgagggaaaaactgacatttcctggatgggtaaataaaggaactggttcagaacgtagtctcagatcttttccagctcattgagtttattgattgagaataatgaacatctttttaagaaaattttaaaatgtagtgatcataaatctattctaagaagttgcccaattccgatcccatgcaattccagttaggtgaatttaaatttaaatgattccatcaaatgctagactatctgtatttgtcacactatcacaattgtttagtgtaaatagatgataactataattcatgtcattgtaattattgagagcaatagccaggccagaactagggaactcaaagcaggatatctcctaatggcaatggccttaggagagaacacattctttccatggagggtttgggatgcatcaaaataatcaaacacttataacccaatgtgtcatcctggaagccattcagcgacccaaagatgaatacttaatacttaagaaatgtgaagacaagaggacaaaagctgagtaaatttttagatctgctgccatttgctctttgtattattttctcatctttgctttatgagggattgtgaagtaggtaaattttgtgtttagctcaatttattcttttactcagttctggcttcattcctgcgactcttattctcctacccagcccttcagctattactctgtctcctgaagcaaccagcccttgataatccttcttgggtaatgactcagcttaaaaatggatcacttatttcttcatcattaagagtctcatgtcttgcatgcatgcgatctccactaaggaaagccagctgttattttttttgtctgcaatgctcaatggagtatccttcctgtagcaatgtaagcaaaacaagggactttagtatcttaacctaaaggaaaacaactctaatgctgcagttttttaacctaaaagaaagcagctctaatgttaaaggaaatattttggggcactggagcttttaatattgcacatctacacaaactcctactttgctatttcttcccctttatcacaattttccacttaatgaaccatcttagtctcctgttgaattcaataattcaatttccccttttctttttttctcatctctttcctttctgatttaaaaaatgtatttaacttaaaaaaatccaccttgccctctgtgtaggctctgtctttgagtaaactttacacagaatctcatattttttgaatgacctaataaccctcttttagttttgtcttttccttgtaaattcattaaaagtgaagtttaccactatttcttttgttattctgagttgtcagtttttgctattcaaatttcagtttggaggaagcaccacatatatttctacttcacagcatatttttattattcctacttcatggaagccttaatagcatctttgctagaaggctgttttttctcttagtgatcagaaggatttatttttgtctttgttacccatttctagacaagtgtttgtcagtttatagttcaggtcatgaggatttagatgtaaatcacagaatggtttgcacaactcttacttaaaattgctctgataaccttagattctcattttatctatgttcaatttcttattaaacataatgtatatattttcacctttatatcatctctaaggtttagtgcattgttaggcacttgatagatacagcataaatacttgtcgaatgaatgagtgaataagccaacaaatctccccagcattgtttttgagttgctttacagtcaatacaaagaatcatggtatgtgaaacatgaccccaccagttttatatatatatatatgtggggagataaaaccaatcgtatttattggataaaacccactggaaaatagtgtaatagaagttatagtggtaagaattcagataaaggaagaagtcagaaaacagatctcctgaaagtagaaattagagtgagactccccaggtagttgataaattatagactttcttcaaatgttcttaccctttctgtagaatgaaaatctgtatgtgacacaaaaattgcatttgctgtggtgaatatggattccacaaaagcaagaattcttgtcaatgctatatgcccaacctctggaattgtatctggaatcctgggcactgaagatattttttgaattaatgaacaaaaatcattcggagaaccactcaggagataattatatacctagaataactattttttaaagaacatgttggttgactaatgatcattgtttccttattgatagtcattagtggccatgcttggtcctacatgtaactggagtcagaagtcactaatgtgtagttacagagcaaaagtcaggatgcaccatctgtccccattccctcaatatctcttccaccttcctgacaggctacttgaaatccctctgtcagattcattactttaagattttccttttccccctaaaacacctgttcacagtaagaaagctgtgctgtatagaataatggccttcaaaaatgttcatgtcctaattcctggatctggcaaaaaggtacagatatgaataatttaagaatcttgatttacttggattatctggaacttcccaatgaattacaagggtccttataagaggaagagtcagaggagatgcgatgacagaagttgaggttggagtgatgaacttttaagaggcagaatgtcatgagccaagcaagggatggaggcatcctctagaagctggaaaaggcaagaaacggattcttttctagaagctccaggaggaatgcagctctgttgacaccttgattttagctctgaaaactcattttattgattttagctctgaaaactcatcttaggcttctttactttagaacagtaagaatataacgtgtgtgtgtgtgtgtgtgtgtggtaagccactagatttgtagtagcttgttacaacagcaatagtaaactaatgtaacaagtatttactgtaaagaactttgaatgggagtaaaaagttcttggtcccagtataaattttcccaccaattacctttgtgaggctgagtagattgcttcctatatttctttctttatgaattatttataaaacataaatgttggactaaatcaggaacacttcattgaacaatgaaactctaatggtttatttcgggcagttgttcttcatccttaaagaatcataatattgtcacacctccccatgctgggacctggccaccattctttagtttattttctggacttaatctccattactcaatcatcatcttcttccagagtgcagatacagacactgtctggttcttttcggtccatattttatttctgtcccttttattcgctccaaatgtattttgataaaaaagagagactgcctttatgtgacatggtttttatcttatggtatcctctaggggtgtattatctacattagaggagattatttgtttcagctcattacatattttatataaaaattgagattgaaaatcatttataaaatgaagtggtttcttccattttgaaccatattagaagccttttattgactatttaaaatgaataataagaccccatatttatttttatgacatcttatgcaaatgtttctttgagtggttaaataagtacaggattgaaatagggatactgtgataattcctgactggcatgctgttaatatactattaatataaaccttactgaattatgaggtactctcttgactccagtgtcattcttcagtctcattaatttacgccttcattcaacaagtgtgaaacacttattatgtgactgattgtgttggtcacaagtggtgattgtgatgatggtgggagctaccgttgtggatcagttacggcttctatacccaagagtctacattttaattggagaaatggacatttatataactgtgagaagcagagtaaaataaatgctaatggtgcgatgagaatacagagtctggggcacattgggaagatttcacacataagcgagaatttggctgggattttgagaattagattttgtgaactggagaatagaataaaagaaattttgaaatttaaaaaaggaagggaaacttctaaagtctaatcaagcaatataaataatagaatagagactttgaaagctgtatgctgtgcatgagtaattgttaggtggctcatgtgactggctgaaatcatatccattgataagaaatcatagtgaaaagtatttaaagatgaccttatatctcacccaaatagaacatcctgggaaggatcaaataggaaatattcatgtaacacaaaagcagaggagagctaggtctaaggatggaattaatttagtagtagtagttttgaaaaccataatgccaaatagcagccagctgacccctctaagtggaagtccagggtgcatgtgatgagggttatttggctgtgtaagatgttaatatgatagttattttcatggctggaggctttctttcttgaacatgaatacttgcctaggtaattctttctcattttctttcttccttcaggtaagtaacatgaaaactgatcttggagtctgaggcaatgaatggaatgaatcactctgtggtatcagaatttgtattcatgggactcaccaactcacgggagattcagcttctactttttgttttctctttgttgttctactttgcgagcatgatgggaaaccttgtcattgtattcactgtaaccatggatgctcatctgcactcccccatgtatttcctcctggctaacctctcaatcattgatatggcattttgctcaattacagcccctaagatgatttgtgatattttcaagaagcacaaggccatctcctttcggggatgtattactcagatcttctttagccatgctcttgggggcactgagatggtgctgctcatagccatggcctttgacagatacatggccatatgtaaacctctccactacctgaccatcatgagcccaagaatgtgtctatactttttagccacttcctctatcattggccttatccactcattggtccaattagtttttgtggtagatttacctttttgtggtcctaatatctttgacagtttttactgtgatctccctcggctcctcagacttgcctgtaccaacacccaagaactggagttcatggtcactgtcaatagtggactcatttctgtgggctcctttgtcttgctggtaatttcctacatcttcattctgttcactgtttggaaacattcttctggtggtctagccaaggccctctctaccctgtcagctcatgtcactgtggtcatcttgttctttgggccactgatgtttttctacacatggccttctcccacatcacacctggataaatatcttgctatttttgatgcatttattactccttttctgaatccagttatctacacattcaggaacaaagacatgaaagtggcaatgaggagactgtgcagtcgtcttgcgcattttacaaagattttgtaaatggcttggctgtcaagatgtgtaactatggattactcctcatgctgattgcataaaagaaactgcaatttcagagaaatactgaagactcaggccatactatatgcctgaaaatttatgaaatcatggtaacaatttcaccattaaattagaagtgatgttatcctttggcacagtgtgcatcaaagtgctaaatattaaatcttaatgtcttttgtaacctaccactttgaaagaccttgttctaggtgagtgccatgtaattgaacaaataacaatactatgtcttttattttttctactggacagattattctattgatagacaaactacacattcaatctgtttaccacctaactcctatttatttatttatttagttagttagttacttatttgagttggagtctcgctctgtcacccaggctagagtgcaatggcatgatttcagctcactgcaacctctgcctctccggttcaagggttcgagtaattctcctgcctcagcctcctgagggctgggattacaggcgcccatcacaacccctggctaatttttgtatttttagtagagatggagtttcaccatgttggccaggctggtctggaacccctgacctctagtgatccacctgcctcggcctcccaaagtgctgggattataggcatgagccaccgcgcctggcctgtttagtatctagctctcttgattttaattctttttgttcctaaagtgtttgctttctattgctccagtctctacatatttttgccaccttatcaggcttctttggccatctacaaaattgttagtcctatatttagaatattcaaatttaaagttagagtggattaccaacaccatctgttccaatcccctcaaattacacgtactaaaatccaagaattgagcagtgactagtttgcccaaaggcacatagctggaaaccatcaaagagagccaggcaccagaaaccatgactctgattgctaggtcagtgccctttcactttcagatcaattttgtttttgatttgatgttcatattccactcttccatctttatcatttctgaatccttccctacttctaccaccaccacatatttcttgttcaagtcctaccaaagctgaattttaaatcattcctttaattatgaaaacaattcttgaactttattattaaacagtgttcttttgtctatggtagtattcacagagacccttgattcaattctattttataggtttgaagttcattccattacttacagcggatgatgtttcttctcttgggaaacaaaaatgtgattggtgaattacataagttacactaagatatttatgcctctttctcagaaggataaatttcaaatattttagcaaaaaattgaaagatttataaaagatgtgtgaaaattctgtttcccaaaattctgtggcttttaatctaacatggttactaaaatatagaaacaaacctattaattgaggtttccatcgtgaggtaatgaagctctgatcatctctcatcgtttgtgtcctaggggagataataattgatgttacccatccagtgcttctaattgtctaggtactgttctaggtgctttatttgaatcttatgatgcagattcattatctcactatccccattttagagaggaggtgtctggggcacagagttgctaaatatcatcaaggttatgaagtagtaagtgtggacgcaaagtctgctagtttgaattcagagttggttctcaaaacccgtgcactacagtgcatctctggcaataaaacgtatcaggatagctcctttacttaaaagcagtccctatttgtgggccctctactgggtgacgtcattaccaccaaacccagcatttatggggtcaattaatttacaaaaattttttgtatatgtatacccattcagccgttttgttgtaggctgtcactacaatcagggaagttgaaatgccagaatttctccgatatagaggaaaatgtctaaagtctccagaagatattaaataattcctaactctacctttcttggagggggtgggaggacatagcatcaccatggctgatttaataaatggtagaaggaaggactgtgcaacaactctaagtacacatacacatagtaatgatctaccagtactttgctcaaacttacctatgaccatttatttgtagaattaaacaccaggaaaaataaggaatatcacaatatttaaaggactgttggactcagagttgacatttactcccagattcctgaagggtcatcactgctgttttgagtggacacatttggtagtatgtagagtcctagttcagatcaggtgcatgttgggttcaccaaatgacaacctcccagtgatccttacatcatttcctcaatgtataattggaaaagatatacttggtagtttgtacaactccacacttcttccttgtcctgtgggttacagttattatggtagggaagtcaccaaaactgtcctatcccccagtataaaatagtatttttcttttttttctttttttgagacagggtctcgctctgttgcctaggctggagtgcaggggcacgacctgcagcctccacctcctgggttcaagcgattctcctggctcagcctcccaagtagctggaattacaggcgcatgccgccacacccaactaatttttgtattcttattagagacaggttttcgccatgctgatgaggctggtcttgaacccctgacctcaagtcatccacatgccttggcctcccaacatgctgggattacaggtgtgagctgccatgcccagcctaaaatagtatttcaaaaattatacttcattatgaaggggtaaaaatatcccagagatacagaaatagttcccattctatctccatttaattcaccagtgtgtcacctatgaaagctagtcacttcctggagaatgccaatggactattgtaaacttatcccagtagtaatctaaattgcagctactgtgccaaaggtggtacctttgctagagcagattaacatagacctgggtatataatatgtgatcattgatctggtaaattttctcttccatctctttcacaaagtagaattagaaacagcattcacttggaatggacaacatatacgtttgctgtcttactgtaccataaaatagcctgaagagacttgaaccatttggatattttatagattgtcttaatggtcgattatattaataacactatgctgtcaaaccagatgaaggagtggcaagtattagatactttagtagtacacatatgctctcaagagaaggaataaactctatagagaactgtgaaattgtcacatcattaaaattttgagtttgatggcccagtccatgctaggaggtccttttcaaagcaaaggaaaatgttttttccttctttaaaattttttttatttcaagtaagttttggggtacaaggggtttttttttgttatatggatgaattatatagtggtgaattctgatatctttgtgcacccatcacctgagtagtgtgcattgtacctgacgtgtagatttttacccctagcctccctcccacactcccacttctgattttctaaagtctattatatcaccctgtctgactttgtttactcatagcttagctacaacttataagtgagaacataaagatttggttttccactcctgtgttacttcacttagaataatggcctctagcttcatccaagttgccgcaaaagacattacttcattccttttaatggcggagtagtattccgtggtatatatattttttatccactcatgagtcgatgggggcttaggttggttttccacatctttgcaattacgaattctgctgctatcaatatacatgtgcaagtatctttttcatataatgacttattttcctttgggtagatacccagtaatgcgattgctggatcaaatgttagatctacttttagcattttaaggaatttccttactgttttccatagaggttgtactgatttacattctcaccagcagtgtataagtcttccctttcccccacaaccgtgccaacatctattgttttttgactttttaataatggccattcttgcaagagtaaggtggtgtctcgtggttttgattttcatttccctgatgattagtaatgttgagcatttttcatgtatttgttggccatttgtatatctttttttgagaaatatctattcatgtgctttgcccattttttgatgggattattttagtttctgctgacttgagtttcttgtagattgtggatactagtcctttgtcagatgcataggttgcaaatattttctcccattctgtaggttgtctatttactctgattattatttcttttgctgtgtagaagctttttagtttaactaggtcctatttatttttgttcttgtcgcattagattttgaagtctgagtcatgaattctttgtctaggctgatgtctagaaaagtttttctgatgttgtcttctagaatttttatagtttcaggtcttatattttagtctttgatttaccttgagttgattttttataaggtgagagacacagatccagtttcattcatctacacatggcttaccagttttctcagaaccatttattgaataggttgtccattccctaatttatgtttttgtatgctttgtcaaagatcagttggctgtacatatttgactttatttctgggttctttattcagttccattggtcgacatgcctacttgtatataagcaccatactgttttggtaactatcgccttgtagtataatttgaagtctggtaatgtgatgcctccaggtttgttcttttaatcaaaggaaaattattgcatcttgcaccttctgtcactaataagaaagaactatacctggtagatttcttccatttctggaggaagcataggctataatcaggaatactaccacaacccatatgctgaaagccatgaaagtctgtcagctttgagcagggcgcaaatatgaaaaagattttgctgtaaaagatctagactttgtgcagatagccttacttctttggccatactacctggcatacccaggtattagaaaaattggtggtgaaaagagaaaaaatgagtttcatagcaagcaccagttggataattacaacacaaagcttcaggggcttaagcaatcatttttctaaagattacagagtaattaacacatgacatgtagttccacaagatgtcatattataccacattaaagatatggaggtatgagagttaggacatgaccattagatctactggcctcttcacatactgcaccacccagaatctgctcatctaatgaagcaatgaaatggctgttatcaaaatagtcctcatggtgagctacaggaaagaggatttcaacagccatgtttcatgttaatcacctttttcttcccctccattcccgctaagtgattcatgtgaaatacactggcggaggctgccattttgggtttagattactctgcaaagatataacagcttatttcttctatgttgccaactttcttctgccctgatgttatttgtcctgccctgtttgtcccccggataaaaaatgagtgggttcagacaacaatagcccagtttccatttgtctctccagtgtcactcttgacccttctccacccagttttgtgcctttattaagctcttcttcagttacctaacttgagtgtcgcgtctcttgtcctggcaggatcctgactgacacaagtgtacaaaattgaaagtaaaaataccttgttttcttgcacaacaatctcactgtcaaaagtgcttattgcaaaaagtttattgtctacttgttccgatttgtatgcacagcggcatagtgtgtgctgcattggtatccactgtttcactcaatggtgtgtcgtggttgtctttaactgtatagatatcaaacttgctttacagtggctttagagaattcgattgtatggatgtagaatactcttttaaatttatcatcaactgctggatgttttagttgtttcattttctattaagctctaaacaccggaatgaatttctgtacagctaaatcttggtacatatccataactacacagcatatgactatgtaaaaatgaagtgttgtatacattcttctaccatttaaactgtaataaaaatttggcacagtggcttttctagagatgataaaatgattagagttaatttttgagttaacatttacttattttcagggattagttataatgagtagttatcactattgccaacaaaacagcacaaatatactaaacaaaaatattccacttttgtttccctctttttctctagtgtcttattatgaacttttgtatcttttggttgcactgatcaaagcaaatagttctctagtggcaaagcccatgacccataagctcctttaaactatcatgtttttgcagtatcacttggtcactgtcctcttgaggtatatgtaattagccttctgtttcctgtggtagggtattatatggcacttcacgttagagaacacaggaaactcccagagtacctgaacatgttgttctctctatacaggtaaagtggaaggatgcaaataaatttaacaatgggatattggctttagttttagataaggttctgttgtgggaattgctatgcacacaagtcatattctaaagcaaagtagatagggtccaggataaggaattgactaaaatgagagaataattgtgaaaagtttattgacattttagaagttaattggcattggcttttgagctaggattacactgtgcctaaggaaaggtgaaagacattagaaaaagtctgattttgcaatattttaaattcagcataggttgcaattaatcactctctgtgattataggaatgattctcatcctttgtcatgtgataaataggcaagaaaaattgacacatgaagatagaaaaacataggttattatatttttctctcaattttcttttcaaaagagatgggtataaactgatcctcttccataacaagggaagcaaatttcttgagaatttgtcaagtttgcaagatggaagagtctcatagacactttattagaaatgaaagacatggagaccaaaagacccaaagcttagtaaataatttccaatgtaatgtcatttaaaaatgtgatgtgaaaagtttaaaaataaaataatacataaaccaccaggagcttgattttgttttactggtctcttatatgatttagaattacagtgtttgtattacttatgtctttgaactgtaggtagaatgaagaaggatttagagaatgcttataaataaaaattttttaggaatcactgtgagaaaacattctaagtgtaaatataaaaggtattgagtttgttgaatcttggaaacagaaagataggggctaactttgttgcatttatgtatatgaaagttaatttgactggacacatggttataaaactttatttgatcctcacaatttaccttgtaaagttagtatcattaattgcaatttggtagaccgagactcagaaatttaaacaacttgcccaataccaacttgtaagaagctgaaaaattatataaatctttgtttctgaagcccatattctttccaacatgctaggttgcttctctaaataaaactgaaattacaataaaatgtgataaatctttgtatagaggtttgaacaaaatgcttcccactgtaccaaaatgctctttgtagtttaagctttttagatcatgtgctactagggcagtgattctccaattatcttctcaaattattttagttacatattttttcccgcagtgcttcttggacttctactttggtagaatacaaaatcaaacacttggattttgctgtaatgttaaattattagagacatttctaaacactctgaatttcagtatctaacataatacaaaccagtaaccgtttgtggacctgctcttctctgtagaccacttttttgttgcttcagagaatcccaatgtgaataagtactaatccctgcctttcagacatgtcaacttggtgagttagacttgtacccagtttactacaacataagggatagtaaaatgagtacttgtgatataaagcaagacctcacagctatggtaaacatttcttaaaccttgaaatactttccagatgtggcgagtgaggaacgtttctgccagaatatggctgtggtcttggaaatggatgtaatggttgagaaaacgtaaatagttctgtgtgactagagccaggctatattagtcttgaagcaaaaattaaaagaatttggagtcaaattcctgttacccatgttgaccagtcttgtatttcacgaggaacatcacggccactactctgggagaagcagagggatattaaagcagagaaggttttctccttcacacttggttgtcacaccgtgttaacacaatttcagaacctatcaggatattagattcttctctcaactctctgcaagttttattaaagtgtagttaacaaataaaaattatatatatggtgaacaatgtgatactttgatacatgtatatgtatgaaataaatcaagctaattaacattcatctcctacacttatttctttgtggtaaaaacattgaagatctattctcctagaaattgtaagtatgaagtacattattatcaactgtagttaccacgcttcacaagaagcctccagaatttatttgtcttgtttaactgaaacacggtactggtgcgtaacatgtcattctctacccgcttcatcaacccttgtcagctgctaattctaatctctagttctatgagtttgacttatgtagattccacatataagtgagattttacagtatttgtaattctgtgtctgtcttacttcaattagcataatgtcctccaggttcatccatgttgttgcaaatgacagaatttcccttttttttttggtaaggcggaagagtattcgattgtataggtacacacacacacacacaaacacacattttctccatccacttatgtctcaatgaacactgcatcttagctattgtgaataatgctgtgatgaacataggtgtacagatatttccttgaggtatgtatttcaattcctttgaatatacacctagaataagatttctagattatatggtagttctttttttttggaaactccatagtgtgtttcataatggctaaacaaattacattcccaacaacagtgtacaagagttccttcacttcacagccttgtcaagacttgttacctgttgtctttttggtaatagctattctgacaggcctgagataaggtctcattgtcattttaatctatatccttaatgattagtgataagatttttatatacctgttggtcattaggttagttttaacgctaaagtggaaatagacttttataactttgacttctttccttctcgttcattaatatgattataatttacatttttggctgttgttctctagctatcactgctaacaaagccaatggttggggcaaatcactccgtggtgtcagagtttgtgttcctgggactcaccaattcctgggagatccgacttctcctccttgtgttctcctccatgttttacatggccagtatgatgggaaactctctcattttgctcactgtgacttctgaccctcacttgcactcccccatgtattttctgttagccaacctctccttcattgacctgggtgtttcctctgtcacttctcccaaaatgatttatgacctgttcagaaagcacgaagtcatctcctttggaggctgcatcgctcaaatcttcttcatccacgtcattggcggtgtggagatggtgctgctcatagccatggcctttgacagatatgtggccatatgtaagcccctccagtacctgaccattatgagcccaagaatgtgcatgttcttcttagtggctgcctgggtgaccggccttatccactctgtagttcaattggtttttgtagtaaacttgcccttctgtggtcctaatgtatcggacagcttttactgtgaccttcctcggttcatcaaacttgcctgcacagacagctaccgactggagttcatggttacagccaacagtggattcatctctctgggctccttcttcatactgatcatttcctatgtggtcatcattctcactgttctgaaacactcttcagctggtttatccaaggctctgtccaccctttcagctcacgtcagtgtggtagttttgttctttggtcctttgatttttgtctatacgtggccatctccctccacacacctggataagtttctggccatctttgatgcagttctcactcctgttttaaatcctatcatctacacattcaggaattgagaaatgaaggtggcaatgagaaaagtatgccgacaactagtaaatcacaggaagatctcctaagtcatggcttgttttgtgagtgtcttcattaactattgaagtttattgctgaagcttctctttgtcctaccttaatttgatcatccacatggatattgggtctattttgtttgtcatttaggagggagggaaatttgcttctgaaaagagaaaagagttacatataaattatttagaaaccaaatattatacttttgagcttaattcctaagggtaattattagacatatgtaaatcggaaggctatctgaaggccttctgaaaagggagaaatatctccttcatccactgtaattcagtatgaccttaaattgactatatctgcaaagacaaacatttgcaaagaagggcacattgacagtactcagtgttagaactttaacatgtctatttggtgaacacaaatcaaaccacaaccgtagtataggtagtacagatacatgtgaatagaaatgattagaatatagttacctatgtatcagagtaaagctatttttaaaacaaagttagtagaagtaacttttgctctttcataggcaatcaactatgttttttaaaacaacggagcaggtaaagtcagcaaaaagcacaaaaagtgattcctatgtactacagaatttttatctactggcaaggacgtttacaaagaaggcaaagaataacatttactgtttttttttaaaaaaagaagaaagaatacatttgttatgtcaaacagagcgaaagccaaattctagtcttactttaatgtaatatttggcaataaagcattcttgagattaaaaaaaatagatccatgaaagctgagctgtgaaaaactttgccaaaattttaacatgtatcattgcttctattcagcagcattatttgtagttacatatatgtaacaaaacagaatttacttcctcacacttctacagctttctgtatcctttgggttttgtctttcactattgttcttcacatattgaaataactagacattttatcttagaatgaatctacccctttgtccctcttgataaacaaaaccagatcctattacattgcatagcctgtcgtattttttggttattattacttctagtttcaatcactcatagtaattatgactttaaccaaagaaactgacttttatttcatagagagtatttgctaaaggaaactaaaacctgataatatttaatgtggtaaaaacattaattgatttttgaggaaccatgtattgaggaattattataatagtagaaaagagaccttggtaaaagtttgggctcagttcctagtacaacaaaaacaagtgggaatttatggctatggagcaggttgtagtttctgtgggtggaaaattttaaaaagtgacatcaaaggtagggagaattcttgctaaactgacctaataggattctggctgcagggaggcaagaacatatcaaggatggagaggaggaattagatcagatatcaaggtataaccagatatcaaggctggaagattctctctaaactgtcttagcagaattcttgctaaaactgggctatgcaggttcagtagagaagcgggccaaggttgaggcttattcgggaagtgggataagaagagtctgactaaattttggtcaaggggagagtctttgtcaactcaaagatggaaaattgagtattgtctgacatacacaattactttagtaaccagtaaagctcatgagcactcaaaatataaccatttaccaccacaattattctatttacatcttcttaaaggaagtaaatgtttttcttaaagtaggaaaaaagaaaacatttactaagatgatttgaacactctataaaggtatgaataaagtgacacaaacgcatcacacacacacacacacacacacacacaacattctccatgaccactgccccttagcattagaaacagtaatggcttcctgctgtagctagtcctggatacttaaccattccttgttggttttctttaatatcgcttgcactgtcggaaattaaatttcctcgtttactccatttgaatattgtactttttcttggtgtgaccctgatatacgtatttgtgcacagaaaagccccaggaaagagcacctcaaaatgatttctgggattagctggctcacatatttaaggagtacctgtataacttccttatctcaggagtactagactttgatcacacaggggttcttctacaagttcatggaaagtgcttattatgaaaaaaactatgcatgggtttcaaactctttttgcaccaaaataaactcatactaacttgtgataacatgtctaaaaggaatctagtttgaggcactaggaaggacaggacatcagtttgaaaagagctcatatcagagcaacatgatttcttctaaaattgaagcaagaacaaacatcaaatttatggtgaagcttgggcagaaaagtggtgaaatcattgatgctttacagaaagtttgtggagacaattctccaaagaaattatcagtttaaaattgtataactcattttaaaaagggataagactatgttctatgttgaagataaagcttgcaacagcagggcattcacataaatttttgaggaaaaaaattaatcttgtttataccctaattgaagaggaccactgattaacagcacaaacaatagccaactccatatacattttaattggtttagcttacacaattcttactgaaaaaggtgagcaaactttttactcgacaggtgccaaaactgttgcatctagatcaacagcagagaagagcagagctttccgtggaaatttaaaacaagtgggagctatcctcaaacatttctttgaagaattgtaataggacatgaagcatggctttaccagtatgatcctgaaaacaaagcacaatcaaagcaatggctaccaagaagtggaagtggtccagtcaaagcaaaagtgggccagtaagagcaaagataatgaccacaatttctttgaggattctcaaggaattttgctttttgactttctaaagggccaaaggacaataacatttgcttattatgagagtgttttgagaaagttagccaaagctttagcagaaaaacatccaggaaagctttaccagagagttcttctccaccaaagcaaagctcctcctgcttatttctctcatcaaacaagggcaattttgtgagagttttgatgggaaatcattaggcatctacactgaagtcctcatttggcttcttctgacttctttttgtttcctaatcttaaaaaaaaatccctaaatgagacttcttcttcatttaatagtgtaaaaatctgcattgacatggttcaatttcctaggaccctcagttctgtagacatacactaaatggctgatatcattgctcacaaaagtgtcttgaacttgatggagcttatggtgagaaataaaagtttatatttatatttttatcttttaattccattttttccacatacttttggaagtcctccttgtatgtagaataaagatagacttattattcaagttttcacttgtgtttgtatagaatgaaatgcaggtcaaggcaaggcactataatctccattacaactaaatgtcacagccacttgatctcccaatcccttaccctttttgctggtagagctactctttcatccaagtctgaataaaccagcctttccttgcattaaaaaaatttatttttgattggctttatctggaccagttgcccataggactacaacaagaattaggtcccactacaacttatatagagaagtacaaagcctgctctgaaaaatatagtttaaaagagttataggattttctaaatatttgctggggtctgaggaaaagacatatgagtgaagtcaatggttaggctgaaaaagactaatgagacaaaaatcagacagaaatcaatatggtatatcacctgagatttaggcattaataattgatttgagcacctggataagtgctaacagcctgctaggttggttaatgcaatcctgtactcagtgaagatgttccagtataaatgtccatcaaaggtcatccattttggaggaggcacttaaatgtcatatggattagaaatcatccagcaaacctgaggcatgtgattaaagttaagttatcagcttaaaatagactagtataactttatgataaacacaaagcagaacctatagttgatttgcaaaagataaagagaaaggaggggctgggtgtggtggctcacgcctgcaatcccagcactttgggaggccgaggcgggtggatcacgaggtcaggagatcgagaccatcctgactcacacggagaaaccccttctctactaaaaaaatacaaaaaattagccgagcatggtggcaggtgcctgtagtcccacctactcgggaggctgaggcaggagaatggcgtgaacctgggaggcagagcttgcagagagcagagatcgtgccaatgcactccagcctgggcaacagagccagactccatctaaaaaaagaaaaaaaaaaaaggaatcaaaacataccactacagaaaagcatcagatcacaaaggaaggcagcaagggacaaataaaggaacaaaggctccacaaacagccataaaaccattaagtaactgtaaatagtaaattcttatttattggtaattactttagatgttaatagtcaaagtttggcaataaaaagacagaatgactaataaaccaattcagtaaagttgcatgtataaaatcaacatacaaaaattgatagcatttctacacactaacagcagattcaatgcaatctctgtcaacattcccatggcattttaaacagaaatttaaaattctcaattttgtatggaaccacaaaagaccccaaatagccaaagcaatcttaagaaaaaaaaaataaagttggaggcatcacactacctgatttcaaattatagtgcaaagttatattaatcaaaactgtatggtattgacatgaaaacagatatatagaccaatggaatagaatagaaatccaaaagataaacccaagcatatatgattatctaatttttaacatggacactgagaagacccaatggggaaatgaaagtcttttcaatagatggcacaggaaaactggaactctacatgcaaaataattaaattggactcttatctgtatactttttcaacatagctaaaccagaactatgattcccagaattcccctccatgtatgtttccatgttagggcttaccataagaaaagtttgtgtaagatttggaaggtggaagtgaagcagtagttacttttgatgtgaagttggtggagagaaggtactgctgcagctcacacatactgtcactggtatgctggctcaccttgctgatgtctctcccttagatcctccgagtcctgaaccaggtgcaagtacatcagagttggaagcactcaaggagacactgttctaatttgtccttggcctcctctacttcgtgtccattttcccttccatagtactggctctactggctttaggcccagcatgagattcaatggaaacagacatacatagatcgcttaatggcttccacaattgcgtaaggtctaatgcctataagaaatttcttactctatatcagttatagtggttctacttctctgatcaacccctgagtgatacactctcaacagatcacaacaacccaatcatttatgggcctatagaataccttattgatcaccatgatattgacacaatattgcatctgaccaggtatattttacagcaaatgaatatattttacagcaaatgatatattttacagcaaatgaagtataatgataagctcacacacatggaactcactagtctactgacatgcgccatcacttacaagcatctgatttgataaattggtggaatgcctgcttctgctaaggtgtagttacaatgccagttgggaaccacattttgtgatgacgaggtgctctcctacaggatgcaggagaagcctatgatgagctactaaagcaggctgtactactggtcacagctcctgttcctcatgctcttctgcagccttggcttttatttgtgattcttgaaacccctccctcattagacccccatagccctagggattataagagctcactgcccttgccagccctgggttcctttccatttcttcctggttcttataacccttgcccaaattcttgtatataattccttcaatcgattattttcaatcacgcattttagtgtgatatattttcttatcttgaccttgattattttctacaatatctgtaaaactgagaaagaaagtagagcaatatggatttacagaagtaaatgcacgtaactgtcaagcataaaaagggtctggaagaatacatactacatgatagttactctagagaggagggcaggagccttggattaagggtcattaaaaggtctttgtctttatttgtgatggtctagtttttaaaatgagaacaaattcatgtactctgtatgcaattacaaattattaaaaatttaaagtatcagttgaagatctttgctgatatcaagtcgttctgtgatactttaaactggatttcaaattttcagagtatcatttgcttataattaaattaagatttaatgaactctaatatattagatatatatttttccaactaaaacaaaacagataattacattgtttgaaatttccatttcagactactctgggggttaaggataatgtacccctgagccgcctgattataggcctgttctataaaacatattcttttggactttatgggcacttgcaagggagtctgtgggccatagatatgaatgactgtcagagaaatgttcaagtggtttgctttttcctggctttgctgctctgaagagagtctgtcttgggaggcagtttcaacctagaagttagtcttaagaattcagttatttgcctgtatttcaaactaatttttaacttcttagctctgaaattcatgatcattgagccattctacccttatttatgttcccttttagtcattgcctataattctattttgaaactattttttctcttttttttttttttacatttttgatttggcctaattttattctttagattttagttttgttcagttaaaccaatatttatagagttcctaatatgtgccagaaaatgtaaaaggcattatagagacagagaaaaataagctagacatcctggctagcttccattctgcaggacatagagaaatagtttcaatgtcaccaggtaagtacagtgatagagttatgcataagatggtatgggagtacaaagaggagcagagggtgcagcagtgttttcaacaacagttgtacatcagaattacctgagacacttttaaaaaataatgagactcttggctgacctcccagagagtttgattcaattggtttggttggatacattattcctattattattttacaattaagactctattttcctttctagttttcttctgtgttttttttaaaaatgtaaagaattaatttttttaatttttaatttttttaaattatagatacataattgaacatatttgtggggttcatgtggtattgcgatacaagcatacagtgtgtaatgatcaaatcagagtagtcaatccatctccttcaatatttatcatttctttgtggtaggaacattctaattccactcttctagttattttgaaatttataacaaattattaattatagtcaccctattgtgctaccaaaactagatcttaatcctccatgtaaccgtatttttgtactcattaaccatcctcactttctctcctgcataccactaccattctcagcctacagtaatcatgattccactctctagctccatgagatctacaattttagcttccatcgatgaatgagaacctgtgatctttgtcttttttcacctggcttatttcacttaatgtcctccaggtccatccatgttgtttcaaaggacaggattttacttttttgtggccaaataatattccattgtgtatatgtaacacattttctttatttatccattgatgggcacttaggttgattctacatcctggctattgtgagtagtgctgcaataaacatgagaatgcagactatcttcaatatgcggctttttcttttcttttaaatatacgtccagcagtgggactgctggatcatatggtaattttacttttaggtttttgagaagcctctatattgttatccatagtgattgtattaatttacattccctccaacagtgtatgcgggttcccctttctccatatcctcaccagcatccattattgcccgtcttttggataagagccattttaactggggtgagagtatgtctcattgtagttttattttacatttctctgataattagtaacgttgagcatttttcatatacttgtttcccatttgtgtcttctgagaaatgtctattgaaatcttttacccattttttaatcagttttttttttgctattgaattatttgagctccctacatattctggttattaatcacttgtcagatgggtagtttgcaaatattttctctgattctgtggattgtctctgcactttgttgactttttcctgtactgtgcagaagttttagccattttttaattgaattattagatttagtttttttttcctattgtttttgagctctttatatgttctggttattaatctctcgtcagatgggtagtttgcaagtattttctcccattctgtgagttgtctctttgttgactctttccttcactgcacagaagctttttagcttgatatgttcccatttgtccatttttgctttggctgtctgtgcttttgaggtctagctcaagaaatctttgcctacttcaatgtcctggagagcttacccaatgtttttttttttttcagcagtttcatagtttgaggtcttagatttaagtttttagttcattttgatttgatttttgtatgtggtgagagataggggtttacactcacttttctgcatatgaatatccaattatcgcagcaccacttattgaagaaactgtccttttcccaatgtatgttcttggcacctttgtcaaaaatgagttcactgtagatgtatagatttatttttgggttctctattctgttccactggtctatgtgtctgtttttatgccagtactgtacagtttggtttactatagctctgcagtataatttgaagtcaggtaatgtaattcctccagttttgttctttttgcttaggataactttgacttttctgggtcttttatagttccatatacattttaagatttttgtttctatttctgtgaagaatgtcattgatattttgacctggattgcactgaatctgtagattgcttttggtagtataaacattttaacaatattaattctttcaattgctagtatttttaaaggatttttcatcaatattcatcagcaatattgggctctagttttctgttcttgctgtgtctttctctggctttgttatcagggtaatactggccttgtagaaggagtttggaagtattccctctttctccattttttaaatttattatttttttattatactttaagttctagggtacatgtgcacaatgtgcaggtttgttacatatgtatacatgtgccatgttggtgtgctgcacccattaacttgtcatttacattaggtatatctcctaacgctatccctccccctccccccaccccacaacagtccccagagtatgttgtttcccttcctgtgtccatgtgttctcattgttcaattcccacctataagtgagaacatgcggtgtctggttttttgccttgcgacagtttgtagtttgagtaggattggtactggttattctatttatttatttatttttttattattatactttaagttttagggtacatgtgcacattgtgcaggttagttacatacgtatacatgtgccatgctggtgtgctgcacccactaactcgtcatctagcattaggtatgtctcccaatgctatccctcccccctccccccaccccacagcagtccccagagtgtgatgttccccttcctgtgtccaagtgttctcattgttcaattccgacctatgagtgagaacatgcggtatttggttttttgtccttgcaatagtttgtagtttgagtaggattggtattagttattctttaaatgtttggtagaatttggaaatgaagccattgggtcccaggcttttttagtccatttaaatttaatgttattattgataagtaaggatttaccgctgcccttttaaaatttgtgttctggttgttttgtggccttccttccatccttccatcctttcttctttccatcttccttttggtgaaggtcattttctctggtggtatgatttaatttattgctttttattttttatgtatctgttgtatgttttttgatttgagatttccatcagacagtaaaccctatcttataataatccattgttttaagttgataacaacttaaaactgcttgtataaacaaacacacaaactaacacgcaaaaagaaaactaataaaagctctgaacatcatcctcccagtttttaactttttgttgttgctatttatatatatctctctctttaaagtaaatacagggttttgccatgttggccaggttggacttgaactcctgacctcaagtgatccatctgctttgacctctgaaagtgctgggattacaggtgtgagccacggcacctggcctgtttctatttatgtcttattgtacagtctatgtcttgaagagttgttgtagttgttatttttgattggttcatcttttagttttcctacttaagagtagtttacacactacatagtgttataatattctgtgtttcagaaatattttaaataattttaaagtaatactattatcggtgaattttgtaccttcagaggattttttattgcttattaacatccttttctttctgattgagtgctccctttgtcatttcttgtgggacaggtctcaccttttgtttgtctgggaaagcctttatttctccttcatgtttgaaggataatttcaccagatgtactattctagggtacaagtttttctttcagcactttaaatatgtcatgccactttctcctggcctgtaaggtctccactgaaaagtctgctgccaaacatattggatctccattgtttattttctcatttctcttgctgattttaggatcctttctttatcctttacctctgggagtttgcttattaaatgccttgaagtagtcagacgtgaagctagtacagcactgggtctcactcaaggtctgctatacccacttcctggctatggcccatgttccttaagggtcccagggctcttcagtcagcctgtggtgaatgaggcctgggactcacccttcaggacagtgggctcccctctggcccagagtaagtccggaaatgccatcccagagccaaggcctggaactgaggaccccaaaagtccgcttggtgttttacccctctgtggctgagctgatagctgaggtgcaagacaaagtcccctttactttttcctgtacttttctcaagcagaagaatctctctccatagccaccacagctgggaatgtgccagttcacacctgaagccagcacatctctgagtctcacccaaggcctgcagcatactacctggatatggctgctgctgcttccgggccgaagggctttttaagcagtaggttgtggatcctgctgggactgggttcttcccttcaaggcagtgggttcctttctggcccaaggtatgtctagaaatgttgttcgagagttagggccagatgacgctgaccgttgtgtcctatcctactatggctgagctggtatttaagatgcaagagaaaagtcctcttcacccttctctcctctcatcaaacataaggaaaaggtctcttttggagaggtgcattgttctgcctgtggttggggaagggataatgtaagcactccctcagctgccccagctggtgtctcaaaggtcacgtgccccccacctcctcagtcggctggctctgagcccagctcaggactaggacttgcctaggaattgcagtctttgcgtcctatactgcctttcaagttaatatggggccccacagccctccagccctgggtggtgaggctggctggaactcatcctcccactgaagggatgggtgatgtcctctggctagttagtgctggttgtttttttttttaattttatgtatatatatatattatactttaagttctagggtacctgtgccatgctggtgtgctgcacccattaactcgtcatttacattaggtatatcttctaatgctatccctgcccccaaccccagccccacaacaggccccagtgtgtgatgttccccttcctgtgtccaagtgttctcatggttcagtttttaaacgcaccctccgtggtgagtgtcagctgagttcagctctgttctgctttctgtgggacagggcagcactgagttccatgcaaagcctcacagttgctgtgctatgcctatctccaccacccagtgctgtgggtggtcggggggagcggtggcgtcacaactcaagactgaattcaatatttcaagaggatagaaaagacatcttctatcctcttcagtgcctcttttagtgatattaagtcaaaaacaggcactacgagtgcttacctgatctttggttcctatgaagctactccttttgtgtagatagttgtcagacgtggtgttcttgtgtgtgtgtgtgtggcaggggtggtgatcggtggagacttctattcagccattctgcccctccccctcttcctaattttaaaccaccaatgagcaagttggacttagcagataaaatctccaagggtgagggtcttaaaatatccagtctcagttttgtttcctctccaggactcattacaagacttttcttttggtggttcttaccaagccaatcaggttccagggacaattcccctggccacatgaacaaagctggcaaatccaggtttctgcaaaagcagctagtcagtattcttcagtgctgttaattcactactttttgtgattctcttagctttttatataatagaagtggcacaagcagaagctcagttacctgtattctaattacctgaagatcatgtggtctgggaacaggtaagtggaaagatggaaagtcaagataacagcaggaaaaaaatttaaattgatttatgaaatttagtttcagcaaaatagtgtagtggcagaatctctctttgcatttatcaaataagattttggtgtggtcaagtaggttataacgtagggaagaaggaacagatcacattagggcatacataaggggctacagatcatgaagaaaggcaaataactgactttcacttttacctggtagtagaaatgtatcatgggtatccacagtaaaaggaaggctatgaaggagagttggactcagcacaatgcagtgtctttagcagaggcaagagatttgggagttcaaatggtgacttagaaaatgatttattatttaaaaatcttcttaacctgtttgataggcgtgaagggaaattaataacctatagaagttaaaagtgaagaccacttgctctatctctgtctttgcagaaaagtttaaaaaggaagtctgctagagactcatgttctgtggcacttcttgggaccaaattaaatgaaataaacagaatttggagaagaattgaccggtaaactgtctttctgagagcccacctgcccttacctgcatgccttactacacacttaatatcattttcaactgtgaagaagaaaaactgttataatggtactaatggaggaataaattattctgctatgatagttcgttggacgtttagttgtttttttcttcttcctctctagttttggccattacaatgtaaaatagaggtagatacatttcaggtaaaataacaaatttttggaatccaggaatccagggacatgaaaattgaccgtaagaggaaagatgaaaggaaggagtaatttagtttgattacttaattcaagcatggtaatgatttatatgagaggatataaggacacctgtatttttacttttaaaaagaaacagacaagtgaacataggcttaaaacaaataaccagaaagttcagctgggagcagggaagaagttttgggctgttgaaatgataaagcacaggaatggccaaaaaagagaaatattgaattcttaagtagtatgacttagataatttagaaatgccactgatgtggactggactggacagaaattctccctcaatgctttatttctatgcctttattagtaggatactaattttatctattttcttcaactataaattttaacatggctaagaatttcttctgggagactgaccaaattcatataaatatgcaaatcaaatgatgttgtttggagagcaaatattaaaaagttatgatttgtaacttttatagtcttgaattaataaaaaagaaaaaaaaagcatggtggaggaaagtcctggagaaccaaagattgaaagtattcttttagaacaagctcagtttactgagagcaaagaatggctcagagagcactgaacacccttcagggggcagtgggatacctttctctagccttgtgtattccaccaggagcaacttttgcctttgagactctgaagacacaagttaaatacactgtaaatatcttgtgatatacaattatttgctttgcttcttttccagttttaggctatctggcccatttctaaaattcattttttcctgtttccttgtccaatttctccatcatttgtatcacattcaggctcattacatttggataatatcagatattctaaacttgtgttttttctctccaaactccatttgcttaaatacctgctgctgcttccagaaggagatcagaaaaaataatctacacaaaactatgaaagacttgttatttcttattatctgaacctttgggacattagtacatatttctcagatttattgcttgtgcatctagaaaaattctgattttatctatcaaatcgtgggatacattaggtatatagccaagtttttttgtttaacgatgatgcattctttcattttttgtaaagtgttgtcattatagacttccggtgtccctagcaataactagtctgcgttgtttagagacctttcttcttttgagttgcatttaagcttcccttttgactgtctattcatctattcatctttcatcatccttccttccctcaatgcatccattctcccatccagctactcatccacttactcattcactgccgcaccaaacactcattagagcacaccatgtgacgggaatgatggtgaggaataaattgatataaaaactgaattttacatagagaagctcatagtttaatgcaggggttttctactttggcgccattgacatttggggctggtcagtttttgctgtggggtctatcctgtgcagtgtaggatatttagtagtatccctggtttatacacaccagatgccagtagtattcttccccccattatccctcattggggaaactaaaaacgttttcagacattgctaaatgtcccctgggaggtaaaatgccctggatgagaaccactggattaataagactgacataatttctctgtattgtggtatttcctacaataaatatgcacattggagatatattctggatatattatatctgtactccccacctctgatcgttactaacatacttctgtaaagtagttcttagtttaatcatgaaagaagaacttatgtttgaggaaattattcacagtttaattgttttgctctgcagcaactttagttattctacgtgatagctttcatgtaaattcatctaaatagctaaacaaactttatcactgttttttcttccatgcagtctctgttgaagtaactttcagaggatatttaatagaaatgctcttcataaaaagttttcattaaatgccaaattattgaaaatgtgccactatatagaacaggatgagaactggaatttgtgatcaactcagtaaaatgaatttttcttttctgtttgcccatatttctgttttttaaaacatatattttatcacatttaattgaagttgattacttctgtattagtagtgttttaagcacagacttttaatggtatatgtctcacacaaaaatggttgacaatagttaaatgatattacatgaaatctaactggatatgacattattatcctgaacagattttcctggctagaagtagaacctcatctttctattaatctagtatttttctgtttatttgcatcttagatgtttttttgcgctgatgatttcatcctgtcttatagagaagtcgatgtgatagcccttaaaaaagtcctgataatgtggagcttaagtgacaaaaggaaagattattcttgctttcttggtttcagaaacagccttacttaggaaaacaagttcaaagagttcagtgtaattggtctgaaaaccaaaacagttatttaaaaggagaaatggcgcatttaaattctcatttagagaatatggcagagtaaatagagaatattttgtttttttcacttaaaaattcctacttggttataacaacattttcagcctatataattgcttgtggtattgagtttcgtagctttctacttgctttgaaagagattacagttgaccctcagtatctgtggggaatttattccaggacctcccacccgccgcccttggataacaaaatccttggatgcacaagttccctacataaaatggcatagtgtttacatataacctgaacatattcttctttatactttaatctctaggttacttataatatctaatacaatgtaaatgctatgcatgtagttgttatactgtattgttttcttattttttaaataaaaaaattgtggctacatagtaggtacatatttctactttttgttatttttcattttactttatttttcccaaatattgttgatctgaagctgattaaatctgcaggtgcagaacctgtggatatgaaggaattataccttttgtttgcctcagactcccttctcaaaactccaaatgtttccttattctagagtccttattagatttggtgaccaaatatatgtttaccagaactgtttgtgtttttacagatttgagatctcatgtattttcgtatgaaaactctctaataagatgcagtgttttatagtctccaaaaggtcagggttatctatagcctgaaaatttcaccatgtatcatttcagtgtctccagaatctagtacctctcattggctcgacttctaccaccctgatctaagccaacattatctcttggatttttgctagtgataaaaatgtgtttctagccaatctctctgcttctatccttgagactctgaagcatattcacaatgcaacagacagagtaaccctttaacaatgtaagctatattttgttgtttctctgttcaaaacctagttgcttgttatctcattcagagtaatgataaaagtacttacaatggcttataaggacctacatgatctgtgcacctgttacctctcaaacctcatctactctaccctccttgcacactcaggttcagccttttggacctccttgtagttctttgcagatgtcaagtgagtttacatttcagagcttttgctcttgctgttatttctgcctgaagtactctttccccaaacaccctcatgacttgttcatccatcttcttagatttctgctcagtcaactcatcagcaagaatgttattgttaatcctgttttataatagcactccccttagtgccctattcttcttccttgcttaattgttatccacagtgaaataattgtctgacactgtgtatatctttatttatttatttaattgtctgactctttctgtcaaaatgtaaatctgtgaggacagggacttttacctattttgttcttggctatattcctagtgcttagttcctggctcataatacaagaaattattaggtaagaactacttcagcctaatcatttatttactcaaaaaccttttttttgtcacctagtatttgcaacacattgtatgggcaaactattgaaataaaaaattaaaggagtgatgatttataaccttgagcagtttataattctataggggaatagacatgtgaccaacaagcatttgggtatattggtgggtcctaaggaaggtttgataaatgaggtgctatttgatctggatattaaagaacaaattatattttgagaagtgtaaaatagggaaagaaaatttgtggcttgaacaaagaaatctgagtcacaagatcttaaaagtctatgtcacagaatagccctctttgtctgtctcgtatcatcattagttattactcctccagggagagggtggtgaatattgattttactgatacagcaatttgacatcaaatgcactttctttgtgatttccacaggtaaacacaggtaccaatctaccagactatttcaccatcccttaaattagcaagctcatgtggcagcttcgttactgtcacatgtaactgcagcagtagtggccaaaagaatgtcatttgttattcatgaggtgctcaggtaatatttgactttcatggttatatactttttcatagaggctattaatataatactattaattagaaatttctcatttttttttctctttaggtaacgtgaaagtgaacttatcaaatgaatagggacaaccagtctgtggtgtctgaattcgtgttgctgggactctcaaattcttgggagactcaagatttttcttttttgcttttcttgtcttttctatgtgtccggtgtgatggcaaacctcattgtagtggtcactgtaacctctgacccttacttgcactcctccttgtatattttgctggccaacctctctgtcattgatctcacattttgctccattgcagcacgcaagatgatttgtgatattttcaggaaacagaaagtcatttccttttggggctgtgtagctcagatcttctttagccatgctgttgggggcactgagatggtgctgctcatagccatggcctttgacagatatgttgccgtatgtaagccccttcactacctgaccatcatgcatccaagaatgtgcattttgattctagtggcttcctgggccattggtctcattcactcattggtccaattgtcttttgtagtaaacttgcccttctgtggccctaatgtgttggacagcttttactgtgacatacctcagctcatcaaacttgcttgcacaaatacctataaactgcagttcatggttactgctaatagtgggttcatttccttgagtgctttcttcttgctcatcctctcttacatcttcattctggccactcttcagaaacactcctcaggaggctcatccaaggctgtctctactctgtcagctcatattactgttgtggttttattctttggtccactgatttttttctatgtatggccctctcctccaacacatctgaataaatttctagccatatttgatgccattttcactccttttctgaatccagtcatctacacattcaggaacagggaaatgaagattgcaataaggagagtgttcggtcaatttatgggttttagaaaaactacttaagtggctttattaaaacacagaatttccaagtgactattgaaagtccacagtaggcagtcctcatagcaatgagaacacttggacacaggaaggggaacatcacacactgaggcctgtcatggggttgggggagggatagcattaggagatatacccaatgttaaatgacgagttaatgggtgcagcacacccacatggcacatgtgtacatatgtaacaaagctgcacattgtgcacatgtaccctagaacttacagtattttatatatatatatgaagagactttatactgtgcatcactttgagttctcacagaccttcattgcccatatggagggtctattttgttcccactgaagaatgaatgacatttgtcctcgaagagaaagagactttatatgtaatatatagaaatcaaagattatattcattcttattttttagttcccaaagaatcatgtcattaataatattcacatggattaaataatggtgtaaataagtttgtttctcagaataactgtattgctgttttcaagctgtcctgccctctaattggaatatttgttaacatcatgctttattatctgtgtacatctcatatctccatttttatttgttctgccttgttatctcagtcttttggttatttgttccgccttgttatctcagttttttggttatgagtaaacagtagtaaacatctttaggatttgtggtcatgtacacattttaatccacagagcttgcttttgtgtttttttgttccatatgttgaagaatgttttttactttattttcagtcaagtagatcaggtgttggcaaacttttctgtaaagggccagattagaaatggtttttgctctgtgggctatgtggcctctgttgtaaccacttaattctgttgtaagatggaaatagccataaacaacacataaatgaataggcatggccaagttccaataaaactttacaaaaacaagaggcaggccagatttgatccaatggctatagtttgccaattccagaagtaaattttgtccaccgagttccagtaaaacttcacaaaaacaggaggcaggccggatttgacccaatggctatagtttgccaactccagaagtaaattttgtccaatatacagatttgcctatttcctcaaatatcacagtgtttgtcttataacaagagtataaaatgaaagacaatatagtacagaacaaaatttgtggctaaaatatataaattctcatctcaataacatcaactcacttactgtgtaatcttacttaaatcatttaacacttccaaaattcagaggtggcaaatagaactcacaggtttatgatgatgattaaatcagatatttgaaaaggctttatcaatttaaaagctagcctggttttctttcctggactataaccatttgcttgcagactatcaacttacaaataaaatccattttatcttctaatttatccatcacatattaaagttaccttccatattatattctttctgtcctatacactcacaaaaatatcttgtgatgtatctccatgatcttgtcttttcattgcattctggtgtgtactttcattgctttgtgtcacctgtagaactgaagatttaatagtttactactttcttctttaggtcattggttaaaaaaaggctaacatttacagagtacatactatatgttaggcactcataattaactcatttaatcctcacagtagtccttgagatagacacttttatcagcctcattgtacaatttgagagatgagatggagaaacagaggggtcaagtaacttgtttaatgttagtaagtggtagagttaggtttaaacagacagtatggctccagaggctaatttcttaaatgttgtgtgatttttcttctcataaaattggtttaatatggatctctggtgaattttagctgatatttcttcatgtaaggccaattattctatacctttctctgttgcctgtatttatatcaattccatgtggatggtaaaataattttaaattaaatgaattattttatgaaaccactgtggaattatgtacatacagtttagctattatataataatatttaataacagagttgctaaagatagattattaagtaaaaagggaggtaataaaacaagatttgaaattttgtttattttaaaattaatttgtgtatgtacaccaaaatgttaatagtggtatttctccaggggaagaatataggtggtttttactatcatctcatacttgcctatacattttatttttgcattatattttttgcgttacagtctatgtgtctgttttttatgccagttttgtgctgttgtgattactatagctttgtagtatattttgaagttaaacagtatgatgcctttagatttgttctttttgctcaagattgttttggctgtctggggtcttttgttgttccacatgaattttagaattgtgttctctatttctgttaaaaatgtcattggaattatgatagggattacactgaatctgttgatcactttgggtagtatgaacatcttaacaacagtgaattcttcaatccattgacacaggatgttttgtcacttatttatgtcttcttcaatttcttttattaatgttttatagttttcagtgtgcagatttttcagttccttagttaaatttattcctaggtattttggtttttgtatcaattgtaaaagggattcttttcttgacttctttttcacacagttcagtagtatatagaaacattactgaattttgtatgttaatattatattttgagacttaattgaatttgttaatcagttctaatagtttttcagtggagtctttagaatttactatgtataacatcatgccatctgcaaacaaataatataacttctccttttccaatttggatgccttccatttcattttattgcataattgctctggctagaaattccagtattatattgaacagagagatgagatcagtcttgttcctgatctcagagaaaaagctttcagcttttcacccttaagaacgatggcagcagttggtttgtcatatattgcctttattgtgttgaagtacatttctatacctagattgttgtgagtttttgtcatgaaagtatgtgaatgttgtcaaatgctttttctgcatctatttagatgatcatatggtttttgtattatattctgttaatgtggcatatcacattttttgatttgagtatgttgaccatccttggatcaccaagtcaccaagtccaacttgatcgtggtgaataattttcttaatgtggtgttgaattaggtttgctggtattgtttttgaggattttcacatctatgttcattagggatattgacttgtaattttcctttcttgtaatgctcttgtttggatttggtatcggggtaatgttgggtttacgaaatgagtttagaagcattctttcctcttgaattttttggaagagtctgagagggattggcattaattctttttatttattattatttttttgagacagaggcttgctctgtcacccaggctggagtgtgatggtgcgatctcagctcactgcaacctctgcctcccaggttcaagtaattctcctgcctcagcctcctgagtagctgggcctaccatgcccggctgattttttaattttaagtagagatggggtttcaccatgttggccaggctggtcttgaaatcctgacctcaagtgagccatccatctcggcctcccaaagtgctggaattacaggcgtgagccactgatcccggcccattaattctttcttaaatgtttggtagaatttactagaggagctattttgtcttgccctgagattttctctgatgggagacattttttgtttattactgattcaatgttctaaatggtttttattctgtttagattttctgtttctttgtgatttaatcttgacaggatgtacatacctaggaatttatttcgttctttttgattatccaattggctggtgtataattgttcgtagtagtcggttttgtttatctttttaaaacaccatctcttaagtttttgtagatctcttctgtttttcttatctttattttatttctgctctgatctttattactttcttctttctactaactttagacctagtttgttcttctttgtctggttccttgatatgtaatgttagattgttgagttgacatctttcctcttttttcatgtaggcatttattgctacaaatttcactcttagaactgcttttgctgctttccatatgttttggtatgttgtgtttccagtttaattgtctcaaaatatttttaaatttaccttttgatttcttcatttacccattagttactcaggggtatgtgtaatttctacatatttgtgaattttccggtttttctcccattgagtagtagattcatactgtagtggttgtaaaagatacttcacatgattgtaattaaaaaatctgtgaaggcttgttttatagcctaatatatgatccatcctagagaatgtttcatgtgcacttgaaaagagtgtgtattgtgctgctgttgggtggaatattctctatatgtctgttgtatccatttagtctggagtgttgttcaagtctacagtttatttattttctgtctaaatgatctgtccattgttgaaggtggggtacttaagtctcctactattatcttatggtcatattttagagacctttaccttgaactcatgctttatttactaaatttagactagatctgtaccttcaaaccatatatacatttttttttgcagaatcttttctgaaattggctgaagataataaatagtttcctgcttttctgagatcacacagtgagaaataaattatcaaaagctgaaacaagaaaggcactgcacaccaacttctagttggtactctggcaggcttcatgtataacatatgtactatacttatatatgttatacctatacatacttaggtaggtgtatgttatacctacctatgtatgtagcctatacttacaagtatctccataaatgggaggggttactaagggagatttcatactaaaatggccaaaattattattctcaaacattaaggcatgccaggttttctgggactctaggaagctacatattgtatcttgttcttgtacaaatttttaaactggtgagcaaattacttaaaattcagaactcaaatggccaatattgctgcaactatagagttaacacataaagtcttctaagttctctaactctctagttttttccctacctaatttgaatgtgatgacttttctactggtgtgtgataaaattcactattttgggtattagtaattcaaggttacttggagattttttcttatacaattcagccagttccagctaaactgtacacattgaaaatttaaccgtaaacttacttgaaattgaagtgaaaagaggaataaaatgtttttaaaaacaaaaaaccacacaaactactttattcaaaattttgtctatagtcttcattagattgcccatcagggaaaataaagttcagccatgtgaatatgtcttcattttgtcagaaatgtaatttgtatccaatcatcttttataagccagtgagtctgtattcctatctcatgacagaaattctaaactgaaagctattaatgtaagatttgtgtgtgtgtgtgtgtgtgtgtgtgtgtgtgtgtgtgtgtgtttaaatggatgtatatgtacatgtgttacatgttgtggctgcggcagggtaccaaattgacttataaattaatgagcatgcataaattaataagcccaaataatttccaatttcacatgacaagaaaatctttaataaatagtatggtttaaaattattggtaaaaatggaaatgtcttcaaagttgttagcattcatttttgcttaaatttctgataaaacagctttgtagttttctctgctaaatatttttaaatatcagagtttgacatgaaggttacaaaattataaacctatcctaaaacaggatgatctttcttcatgtgtttttttttggtaagcaaaacaaatttaatactggtggtttaataaaaacagctgtgtcttctgagttatcagcacaatatatatttaattttgagattcttaggtgaacatctgctattcacagattataaaatggtttacagggaaataaaatgactaacattttctaacatcttagttctcataagtaatctaggcaaactgttaaaaaacaaataaaccaggtaaatgtaaataaaataaatgtctataaataaaaattttatgtaatttgaaatcttaaagttatgttaaatgacataatgatactaattaaatatctgaatgatttcgaattaaaatcattaaactgttatacaaaaacatgtttctaaaaattataaaatggtttcatccataaaatagtgatatatgacagacaattcaaaatttattcttatttttagggatgggatcttactcagtaaccaaggctgaggtgcagtggcatgatcataactcactgtaacctgaactcctgtcctcaagtgatcctcctgcctcaacctcctgagtagctcagactacaggtgtgctccaccaagcccagataatgtttttaaaaacttttgtggagatagcatttcacaatgatgcctaggacactctcaaacttctggccttgagtaatcctcctatcttagccttccaatggactggaattaaaggtgtaaaccactgctcctagcctcaatttaagatttcttgattcctaggttttcaataaaatttaaagttactgagagttaaaatttttaattctcagtgtaaaaaatgtgcaaatattatcaaaaaggcataaagtgtgcttgaataattttgtgtaattcagtttttttaaaagattctttcaaaatatagatttaggaataaaatataaaacaaaatagaaaataggaagtagaagagagagatataaaaaaggtatagatatgaagatatatttctggtaagaaagtttaaaaaatataaataactttatatgagaaggaatcttgtatggtaaatttttgtcataaagtaaaatgactggttatttcaggaacagaaagtataggataaagtcgaaattcaagcatgttgcaaatagtttgtgtaacttctgtgtaataagttttgtgaaaaggaaagttataaaaattttttgtgtatagttaagtttgctataattaaaagaaaattatttctaaagattgaactttgacattaaaatacactaacataaaactggaaattttcatttgctatattaaaacaacaaggtttttaaactcttgatctgctcttgttaacattgcaagaagttttgatatttaattctgtaatccatttttttaaaacttctcagatttgtatatcagaagttagacttttgctgtaccttattgcatgggatttgtaagtcatacgtgattacctcctgatagagtttggatgattgtccctacaaatctcatattggaatgtaattcccagtgttagaggtgggacctggtgggaagtgtttgggtcatgaatgtgttggtgctcttcctgtggtgatgagttactgtgagatctggttgttaaaaagagtctgggatctctcccttctctcttactccctctgtcactatatgacatggtggctcccccttttccttctgccatatttgtaagcttcctgaggcctccctagaagcagatgctggtgcaatgcttctcatacagcctgcagaaaccctgggccgaataaacctcttttctttataaattgcccagtctcaggtattcctttacagcaatgcaaagtggactaatacaccttctgttctttcttctcttgaataggtatatctttttgcttggctgggatgataactctgtccttcaaccttttcattgacttataacttctttcctcatttcagacatggctgttgtggcctgatgctgcagtgtttatcttgaagtctaaagaagcaatgtgttcctccagtgtaacttgattctgtactccaggcatttcttgatgtatctgaattgttcaatgtaatcagaaaacttctcatgtttttactaagagccatgtattcccctgctcaaggtactagttttattgtttatattcctttataacatacgtattctcataatcctgaaaacactctccctgtgtgtggttaaatataagcattctttttatcagggttgacttcctggttatctacatagactttgcataaggagaagaaatcacacaacagtaggtttttatttatttatttgataggtggctgaaaaaaacacagattttacattttaccaagataatttctttttctttttctttttttggaaacagagtcacccatgctggagtacagtggtgttatctcagctcattgcaacctctgcctcctggggcttcaacaatcctcccacctcagcctcctgaatagctgggacacctggctaatttttgtatttttttgtagagctggggctttgccatgttgcctaggctggttttgaactctgggctcaagtgatccacccccttcagtttcccaaagtgctgggattatcggcttgagccaccacacctggccttcacattgtctttattacatttttgacttcttagaaaactgagttttaaaatgttcactttttttttcttttttttcccatcaatatgactttctatactgcttttgaggtcttttgattatcaccttggttaaatgaataacttttattttgcaataacctttgattctggttagaccaagtgttttaaacttttgacatctgtgataagttcccttacggttcaaatcctaaattaagtctttttgaactaaataattatactttttttgtaaattgtatcagaggcattgtcaaatgacaaatgataatagatcttctttcagttagatttatgtgtatgttattgatacaaatattccaaaaattacataaggctggggacagtagctcatacttataataccagtgctttgggaggccaaagtgggagaatcactcgaggccagaagtttgagaccagcctgagcaacatgttttctgtctctacagaaaacaaagtagctaagcatggtggcatgtgcctgtagtcctaggtacttgggaggctgaggcaagaggatcccttaagcccaggagtttgagtttacagtaagctatcatcatgccactgcagtccagcctggttgacacagcaagactttaatatatatacattctctctctctctctctctctatatatatatatatctatgtgtgtgtatatatatatatatagtgtgtgtatatatatatagtgtgtatatatatagtgtgtatatatagtgtgtatatatatagtgtgtatatagtgtgtatatatatatagtgtgtatatatatagtgtatatatatagtgtgtatatatatatagtgtgtatatatatataatataatatatgtgaaattgaatacgttatcagttagaattttgattgttgattttttcctaaaattatatttgtatagatattttattaatttgagtattccaaagattatataaaatttataaatgctttgtggtctcaaaatggcactatcagtcataattctcattatcttaaaatgttggatgtaataaaaataactaaatttacttgtcaacgaaaaactttgattaagttttaatcatggctactgtacttattatagcaatggttattctagattatactaataaaaaaatagatgtgatcaaagcatgttttccaataaataggcaagtgtgcatgctgagcttgatgctcgtgtcttcataactacaaataaagactatatcaacttttccaggaaagagtcttcctagctgcatgggacaatcagtgttggtcctgtaaatgcagtcagacctggtttatgtcaactgatttatgaccaaaagggggaacttatgaaacagagcagcaaatgtaagaaatcgtgtttgctgtgtatacttgtcagcataatgtcacacattccctgactccgtgatgaagtgcagctctccaaaaaacgctttgaagacaaaacaggatagaatatatgttccccatgtctcttgtctgagcctctatattccttaaaatataaatgatcctaatcctgacccttttctacacaaaagataatgtctgacagggttcgtgattatgcccgtgtaatctgtaagcagatgtatcgatgtaggggtgggttgcccctccacacctgtgggtgtttctcgtaaggtggaacgagagacttaggaaagaaaaagacacagagacaaagtatagagaaagaagtaaggggacccggggaaccagcgttcagcatatggaggatcccgccagcctctgagttcccttagtatttattgatcattcgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccatttaactctgagttgacccagcacatgtttcagagagcacggggttgggggtaaggttatagatcaacagcatcccaaggcagaagaatttttcttagtacataacaaaatggagtctcccatgtctatttctttctacacagacacagtgacaatctgatctctcttgcttttccccacatatctacacccacacattgatgtgattctgctttaatgtagcttctaagcaagtccaatatgattctgcacttactggatcttcacagcttgtatataaactgtgggctaaagacctgcaccagagcagtctgacagaacctctctgaaagacttctcctaggctgtaatcctcagtctcttgttctcagacccctaaataaatctaactttaatttcttaaaagcttaatttttttctttagttgacaccaaaaatctccccagccagatccacaaagttttcggtatttttcctatattttatatcattccaggcaagggttttctaactctcccatcagaatacgactttggtgcgttttcctcagcctccactgatgattttttctcattatccttaaagccctttccagtagacttcttaagctctttcaagttttcagtctccttaaggaccattcagtgtttactgtcagttcccagaatgcttttacaggttttgctgtcattttccttgaagtctgttcacttttcactaacagtctttgtgaaatccttctagcttctatccattgtctgattccaaagccaatgccacatagtttaagtttatattatattagagtgacatcttattccacgtaccacaaaccacctcagaacttagcagcttaaaacaacaaacttaaaaaaattgtggacttgtattagcgcaagcagggcttagctacgtgattctgctccgtgtggtattaactgtagccatctgtggtattcagctggcagctgggtagtctggagagttgaaggtggcttcagtgatgtgcctgttttattagtggattggatgaaatgttgtggtaaggtgggcctctcttgctctccgtgtagtttgagagcctgtctacatgatctattcagcagcaatatggtttggctgtgtccccacccaaatctcatcttgaattgtagctcccataatttccgtgtcttgtgggagggatccaacgggagataactgaatcacaggagtatttcccccatactgttctcgtggtcttgaataagtctcacaagagctgatgattttataagggggttcccctttcactcagctctcattctgtcttgtctgccatcatgtagagatgtgccttttgccttccaccatgattgtgaggcctccccatccacctggaaatgtgagtccattaagtgtctttttcttcataaatcactcagtctcaggtatgtctttatcagcagcatgaaaacagactaatacagtacattggtactggtagagtggggtgctgttgtaaagataacccaaaaatgtggaagcgactttggaactgggtaacaggcaggggttgaaacagtttggagggctcagaaaacgacaggaaaatgtgggaaagtttggaacttcctagagacttgttgaatggctttgactaaaatgtcaaataatgatatagacaatgaaatccatgctgagatggtctcagatggagatgaggaactcactgggaactggagtaaaggtgtctcttgctatcgagagagactggcaggattttgtccccgccctagagatttgtggaactttgaacttgagggagatgagttagggtatcttgcagaagaaatttctaagcagcaaagcattcaagcgtgacctgggtgtgttaaaagcactcagttttaacaggaaaacagcataaacgttcagaaaatttgcagcatgacactgtgatagaaaagaaaaatccattttctgaggagaaattcaagctggctgcagaaatttgcataagtaacaaggagccaaatgttaatcgctaagtcttcaggccatgtcagagatctttgtggcagccccttccatcacacacccagaggcctaggaggaaaaaacggtttcataggctgggcccagggcctccctgctgtttgcctgtgtacagcctagggacttggtgctctgtgtcccagctgctccagccacagctaaaagggatcaaggtacagctcaggccatggcttcagagggtgcaagccgtgcaagcctcaagctttggcagcttccatgtggtgttgagcctgtggatttacagaagtccagaatcgaggtatgggaacctccacctagatttcagagaatgtatggcaacgcctggatctccagacagaagtttgctgcaggggtgaggtcctcatggagaacctctgctaaggcggtggggaatggaaatgtggggttgaagccccccaacacagagtccccactagggtactgcctagtggagctgtgagaagagggctgctgtcctccagaccccagaatggtagatccaccgacagcttgcactgtgtgcctggaaaagctgcatacaatgccagcctgtgaaagcaaccaggaggaaggctctcccctgcaaaaccacaggggtggagctgcctgagaccatgggaacccaccacttgcatgagtatgacctggatgtgagacatagagtcaaaggagatcattttggagctttaagatttgactgtcccactggatttcggacttgcttggagcctttagtccctttgttttgggtaaattttaccatttggaacagctgcatttacccaatgcctgtactcctatcgtatctagaaaataactaaattgcttttgattttacaggcttatatgtggaagagacttgccctgtctcaggtgagactttggactgccaacttttgagttaatgctgaagtgagttaagacttttggggactattgggaaggcatgattggttttgaaatgtgaggacatgagatttgggaggtgccagaggcagaatgaggtggtttggctgtgtcctttcccaaatctcatcttgaattgtagctcccataattcccatgtgttgtggagggacctggtgagagataattgaatgatggggtggctcccccatactgttcttatggtcgtgaataagtctcatgagagctgatgactttacaaggggcttcccctttcactcagctctcattgtctcttgtctgctcccatgtaatgcatacttttcaccttctgccatgattgtgaggcctccccatccacatggaactgtgattccatgaaactctttttattcataaattacccggtcttggatatgtctttatcagcagcatgaaaatggactaatgcaagcagaataagcagaattcttcgatactgactcagcaccccacacacgttggttccaagatgtagaaatggaagcttcaaggcttttaacatctggacatcaaaactggaagttttactttcactgtattttattggtcaaagcagtcaaagagcccacccaggttcaaggagaaagaatatgtccccacgttttcaacgggatggtgccacaaaatttctagtcatcttaattcaccacagatagaaatatgaagagctcatttgttatgttatttgtgaatgcagactaaacatatttgttggtttatatagtagtgggaaagtgagaacttttaaaatattcaacttttagcccttgacatgcaaaatgagttcattacatggtaaggatgagggagaaagaaaagatctgaaaaagtagaagagtgatggattcagaaagcataggatgattgtcagtgtgattgttttatctagccacatatagctgtgtggtatcaagatgtagaaggcagagagttggatttatcaggattgttgtttggaagagtgagtacaatcattacgagggagcaaggtattgatcatggaatataaagtgggaaaagaggtaaggtaagaaggatatcagtaaagtgaatgacagcataaatatggtagaaccattggattggtggctctggaggaactgaataattattagacttgaagcattagatggtgcactagtgagggcatctccaactaagtctaccatcaagtcctggtgatttattatctcaaatatatgacaaatttatctacttatttccaaaactcccatatctagtttaagtaagcaaatttcttgccttggcaagcatgttgctttctaattgactcacctgtatccaatttgaattccttaaaatccattctatacattgtaaccttagtgatatttacaaatgtgaaatctggtcaaatcattcttctgcttagtagtcttggatttctcattctcttaggaagcatcttccactacttatttcagcattatctgcacaatgcttcccctcacttcctcacaatgtggtttcaggcacaactcccaaggccccactctggcctcggggagcagattgttccccctgcaggaaaacctttgttctccactcagttaactgctgtttaccctttagatctcagcttcagtgttgctttcttaggggaaacttctctgactcacatcaaatccctctcttatagtaattttcattgtatttcagagtaatttttatggttgcaattttacatttgtgtgattgtttgattaatctctgtctcctccacgaaaactccaagatgcaggaactatatcttactggcattcagcacaatacctggcacataggtgttcaaaaaatactaatagggtaaataaatgaattaattttatgcttttattttaatattttcatggtattaatatttctctctatgtgatattttgtatgtacatattttcttttaatttgaagatttatagtttattttagttatgtgctgtataaattatatttagttctttaatttttgtgttatttccaagggtcctctccattgactcttttaatatagttccactttaccccttaaacccactttcctctcccaccgtcgtcattcaactttatttgattttgttatttttaatttttctaagaatgacctttatcttttaaaataatatttaatcacccataacataatttgttgattctctcccactgtgaaagttgaatggaccagaatatatttctactatctttctcttcttatttttgttatgaatataattagtctttatacagttatggtttgtaacatctgcattctgttctttaaccgcaaaccccagaacattttgatattaggcttcagaatgctcacttgtatcatgttatctctattcatttttagtggatagttttctttttcaagtttttctgatagagatggggtcttgctatgttgcccaggctggtcttatcttgaactcctgggctcaagtgattctcctgccttggcctttcaaagtgttgggactgtaggtgttagcccctgcgcctggcctctaatagttgtcttcattaaagcctcatggggactctatttttttgtgtgtgtgggttgtttattttgtgtttgtgaagtccggtaaattcagttgcatctgccttgatgtggtcatactataacacattttttctggataaagataagccctttaaccattagattcaatgttttcttcatttcagaaaagttttcttttatctttgaattttttaaccagatattgtgagctctttcacactaatttctcatttgttggacctgactttaatgttacatttcaccttcttgtgttttctatttcgttttgctcaggatatatttaagcctgtcatttatattcttatctgtgtttttagcagcattattctctccacttcccactttttctcctgcttttattgatcttcatttctttcatggttgtctttactcattacatcctgaattttgccagattattttttatcactttattttgtatttattttcaattatgtcttctaaatatcatttcagagagaaaacattttagagaaggcatatttttaaaaaacagaaaatttgatcctattttttactgcttcatggtataatttgtatgttctgtaccttatgtaattttccctttttcttctagtatttttataaaggtcatcaagttttatttttgtaatacaattattataaataattatataatattattagtctttgaatattctagatacttgtgaaaggatattgtggaggaggagctgggggtagtaagtatgatggaaggcagacgagttttggaatcttgtctccaaaacactctcatctgttagaatgactccttggctataggattgactatggcttagagtggattcatagttgttaatttggtcatgtgacttgtgacttatccttttcttttcataatagaatgaaaattgccatctgtctggcttcttccccatctttttgccttctttcattacaccacacacgtgtcctaattattccaaaggtgatacatttgcatgtttccctttaaactcctttccctctgtcactctgtggagggttcacatgctgcaatatttctgttccaagtaaagatcacaggttttgatcctcagtcctcagtatacacacctcttttagggatttctgggcttcttgactagctcaagctcttcagaggcatgcactttatcttggtgttcagtcttgactggtttaaacttttgatgtccagaaggttttcttcatttgttgttgtgtggaattggaaatattttctagcttttgtaaggttgtggctcatatttatatttctcctggtttgaaagaagagagagaaagaagtatctcaaattgagactcttagattggaaatctgaatttatttacacgattgagattgatctagagttttattttttctgctgtaactgaaatttggattcaagattatatgtgttttgtgaatatgtttggtaacattgtgacttttctataatttagggaagtttgatgtaggagaaagagaaaaaatttttgagagaatcctaaattcatatatggcctaaccttttaatatctatgtaattttagataataaataatttgtttgagattatgtggctctaacaacacctgcttcacagtgtaattatgaggatttcatagaatttgtatagtgagcgttagttttgatgttactttaaacctctttgccttatacattctattttttccatggaatattatatgatttcatgtccacatattaatctcatactttcaattacattttatgtttaaattgaatattatggtaatcgttatgtaaatgattaaaaatttaaagggacaacatttaatgttgctctggaattcacttttagtcataaaataaagatttaaagtatcatctgtagacaatggcaaaaggccttttttgtcataagaaaatcaaatatgctttatttcacccaattaacagtttctgggcttggccatcccgggaaaaccaaaatgaccataggcggtaattccccaggccgtgtgatctcagtctggcattctcggatctccaaggcatcactttggccactaccctctggggctgtgattagcagctctcttcctgttttatgcagctctgtgtgtatgtctgcagtgatgccgtactggatctggttcatcttgagagaactatacctatctgaatttttgatgatgctgttttcttagttcccttggcaaaacaggtaggtgagggatagaaataaaatctatacttagtaaatcggtgagccaaggtctgtgactggcaatgagtgaattacattctcctcagttgggtgcaatgtctgccttctgtgtggccatttgctgttgccactagagaaggaggatgcagcagggatcaggcaccgtggagaaaagtcgccgtgtgtaggcagctaagaatgtaggaaaatgaacatctcggctcccaaaggacgagaataaagctgtagaagaatgtcagggaggaatctgagttgatagtatgactattcatccttcttcccacattttcccgactgtttagccctacttttcttcgcgttgggtctcattttccttcctgtgtggcctgtgccttatggtcagctcggacgtccatcagtctatcaaatgcctagaaacctttcgccctttgtcaccttctgtgtcacccagcattccccttctcagcccttttcattctcatggtggaatccttttggtttgatttcaagggtccagcactgttgatgtcacaacagagtggcatggaaagtttctgaaaattttgtcatctaacctctcgtggggacttttaattaattcagcttttgacaactccatcacattcattatattatccattcattcattcattaatacatttgacatttataatgtgtgccaacaatgtgccaggtcaaaactgcccacttacaatgtagaacatttctgtaaattttatttcaattttcttgtatttcttctcctttattctaccatcccacttgatcttctgccacagaagttctcttctctctctctttgttctctcttctcctcctttattcttgatacctgcttctgtgttggctcctctaggccagcacttgtcctcctacctctgtgatgttctgtctagtttattggttccttttcctactttacataatcaatgtggatagtttctatagttgggtctttgctttttaatcttttttcctgtatattatttccttcagggaccttatgcagtcttacacatccgtccattatttttatatggattactatacaattacatgttgaatttgtacttttcccccatatatcctgtcatatgttttcacctgagcatctcaatatctaatactcttatttgcttaaaatacacgtgattattttctccacctgacatattttatgttcaactttctaatttctaaaaatggacctaccattgtcctatgtattcgtgcttaaatcttgatattttctttgagttcatgctccttcgtattcactccagctgtgataagtcaccaatcctttgggtttttacttaccagtatttctatttctgtttccatagccttaaagctggaactgtgtagtcccagttcctctgtgtagccccccaagtctgctctatttcaatcttctcttaagggaactccttccctccgtttttcttttcctccatttgatacatcgcatttatagatggggcatcttccctaattactggcttcatcctcaattcccgggacccataccttcactggctccctaaatttatttaataattctcatatacctttgagaagtttctaatgataggcaacaaatgaatcttgactacctttcttattttcctttcttcaccaaaatgatttttaggatgtagacaatctgtatgcttcaacatacaccaaacttaccatttttgaaatattttacaatctacttgaaaagacttctttagaccctatattcatgtattgtaatatttatcctcttttatggctatactcaaatgccacatcactatagtgccttccctcatcactgtagctatctcttttcactctacttatattgtagaggatttgttacacttcttgaactgctgatctcaagcgatttgcttgctttgacctcccaaagtgctgggctgacaggcgtgagccactgcacctggcctgatttgttccacttctactatatgcatcacacatgcctgatgcatattttaatgcacgttggataaggatcggctttgtacgacttcagtctttcttgatgtgtgacacccacttctattttggctccactttaacaaaatgaataagtgagaaggtaatactggaaacagaacataactgtgactaggaatttggtcttgactcgccatttaattttctgatgtgcatgactgttttcttcacatgtgaaatttaacatgaggttgaaactggagaattttatatttttcatgaaaaaggcaatttgggagaaaagtccattttcctgaggataaggtattgtatggtttgactgctttgccttggctggtcaacacatttgtacacctgaataggcacagttttcagaaatcctttcaagcatctaccaattctcctgtctacaaatttaccttcctcccatttctcattcctaatgacaagggaaatatccagtgttatctgaagtggtcataaaagactttttttttctttttatgtgaggaattgaaacttatggctttagattatggggcttaccatcaaggaaagggcgtagcgtggtcagaggacaaaacttcttcctgcatttctcaggaagtctttgattagtgtgtccacctaggagcaatttttttttgcggggggtgctgggaaatatacttaagtgattaaatccaagtgtagacatgagagctttacctaaagccaggtctaattaccatacctgagaatcagggagtatttaaaatttgagaaataattttctatacttgaaagtcacttatgtaggtagccctcagattataataaataacgtttattgtgctatactatgtggtaggtatgaggttaagtatttttacctatattatatcacttatttcttacaaatggagcaagggagcaagcaagcaagggaggtattattatccctattttatgtatttatgtatttatttttgatttctattcttttggtttttttgttgttttttattgatgtatcatagttgtacatgttttggggtacatgtgatatttttgatacatgtatacaatgtgtaatgatcaaatcagagtaatttggatattcatcacctcgaatatttatcttttctttgtgttgggaacattataatttttctctgctagctattttagaatatataataaattattgttccctatgatttctccattgtacaattgaatactagaatttattatgtctatctacatatccccagttcaataactataatttctctgctgtgcaatcaaatactagaacttcttcctttgaacgctatatccctaattcaataacaagtaaactgaagctcagcatggtctaggaactttgttacgttaacacagcaagtgagtgttgcagcctggatccaaaaatcaggcctggtcgacctcaaagtccagattattgacctttctaccataatgtatggaggtaagtttgtgaatttattcaaaaatcaggcctggtcaacctcaaagtccaaattattaacctttctaccataatgtatggagctaagtttgtgaattttcatagttttaggatttgaagataaaagaggtgaaaatttggaaacggtttctggacttttgaattttggcaaacagctatgtgataagtccaccctgcagacccacaacttttggaaataactctactgtgaccttcagtagcagaagctgctcctggggtggtagaacacaaggaaaacacacactagtaaaaatttcatgtggcttctttgttctgtacatgtgtttctcttgattagtatatggtagtatcctcaaatcatagtaacaagtatactttttccagtgaattgcatgtgtatattattgtatagtataaaaggcaatatttccatttattatcatctgtgcttttcaaagaaactctgtgagtccaacagggcagataatagaagcaactgccctttctctcccccgttaaatgcaacccaatgtcaaagtccgtagcatccccaaatgagtgtgttaaaggtgagaaattcccagagtcaaactcagtagcatccttgaatgagtgtattaaaggtgataaatttattttatttatgttctttttaacctgtgttctcagaaacagagactactgtatttcatcctaccttagtcttgcttagcagtttctcttctcctttgaggctcttttatttttaaatcattatttatatcttctaatttcccctttctcccattcttcccatatttttaatctttttttaactttatctctcttctactttttctgtatttcaaattgatccatagactttagaaaaatgagttgaatgctggctgtaggctgtcttatccccagcaagaaacatgttgtaaagtcttagtaccttcccactggaagatcattagtcatggctactatgtttttaaatgagaattgttttaattatgcattttaaaattattggaaaacatgagggagaggaatgaaccataagtaataaagattattgacttgaagttaagaccttactatgatctgggattattagtcttacttgtcaatcaagaactatccactttctatttgtttgtgggtatctaatatggttatatacacagaagtaatgataattgatatgaaaaggtctcctcctgttatatcaatttaggtatttttcacacattgtgtacctcattcttctcctattcaattttcactaattcctaaagggtcaggtcaatgtccttggcataacctcctccacctgttcttaatggcaattgtatcttctgccctccaatatctataacacttttttctttaaaactctttgaatgtttatcttaatactcatttgatatatattgtataccacatatgattgtttgttatatgtacaatacatgttttttcaactttttttggttctttccatttacaggaattagagaaagaactaatcagtgtgaaggagaattgtcagtaaaattacaagaaaagattgagatcataattgacctttgaggataataaaatttaaagaccaaaaggatggacttcacagaaacatgaacttaggttgtttttgcagttgtagtaactggttatatgaccaacaaaatatgaagaatgggtacaaattctgatagtaatgatcagtcactttgcaaatataaagttactatttactactgtattgtacaggttcaataatctttgtgtacacattttatgtatttattgtcaggctgctatataattcagtatttataatagatactatgtatagcaatctatggttagttttggtcttaaccaggaaaaatcactcttttgagttttgctgtttttaccagattatttttactggatgattgctcatattatttgattattattgcaatttgtctttctggaataggaagcaagaggcctgaattctggttcctattctatcaattgtgtgaattctggaaactcagtttacttttctgggcctcatgtttttcatctgaatgatgaccaacttggattaaatggtttttatataattccgtaggcatttcccttcccaagggcttgagtctttttcaacagttatagagttttccggtccctcttcccagtgcctcggcaccttgctattcatgttcatctgatcagttgtttgcacgctgacttacattaccctgatgggcagtacctgtggctgtttctgctccctcacccagtccataggcttctggttgtaaaaagtgtgcatcttgagactgtggacagttagctccagaggtgacagtataatcacttcacgtagaagaggatagagagagactcatgccagtggtggtgagcaagtattagagagatgatgtgtgcctctgtgagttttggggtctaagataaattatggcactaggaagatggtcctttgtgtcagaagaactggagttgttggtgcaaaaaagtatgatgtcagcatagcagttttatttgtacctcagcaacttctaaaataatctctattaagtgttttcaggaactactttctactataggaaaatgattgaggtgagtatccatctggacacagagaaatataacactgttttctgctcaccgtccacttcacatataaatacaatatgtgttaaaggactaaatttctagtgtcacagtttgtactttatagtttgaagtcaataagaaagctcatataccttcctaaaagtcacttgttaatgtttgatattaatctaattttatcataaattaaaagtataaaactacaaatttcttaaagataaaatatccaaatggattcagtcaaattaagcatgataatatcaaatatcagaataggttaccatgcaggaggtactgagtacttaaaagggtggggaatgcaatgaacataaaagctggtaccaaggggaggaggagacagtgatgaattaaaacattatcttaactaatccaagtgctggtcttcaatactttcatgtgtatagacaaagagaaactgcagagatttctcacaacctctgtggccattttatgcatgtatcttagcagaaacactggtgaaatccctccaaaacatatttattaggcatggaaaaagccttacatgacaggtggcataggctccttatgaaatcattgcaggatgggaagccatttagggctttgtaattgtgaaagatttatagaaactgaggcacttaaatagcagtaagcatgagaaaatgtggtagataatggtggtgattctatttcttgtgaaagtccacttactctgttctgctacagttgtgggctttccgatttcacataccccggtctctatattctctcaatccacagcctacctcaactaagtccgtcccaggcacctcttactgcagtgataatccatctgttaatcatgttttcctcttatgtctactttctgtcagagaattgtgggtgcaaactgggaagggaaggaaattataagaatatgtataagtacaaatggaatatgttggaaatgaggaatagttaatatcacaggtcatttaaacacctgatgaatttcatggatagtcaggaatcttgttcttacctaatctgttaattttagatcagacattacactgaaagtattgatgatgggtttaaatcaggttgcagctcacatgttgtgataatattatgttgattttttgtttttaatatgtgaggaacagaataactgtatactatttattcatagtgacattgcaatattaatgattttagtacatattattatcttcataatcacaatttcctccccattttcttagttctcataattttagccacagcccagttggctggaccaatggatggagagaatcactcagtggtatctgagtttttgtttctgggactcactcattcatgggagatccagctcctcctcctagtgttttcctctgtgctctatgtggcaagcattactggaaacatcctcattgtgttttctgtgaccactgaccctcacttacactcccccatgtactttctactggccagtctctccttcattgacttaggagcctgctctgtcacttctcccaagacgatttatgacctgttcagaaagcgcaaagtcatctcctttggaggctgcatcgctcaaatcttcttcatccacgtcattggtggtgtggagatggtgctgctcatagccatggcctttgacagatatgtggccctattaagcccctccactatctgaccattatgagcccaagaatgtgcctttcatttctggctgttgcctggacccttggtgtcagtcactccctgttccaactggcatttcttgttaatttacccttctgtggccctaatgtgttggacagcttctactgtgaccttcctcggcttctcagactagcctgtaccgacacctacagattgcagttcacggtcactgttaacagtgggtttatctgtgtgggtactttcttcatacttctaatctcctacgtcttcatcctgtttactgtttggaaacattcctcaggtggttcatccaaggccctttccactctttcagctcacagcacagtggtccttttgttctttggtccacccatgtttgtgtatacacggccacaccctaattcacagatggacaagtttctggctatttttgatgcagttctcactccttttctgaatccagttgtctatacattcaggaataaggagatgaaggcagcactaaagagagtatgcaaacagctagtgatttacaagaagatctcataaatgatataataagcccttctcattaaacatgatatggctttatgtttctttctttgatattttagattcaggaactatgagacattatgtattgatttgaatgttattagacctgtaacataattcttaactgatgaatatatgatgaatatattccttgttcaaaatgagtcataaattcaacacatctctacatctatattatgcccatttaatttctttcagcaatgttttgtagtttttggtgaacaggtactttatgcatatgtactttatatttatctctaagttttatatttctgatgcccttttaagtgacatttttatttcaatttacaattgtttattcttagcttatgggcacataatagatctttgtttgacattatatcctgtaaacttgcaaaacttattagttccatcagttttttataggttatgtaggattttctttatagatgattatgttggcagtgaataaagacatttgcttttaaaattctagtatgaattcactatattcattttgttgaatgctgagtagaattagagcagacatctttgacttgttcctgttatgaaatatattaaatatttcatcattaagtataatgttagctataatttttttcataggtactctttaacaggctgagaaagttttctgtattcacagtttgctgaaaatttcttttatctttagtcaggaatggatcttggattttgtaaagctttttcgtttcagaatcagggtaatgctggccctttagaatgagttgggaagcatctgctcttcttaaattttctgccataattttgtagaattcatataatttttttctttaaaaagggaagtacttaagtattttctcccataagttacccataagtaaatctaaaggaaagtgggaaactttgatacgcattggttgccccctggtggagatttctgggttcttgattattttaacactggagatagaatctggtggaatgatgtcaatgctaccgtgattaagaggcgtgtaggaaatgcttcatgtaagagagaaaatagtctttatgagaatctgcctggtggaaaggagttggtgcaacaacaatataaattagtgaaaaattttaaattgacaaataataattgtatctatttatggggtacaatgtaatgttttgatacatgtttaaattgtggaaagattaggtctatcttattgacatacatatcttttttgtggtgaaaacatttaaaatctactctgttagtcattttgaaacatacaataccttgttatttattacagtcaccattctgtgcaatagttcactgaaactttgtctaactgaaactttgaacccttttatcaacatctaccttttccatgtctatccccaactcctagcctctgataatcaccattccattctctacttctatgaattcaacttttttagattccacatatcagtgagatcatgtgatatttgtcttttcatgcctggcttatttcacttagcatgatatcttctgggttaattcatgttgtcacatatatcaggttttccttcctattaaggctgagtagtattccattgtatatatacactacattttcttcatccatttgtcagttgatagacacctgtgttgatttcatatttgggtattgtgaataatgctgcaatgaacatgagcctggagatatctcttcagcatattgacttaaattcctttggatatatacaaggaagtgggattgctggatcatatagtaattctagttttagttttttgagtaacttttatctatttttcataatagtattaatttacatttccaccaacagtgtacgagggttcccttttctctgtatcctcttcaacacttgtcatcttttatgattttgatagtagccattctaacaggtatgaagtggcatctcactgtcattttaatttgcatttccctgataattaggatgacaaactttttttatgttagtcatttgtattttttttgagaaatgtctatttaggaccttgcccattttttgacttggttatttgttttcttgatattgagttgagtcccttatatatttggagattagcctttcatcagatgtatgctctgcaaatattttctcacaacttgtaggttgtctcttcaccatattgtttcctttgctgtgcagaagctttttagtttgatgcaatcccatatatttttgcttttgttgcctgtgctttgggggttatatccaagaaatctttgaccaaaccaacattgtggaacttttcccctatgttttcatctagtagttttacagttttatgtttaaacctttaatccattttgaattgatttttgtgtatggtgtgagataaggatacacaccatacacattcgtgttcttctgcatgtggatatctagttttcttaacaccatttattgaaacaaatgtctatacttcattacgttttctgggcacctttgtcaaaaatttattggtcataaatgcatgagtttatttctgggctccttattctgttcccctggtcaatgtgtctgtttttgtgcaagtgtcatgttgttttgattactatggttttgtgatacgtatttgttttggggggggatcgatttttatttgggtttctcacagtggttagagaacaaccacagcacaggaaatgcatcgccaagattgcccagaaaactgaccagctgcatcttattgcttaaaaatacacatattcacaataactgacaaatggtgatgtgcctcacacaggaatgtgttcacatttgcaatgctgtgtacagacttcacttcgttcaacatagattttggtttaatggaattcaaatgcggatgcttgttcacagccttggatttgtctgtttttggaaagatacaacctccatgagtatatctgcatgaaaaccacagacaatgaaggtatttcttcgttgacttatttattcttttgactgtagcaacaaaccctggatgacacccttccttttaattcacctggaaaccagactcaatcaaatctccctggtcccctcactattccttcaaattccctatttctatctcttcctgaggagggtaacctcctgtagcaggggtcacactgtgacttgggaatcaagcctaggtctgcaggttgccttttcatcttcttgtaaaatatggtaggacattgcagtgaatccaacagttaacactcagagcagttccctgctctaactcaggaaagagacttcagagggtcaggattcatccatttgatcagttaactgagaaggattcattttggtaaaacttgttcagctttgagacacttcagtgagttgtttgagatttttttttaaattatactttaagttctggggtacatgtgcagaacgtgcaggattgttacatagatatacacgtgccatggtggtttgctgcacccatcaacccatcatctgcattaggtatttaacccaatgctaaccttcccccagcccctacccccagacaggccccggtgtgttgtgttcccctccctctgtccatgtgttctttgttcaactcccatttatgagtgagaacattgggtgtttggttttctgttcttggattagtttgctgagaatgatggtttcctgcttcatccatgtccctgaaaaggatatgaactcacccttctttatggctgcatagtatccatggtgtatatgtgccacattttctttatgcaatctatcattgaatgggcattttggttggttccaagtctttgctattgtgaacagtgccacaataaacatatgtgtgcatgtgtctttatagtagaatgatttataatcctttggatatatacccagtaatgcgattgctgggtcatatcatatttctagttctagaaccttgaggaatcaccacactgtcttccacaatggttgaactaatttacactcccaccaacagtgtaaaagcattcttatttctccacatcctctccagcatctgttgtttcctgactttttaatgatcgccattctatctggcgtgagatggtatctcattgtggtattgatatgcatttctctgatgaccagtgatgatgagctttttttcatatgtttgttggctgcataaatgtcttccttagagaaatgtcagttcatatccttcacccactgatgggtttgtttgttattttcttgtaaattgtttaagttctttgtagattctggatattagccctttgtcagatggatagattgcaaaaattttcacccattctgtaggttgcctgttcactctgatgatagtttcttttgctgtgcaggagctctttagtttaattagatcccatttgtctattttggtttttgttgcaattgcttttggtgttttagtcatgaagtttttgtccatgcctatgtactgaatggtattgcctaggttttcttctagggttttttatggttttagatcttatgtttaagtctttaatacattgtgagttaatttttgtgtaaagtgtaagaaagggatccagtttcagttttctgcatatggctagccagttttcccaaccccatttattaaatagggaatcgtttccccattgcttgtttttgtcaggtttgtcaaagatcagatggttgtagatgtgtggcgttatttctgaggcctctgttctgttccattggtctacatatctgttttggtaccagtaccatgctgttttggttactgaaggcttgtagtatagttcgaagtcagacagcgtgatgcctccagatttgttctacttacttaggactgtgctagctctgtgggctcatttttggttccatatgaaatttaaagtagttttttccaattctgtgcacaaggtcaatggtagcttgatggggatagcattgagtctataaaaactttgggcagtatgtccattttcatgatattgattcttcctatccatgagcatggaatgtttttccatttgtttgtgtcctctcttatttccttgagcagtggtttgtagttctccttgaagaggtccttcacatcccttgtaagttggattcctaggtattttattctcttagtagcaattgtgaatgggagagttcactcatgatttggctctctgtttgtctgttttttgcatataggaatgcttgatttttgcacattgattttgtatcctgagacttttctgaagttgcttattagcttaaggagattttgggctgagaccgtggggttttctaaatacacaatcatgtcatctgcaaacagagacaatttctttctcttgcttgattgccctggccagaacttccaatactacattgaataggagtggtgagatagggcatccttgtcttgtgctggttttcaaagggaatgcttccagtgtttcaccattcagtattggctgtgggtttttcataaataggtcttattattttgagatacgttccatcagtacctagtttattgagagtttttagcatgaagggctgttgaattttgtcgaaggccttttctgcatctattgagagaagcatgtggtttttgccattggttctatttatatgatgaattatgtttattgatttgcgtatgttgaactagccttgcatcccagggatgaagccgatttgattgtgatggacaagcttttgatgtgctgctggatttggtttgccagtattttattgaggatttttgcatcgatgttcatcagggatattggcttgaaattttcttttttttgttgtgtctctgccaaattttggtaccagaatgattctggcctcataaaatgagttagggaggattccctctttttctgttgtttggaatagtttcagaaggaatggtaccagttcctctttgtacctctggtagagttcagctgtgaatccatctggtcctggactgttttttggttggtaggctattaattactgccacaatttcagaccttgttattggtctattcagggattcaacttcttcatggtttagccttgggagggtgtatgtgtccaggaatttgtccatttcttctagattttctagtttgtgtagaggtgtttatagtattctctgatagtagtttgtatttctgtgggatcagtggtggtatctcctttatcattttttattgcatctgtttgattcttctctcttttcttctttatgagtctggctagtggtctgtttattttattgatcttttcaaaaaccagctcctggattcattgattttttttgaaggtttttttgtgtttctatctccttcagttctgctctgatcttagttatttattgtcttctgctagctttttgtatgctcctgcctcttgagttcttttaattgagatgttagggtgtcaattttagatctttcctgctttctcttgtgggcatttagtgctataaatttccctctacacactgctataattgtgtaccagagattctggtatgttatgtctttgttctcattggtttcaaataacttatttatttctgccttaatatctttatttacccagtagttgttcaggagcaggttgttcagtttacatgtagttgtgtgggtttgagtcagtttcttaatcctgagttctaatttaattgcactgcgatctgagagactgttataattctcatttttttttttgcatttgctgaggagtgttttacttccaaatatgtggtcaattttagaataagtgcaatgtgatgctgagaagaatgtatattctgttgatttggggtggagagttctgtagatgtctattggatccacttggtctagagctgagttcaagtcctggatatccttgttaactttctgtttcgttgatctgtctagtattgacagtgggatgttaaagtctcccactattattgtgtgagggtctaagtctctttttaagtctctaagagcttactttatgcatctgggtgctcctgtattgggtgcatatatatttaggataattagctcttcttgttgcattgatccttttccattatgcaatgcccttatttgtctcttttgatctttgttggtttaaagtctgttttatcagagactagggttacaacccctgcttttttttgccttccatttgcttggtaagtattcctccatccctttattttgagcctatttgtgtctgtgcacgtgagatgggtctcctgaatacagaacactgatgggtcttgactctttagccaatttgccagtctgtgttttttaattggagcatttagcccatttacatttaaggttgatattgttatgtgtgaatttgatcctgtcattatgatgctagctggttattttgctgttagttaatgcagtttcttcatagtgtcaatggtctttacgatttggtatgtttgtgcagtggctgataccagttgttcctttccatgtttagtgcttccttcaggagctcctttaaggcaggcctggtggtgacaaaatctgtcagcatttgcttgtctgtaaaggattttatttctccttcacttatgaagcttagtttggctggatatgaaatcctgggtggaaaattcttttctttaagaatgttgaatattggcccccattctcttctggcttgtagagtttctgctgatagatctgctgttagtctgatgggcttccctttgtgggtaacctgacctttctctctggctgcccttaacattttttccttcatttcaaccttgctcaatctgacgactttgtgtcttggggttgcttttcttgaggagtgtctttgtgatgttcttcgtatttctgaatttgaatattggcctgccttgctaggttagggaagttctcctggataatatcctgaagagtgttttctaacttggttccattctccccaacactttcaggtacagcaatcaaacgtagatttggtcgtttcacatagtcccatatttcttggaggctttgttcatttcttttcattcttttttctctaatcttgtcttcttgatttatttcattaagctgatattcaatctctgatatcttttcttccgcttgatcgaatcagtgcttcatccttgtgcatgctgcatgaagttctcatggcgtgtttttcagctccatcaggtcatttatgttcttctctaaactggttattctagttagcaattggtctagccttttttccaggtccttagcttccttacattgggttaggacatgctcctttagcttggaggagtttgttattacctaccttctgaaacctacttctcttaattcgtcaaactcattctccatccagttttcttttgttcccttgctggtgaggagttgtgatcctttggaggagaagaggcgttctggttttcggaattttcagcctttttgctctggtttctctccatcttcgtggatttatctacctgtggtttctgatgttggtgaccttctgatggggtcactgagtggctgtcctttttgttgatgttgatgctattcctttttgtttgttagttttccttctaacagtcaggcccctctgctgcaggtctgttggggtttgccgtaggtctactctagaccctgtttgcctgggtatcaccagcggaggctggagaacagcaaagattgctgcctgtttcttcctctggaagttttgtcccagaggggcacccaccagatgccagccagagctctcctgtatgaggtgcctgttggcacctactgggaggtgtctcccagtcaggatacacggggtcagggacccacttgaggaggcagtctgacccttatcagagctcgaatgctgtgctgggagatctgctgctctcttcagagccatcaggcttttcaaggatgctcaaagtctgctgaagctgtgcccacaggcgccctttcccctaggtgctctgttccggggagatgggggttttatctataggtctctgactggggctgctgcccttttttcagagatgccttgcccagagaggagaaatctagagaggcagtctggctgctgtggccttgctgagttgtggtgggctccacccagttcaaactttctggtggctttgtttacactgtgggggtaaaactgcctactcaagccttggcaatgtggaagcccctccccccaccaagctcgagtgtcctaggtcaacctcagactgctgtgcaagaatttcaagccagtggatcttagcttctgggctctgtaggggtgggacccgccgagccagaccacttggctccctggcttcagccccctttccaggagagagaatggttctgtcttgttggcattccagttgccactgcggcatgaaaaaaaaaaaactcctgcagctagctcggtgtctgcccaaacagctgcctagttttctgcttgaaacctagggccttggtggcagaggcactggagggaatctcctggtctgtggattgtgaagaccgtgagaaaagcatagtttctgggtggagtgcaccgttcctcatggtacagtccctcggggcttcccttggctaggggagggaattcccccaaccccttgcacttcccgggtgaggcgaagccccattctgctttggctcaccctccgtgggctgcacccactgtccaaccagtcccagtgagatgaaccaggtacctcagttggaaatgcagaaatcacctgcattctgcattgatctcactgggagctgcagactggagctgttcctatttggccatgttgccagcaaattctgagattttttttaaaagtgcaaagaaggacatctgaggggtgctgacatattcgggtcacctcaagccacatgccagcttgcttgcccctgttggattcagcggagggagataggccttgctatacctgtggtgtctgccaaagcttcctcctggcaattcttgggagtgctgatacctgggccacagttagtccaagtttatcactgaagatcctatcaaagttttgtctgaaattccacttttgccttttgtcctaagtggttgtggacatctccaggggctgataccaaggactaggaacagctgagggaggcagaaaggttcagagtacatttctatttacagggaacagaacaccggcctccgagagtccatggagcaatgggaaaattgcagtgattgctcatcactgtgaaacttctactttgaatacagtatcttctggcaagcactggggactgcagtcgacaatgctgctgaatatacctgagtacatagtaagacatttgtttggtaaacagtcaatgcatacaataaattaccttgagagggccatctgtgctccagatgtgagagttcatgtgaatagaatggccacaattcaaagaatcttcacaggaaaacggctcagagctcatctacaatggacagacagggagggaaacaggtgaagattagttcaccacttcctcataagaaggtaataaatagtttggtgaaataaaatggtagcactgagtaattgcgggcttctggataggcagtcaggttgatttcatgttgctactgctagacttgagggctggcttggctgtggtggcagacacagcagcagctcaggatgatggtgatggtccatgccaaccagaaccatcaatgtttatagtagtagttacaacactgagactgcccatagcagtgtcctgttgtgtcacagatgtagctttgattgttggtacacacacaggcttccttatcctgtgggggttcagccctggctgacacagggctgggcagtgcctagaggtgcaagagcttcatgccacccaggagtcttccctccatactcctcctgctcctccgacccagcgcgggcacctccctccacccttgctgcacttctcctctaccctcttcttccttcttttgttcttttcctgtaatatgttttgaagtcagattgtgaggccttcagctttgttcttattgctcaagagtcctttagttattcagggtcctttgtggttccatataaattttcaaattgttttttctatttctgtgaagaatgacattgaaattttgataaatattgcattaaacctataaatcactttgggcagtaaggacattttaagaatattaattcttcctacccatgaacataaaatatctttccatgtattcatgtcatctacaattttttcatcaatgttttatagtgttcagaatacagatctttcacctccttggttaaatgtactcctaagtacaatcctaaatgtgctcctaaacaaaaaaaaatacggtttttttgatgctaccgtgaatgagattgatttctttatttttgtcatatagtttgttgtcagtgtaaagaaactactgagttttatacattgattttgaattctgcaattttattgaattcatttatcatttctaatagctttttggtggagtttttagggtttcctatatataatatgtcatcaaacagagacaattttacttcttccttttcaatttgaatatcttttatttctttatttggcttaattgctctggctaggacttccagaaataagttgaatagaagtagtgagaataaatatccttgtcttgttcttgatcttagcagaaaagatttcactttttcattgttgggtatgatgtgagctgtgagcttgttatatatgtcctgttttgtgttaaggtacatgccttctacgcccaatttgttgagagattttgtcatgagaggattttgaatttagtcaaatgctttttctgcatatatagagatagctattttttttatccttcattctgttaatgtggtttatcacatttgatttgtgtatgctgaaccatctggaggataaatccactttatcatggtaaatgttctcctaatgtgttgctaaattctgtttgctagcacttttttttgaggacttttgtatctatgttcatcagggatattggttgacccatacttttcttatagtgtccttgtttgcctttttatttttgtttttattttttcgtttttgtttttttattatacttcaagttttagggtacatgtgcacaacgtgcaggttagttacatatgtatacatgtgccatgctggtgtgctgctcccattaactcatcatttaacattaggtatatctcctaatgctatccctcccccctccccccaccccacaacaggccccagtgctaatatccagaatctacaatgaattcaaacaaatttacaagaaaaaaacaaacaaccccatcaaaaagtgggcaaaggatatgaacagacacttctcaaaagaagacatttatgcagccaacagacgcatgaagaaatgctcatcatcactggccatcagagaaatgcaaatcaaaaccacaatgagatatcatctaacaccagttagaatggccatcattaaaaagtcaggaaacaacaggtgctggagaggatgtggagaaataggaacatttttacactgttggtgggactgtaaactagttcaaccattgtggaagacagtgtggcgattcctcaaggatctagaactagaaataccatttgacccagccatcccattactgggtatatacccaaaggattacaaatcatgctgctataaagacacatgcacacatatgtttattgtggcactgttcacaatagcaaagacttggaaccaatccaaatgtccaacaatgatagactggattaagaaaatgtggcacatatacaccatggaatactatgcagccataaaaaaggatgagttcatgtcctttgtagggacatggatgaagctggaaaccatcattctcagcaaactattgcaacgacaaaaaaccaaacaccacatgttctcactcataggtgggaattggacaatgagaacacatggacacaggaaggggaacatcactttaaaaaaaaaaacaataatgctgatcttttaaaatgagtttggaaatactctttctccttcaagtttttggaagaatttcagaaggattgtattattattttttaaaatgttagaattcagcaatgaagttttctggtcctgggatgttctttgatgggagatgttttattattgatatactctccatactcagtattgttctgttcagattttatctttcttcttgactttctctaggtaagttgcatttttctagaaatttatctgctttttctaggttatccaatttgttggcttgtaattgtttatagtggcctcttatgatcctctgtatttctgtggtattagttgcaatatttcctctttcatttctgattttattgctttgagtattctctcgtttttctagtctagctaatggtttgtcagttttgtttatcttttcaaagaacaaattcttagtttcattgatctgttctattttctttcacagtcttttttgtatttgaaggactcgtatttgttaactggctcaagcctggaaatttgttgaggtgctatgagtctctattgctctcatttctcttcactagacatagaaattttctgattacacgaatcaaataagactaataagcttcccagggatgaatcccacttaagcatggtgaattcttttgctgtgtttttttaaaaataatatttgctaatatttggctgagggtttttccatctaagttcatcaggagtattggtctgcaatttatttttattatagtgtccttctctggttttggtatcagggtaatgctggttttgaaaaatgaatttggaagtattcctcttcttcatgtttctggaagcgtttgagaaggattggtgttagttatctaagtgtttgttagaatccagccaccgagccattcaatcctgggtctttcttttatgagagacctttcattggtgatttaatttccttattcacgatttgttctaaattttgaattcttcatgattcagttttggtacgagtttatcaatttcttctaggttatctaatttgctggtgaataattatttatagtagtatgttatgattttttaacttctgtggtatcagttgtaatgtctcttctttcatttctgagtttgttttcttttttcttagtctatgtaagaatttgttaattttgtttatcttttcaaaaaacaattcttatttttattgaaattttcagtttctattatattatttctgctctgatctttgttatttgtttccttctgctatctttgggcttgtattgttctctaattttctcgctcctttaggcataatattaggttgcttatttgagatctttttttcttttttgatgtaggcatttattgctataaatgtccctcttataactgcttttgttgcatcccatatgttttagtatgttatgtttccattttcatgctacctgattttagaatatatttcaaagcatggtgtacagtgcttttaaaaagaggctatatataggtatatataaaaacaatacacacattgtatataaactatgacatgcttgtaaagaaaagagaacataaagtttctgaggaaataattagaagaacaagaggatgcaaaggggtctgtcaaagattcagtgaaatgagggtttttggatattcacagctaatagattaatgcattaggaatgagcaaaaaaattgatggtagtcaaacagagggagggaggtagattttgaatgattcaaagcaggagtgttttgaagataaacagaataactaaaaagaaagactcatatgaaaagcctagatttaaagcatttgaatcaagaggtggtaatctaggaattaggttgatttctttttttttttaatttgtgtagctttttattttattttttattatactttaagttttagggtacatgtgcacaaagtgcaggtttgttacatatgtatacatgtgccatgttggtgtgctgcacccagaagactggttaatttcaataacctaaaaatccacaaggtgggagcgtttcactgaagccagttgttagagaaacgttagaaccaacttcctttttttctctgtcccttcttctctgctttcttcttttctcctcctcctcctcctccctttactctccttcttctctctctgtttttctaatcatgaaaacaaacgaaaaaaactatgagcaagagcacagaaaaaagactagcaaagactgcagttattgaaagtatcagatacagaaaataaaataactatatttagtatgtttaaagtaaaacaaaaaattaaaaatatcataatggaacaggaaactctagagaatggccaagaagattaaaagaaaacaaatagaatgtccatagagaataacataattgaaatttaaacccaaatgaatggtttcaacagaatattagtatgttagaagcagttaaagagtgaactagtaaactgtaatataggtcagaaggggctatccaaaatgaacacaggaataaggaaatggaaaataagaaacatgtagttaggagacatggaagacagagggggaaatgctaaaaagttttaaagagtgtttcagaaggagagaaaggagatcatgaatcagtgtatatattttttaaattttattttatgttctgggatacacgtgcagaaagtgtaggtttgatacataggtaaatgtgtgccatggtggtttcctgcacccatcaacccatcacctaggtatgaggccctgcatgcattagctatttgtcctgatggtctcctacccccgtccccctgagaggccctggtgtgtgttgttcccctccatgtacccacgtgtttgtcctgatggtctcctaccccctgtccccctgagaggccctggtgtgtgttgttcccctccatgtacccacgtgtttgtcttgatggtctcctaccccctgtccccctgagaggccctggtgtgtgttgttcccctccatgtacccacgtgtttgtcctgatggtctcctaccccccgtccccctgagaggccctggtgtgtgttgttcccctccatgtatccacgtgtttgtcctgatggtctcctaccccctgtccccctgagaggtcctggtgtgtgttgttcccctccatgtacccacgtgtttgtcctgatggtctcctacccctgtccccctgagaggccctggtgtgtgttgttcccctccatgtacccacgtgtttgtcttgatggtctcctaccccccgtccccctgagaggccctggtgtgtgttgttcccctccatgtatccacgtgtttgtcctgatggtctcctaccccctgtccccctgagaggccctggtgtgtgttgttcccctccatgtacccacgtgtttgtcttgatggtctcctaccccctgtccccctgagaggccctggtgtgtgttgttcccctccatgtacccacgtgtttgtcttgatggtctcctaccccctgtccccctgagaggtcctggtgtgtgttgttcccctccatgtacccacgtgtttgtcctgatggtctcctaccccccgtccccctgagaggccctggtgtgtgttgttcccctccatgtacccacgtgtttgtcctgatggtctcctaccccctgtccccctgagaggccctggtgtgtgttgttcccctccatgtacccacgtgtttgtcctgatggtctcctaccccctgtccccctgagaggccctggtgtgtgttgttcccctccatgtacccacgtgtttgtcttgatggtctcctaccccccgtccccctgagaggccctggtgtgtgttgttcccctccatgtacccacgtgtttgtcctgatggtctcctaccccccgtccccctgagaggccctggtgtgtgttgttcccctccatgtatccacgtgtttgtcttgatagtctcctaccccctgtccccctgagaggccctggtgtgtgttgttcccctccatgtacccacgtgtttgtgctgatggtctcctaccccctgtccccctgagaggccctggtgtgtgttgttcccctccatgtacccacgtgtgtgtcctgatggtctcctaccccctgtccccctgagaggccctggtgtgtgtttttcccctccatgtatccacgtgtttgtcctgatggtctcctaccccctgtccccctgagaggccctggtgtgtgttgttcccctccatgtatccacgtgtttgtcttgatggtctcctaccccctgtccccctgagaggccctggtgtgtgttgttcccctccatgtacccacgtgtgtgtcctgatggtctcctaccccctgtccccctgagaggccctggtgtgtgtttttcccctccatgtacccacgtgtttgtcctgatggtctcctacccccgtccccctgagaggccctggtgtgtgttgttcccctccatgtatccacgtgtttgtcttgatggtctcctaccccctgtccccctgagaggccctggtgtgtgttgttcccctccatgtatccacgtgtttgtcctgatggtctcctaccccccgtccccctgagaggccctggtgtgtgttgttcccctccatgtacccacgtgtttgtcctgatggtctcctaccccctgtcccgctgagaggccctggtgtgtgttgttcccctccatgtatccacgtgtttgtcctgatggtctcctaacccctgtccccctgagaggccctggtatgtgttgttcccctccatgtatccatgtgtttgctctcattgttcaactccctcttacgactgagaacatgtggtgtttggttttctgttcctgtgttagtttgctgacggtgatggcttccagcttcatccatgtccctgcaaagaacatgatctcatttattttaatggctgcagagtattccatggtgaatatatatcacattttctttatccaatatatcattgatgggcatttgggttgattccatgtattttctatcgtaaatagtgctgcaataaacatatgtgtgcatgtatatgtatgtgtgtgtgtatatatatgtagttataatatgtatatatatgtgtatatatatgtgtgtatatatatacacatatatatacatttacatatataatatatgtatatatgtatatatatgtgtatatatatgtatatatatgtgtatatatatgtatatatatgtatgtatatgtatatatatatatttttttgagatggagttttgctcttgttgcccaggctggagtgcaatggtatgatcttggctcactttgacctctgcctcctgggttccagcgattctcctgcctcagcctccaaagtagctggtattacaggtgtgcaccactatacctggctaatttttgtatttttagtagagatggagtttccccatgttggctaggctggtctcaaactcctgtcctcaggtgatccaccggccttggcctcccaaagtgctgggattacaggtgtgagccactgcacccagccctgtgcatgtatctttataatagagtgatttatattcctttgggcatatacccagtaaagggattgctggggcaaatggcatttctggttctagatctttgaggaattgtcacactgtcttccacagtgaatgaactaatttacattcccacaaacagtgtaaaagcattcctatttctccacagccttaccagcaactgttgtttctggagtttttgataatcaccattaagactggtttgagatagtatctcattgtgcttttgagttgcatttctctaatgatcagtgatttgagctttttttcatatgtttgttggccacatccatgtcttcttttgagaattgtctgttcatgtcctttggccaatttttgatggttttttttcttgtaaatttaagttctccataggagcaggtgctctaattgcttggaggtctgcctatgtgtggagatgagagggcctcactgcactataatctcagcacaggaaggttggggaagctcaggctgctgatccagtcaagtgggtgctccacatacctggaaatctgcctggccatagactggagagggccccactgcaccacaacctatgtttacaaacggtggggtagctcaggatgctggtccaggtagacaggtgctccaatgcctgaatttctgcctgggggtgaagcagagaaagccctgctgtatcacattgtcaggggaacaggctggggcacccagcaatgacacctgcagactggttgtaggtctccaagctggccctggctgcaagtttcatcacctgggagaaattacagctgtagcagcttttctgttgccccgaggctgcgatgggggaaagcacaattccagcacatactgctgaggtgtttcccacaatatggctgtgaaggtccctaccaagacccaaagcagttgttccaatctttggcctgagactaaaatgcctgtgcaggcattctgctgggtcacaaaaagaaaaaaaaaagctgactttgcatgcatccagattgaaaatggcatcttgctcttacttcctggtctgggaaaatgtctgcagctgttcccagtgtctttgcttcacagcatctccaagcctctccccatgttgactccaggccttgggagaaacaaaatgcaacaacttggctggggttgctcagattcacagtgaaaatgtcagttacagagggaggctctctgcctctctcacatactaggacttcgctcacttttataagctggttgctgtcatgttgactgtttgctcacattctccttcttgggatctatgatgtccttcatgattctggtggattcccattttccttcttgacttagagctcacagagttgacctttgtgcactctcttgctatttctaagtggccgaggcacactaaaagcctctaatttatcatcttgggaaaaaaacaaaacagggaagtttgcttttgcaaattgttgtttgtgggggtctgtcctgcagaccccagctgcacgagggatgaataatgtactcagacaccaattattcagtgaaagagccgctagggggctgggccgtgcacagaaagagttctggcagccacgagccctgactagctagccctgccagcatttattgaaaaaacattaaatgacaggggcttttagtcaacacaaatagagggtaattaacctggtcaccctcccccgagagagagccatcctgcctgtgaatgatcaaaggttggcttcaggaccacatgagtaaacaagttatttagataaactcccttacattcctttgcacctactttaagctatttactcaaggaaggattaggccgccttcattcagatctattactgaagctatacaacacccccagccttccatgaaggtttgtgtcgatttcttataactatctttaaaatttttcccaccagcctgactgaactcccacagttgttgctactttttgaaattgaaatacttctaggaagactgattaagaacaatatagagaaaagacatatttttcaaactcctgatgaagaagaaacatccgtattaatatatagctaataaaaagataagagatgttgtggaaaatttcatacaagggtgcccactctcagaacttctattcaacatagtactggatgtcctagccagagcaattaggcaaaagaaagaaataaaaggcatgaaaattggaaaggaagaagttaaattgtttctgtttgcagttgacatgatcttatatatagaaaacaccaataactctgccaaaaaatttagaattcataaatgaatttagtaaagttgcaggatacaatgtgaacatacaaaattcagtagcatttctacacatcaacaacaaactatacaaaaaaagaaatcaagaaaacaatcctatttataatagcaacaaaaaatacttagatgtaaatttaaacaaagaggtgaatgatctttacactgaaaactacaaaacattgatgaaagcaattgaagaagccacaaataaatggaaagatatctcatgttcatggattggaaaaagtaatatgtttgaaatgttcatactatccaaagtgatgtacatattgaatgcaatctctaccaaattcctatgacattttcccacagaaatagaaaaacaactctcaaatctgtatggaatcacaaaaaactctgaaaagccaaaagaatcttgatcaaaaaaagcaaggcaggagatatcacattacctgacttcaaattatactacatagctatagcaatcgaaacaccatggtactggcataaacgcagacacatagaccaattacacagaataaagagcccataaataaatctacatattatagtcaattgactttcaacaaaggtgccaggaacacacatggggaaagaacagtctcttcaaaaaaatggtgttgagaaaactgaatgtccacaagattgatattaggcccttatttcataccatataaaaatataaactcaaaataagttagacttaaatgtaagacctagcactatagaactcctagaagaaaacaggggaataactccaagacattggtctgggcaataatattttatgatatgactctaaagcacaggcaagaaaagcaacaaaacacaaatggaatagcatcaacctaaaaagcttctgcacagcaaaagaaagtcaacagagtgaagtgataacctacaaaatgggagaaattatctgcaaactatacatttgataagaggctaatgtccaaaatatcttaggaacacaaacaactcaataataagaaaacagggaaccctaatgaaaaattgacaaaggatctaaatagacatttctcaaaagaagacatacaaatggccaacagatatataaaaatgctaattatcactgatcatcagagaaatgcatattaaaactacaataaaatgccatttcacatccgttagaatggctgttacagaaaaggcagaagataccaagtgttggagaggatgtggagaaaaggaaaaccttgtaattgttgagaatgtaaattatttcagccattgtaaaagacagtataaatgattctgtaaaaatagaattaccatatgatccagtaatgctatttctgggcatatattaaaaagatatcaaatcagtgtgtcaatgagttatctgtactcccatatttattgtagcattattcacaacagccaagatgtggaattaacttaagtatccatcgacacatgagtggatgaagaaaacgtggtacacatacacaatagaatagtatacaaccttaaaaaataaaaaaagtatcatttgtgacaacatgaatgaaccgggaggacattatactgagtaaaataatccaggcacagaaagccagatactgcatagtctcacttgtatgtggaggtctaagaaggctgaacacatagaagtacagagtagaatgatggttaccaggaggattgggtagatgttggtcgaagggtacaaaattgcattgtacaggaggaatgaattcaacagatctattgtgcaatatggtgactatagtggataacaatgtattgtttttaaatttaatttttgtgggtacatagcaggtgtatacatttatggggtacatgaaatattttggtacaggcatgcaatgtacaataagtacataatggaaaattggatattcatcccctcaagcatttattatttgtgttataaacaatccagttatactctttcagttatttttaaatgtataattgaattttagactgcaatccccctgttgtgctatcaaatactaggtcttattaaatctttctttttttgtacccattaaccatcccccacctctcccaacccccactacccttcacagcctctggtatacttccttctactctctatctccatgagttcagttgtttgctttttggattccacatataagtgataacacatagtatttgtctttttgtgcctggcttatttcacttaacataatgacctccagtttcatctatgttgttgcaaatgacagggtctcattcctttttatggctgaatagtacttcattgtatataagtaccacattttctttattcattcatctgttgatggacacttaggttgactccataacttcgctattgtaaatagtgctgcaacaaatacgggagtgcagatatctcttcgatatactgatttcttttttggggggtatatatgcagcagtgggattgctggaccacatggtagctctatttttacttttttgaggagccttcaaactgttctccataggggatgtacttgtattcttcaaaattgctaagagtagatttttaagtgttctcataaaaaaagataagcatgtaaggtaatgcatatgttagcttaacatggctattttacaatgaatatatatttcaaaacatataattttatttatctgataaaataaatataaaatatgaaactttatattaataaatttgacaatcataaggaatggtcaagttcctatgaaaaacacctacttttatgaaatgatcagaaaaaaactagaaaaactgagtagtttttttttcattgtagaaattttatttagaaaatttttttttcctgtagaaagaactccagggctaggtggatgcaatatttaataaagaaatattaccaaatatttaataaagaaataatgccaatgttacatgaatatttttagagaattgggaagacataacactttccaacttgttttatatggtggtacctccatgataataaaaccatacaaggatattaaaagaaatgaaattacagactaatatactacataataattctaaacaaaaatgtttgcaaatatccaacaatatactccaaagaaaaatacatcgtgactaagtgcagtaatttcaagaatgtatggtttaaaattagaaaaccaaacaatgaaattaaccacattaactgaataaaagaaaaaaatatggttatttcaatagctgcgggtaaagcacttgttcacatttgaaactatttgtaataataacaagctaggaatagaagagaactgatgtaaatatcttaatatatacacaaaaactactctcaacattataaataatcatgacatattaaacagtttcattctaacacgaggaacaaggtacacatgtccagctcaacactttattcatcattaaaataatactgtgcagtaaaattaacaaggaaaatttttaaaaagaacacaaaagaaaactacaaatccttatccctgatcaacacagatgtaaaaatactcaacaaaattctagcaaactgaagctaacagcacatcaaaaagataattcatcatgatcaagtgggctttattccaggggtgcttgaatggttcaaaatagacaaatcaataaacatgattcaccacataaatggaactgagaacaaaaaccctatgatcatctcattagatgcagaataagcatttgataaaatccaacatctgtttatgataaaaaccctcaacaatataggtatagatggagtatacctcaaaaaatgagtcatctatgacaaagccacagccaacatcatcctggatgggcaaaagttggaagtgttgcttctagaaactggaaaaaagcaaggatgttcaccttcatcattcctattcaatacattactggaagtgctagccagaactatcagaaaggagaaagaaataaaaggtatacaaattagaaaagaagtcaaatgatctctgctcactgatgacatgactgtaggcctggaaaaccctaaagtcttcagaagactcctagacttgatacacgacttcagtaaagtcttgggataaacaagccacaaaaatcagttgtatttctatacaccaaaaacattcaagctgtttgaatgtttgttgagattaatttgttgagaaccaaattaagaactcaactgaatttacaatagccatgaaaaatacctaggaatgcataactatataaatgaaagatctctacaaggagaactacaaaatactaatgaaagaaattatagatgacataaacaaatggaaaaacatcccatgctcatggattagaaaaatcaatagctaaagtgaccatatcacccatacaatctatagagttaatgcaattcccatcaaattatcaacgttatttttcacaaaattaaaaaaaaatcctaaagttcacatggagccaaaaaagatcccaaatagccaaagcacttctaagcaaaaaacaaagcaaaacaaaacaaagcccccagagcaaaagacaaatatggttcctacaaatgaagaccaatggtaatgcttatctgttcgtggtagaagtgtgaattggtaggattgttaaaaaaaatagtgtagcatttcatggtaatgttgaataactcaataattttacttttaaatatataccccagaggatatcttgcacatatgaaccaggtgatttacaaaagaatgttcatagcagcattgtttgtaatggttaaaaactggaaaaatttcaagtgttcatcaacaatagatctgaggaatgaagtccgacatattcatgtagtggaatatcatatagcaatatgaatggatgaattacagcaacattcaacaaggttgtaatatgcaaacttattgaatcaaggtgaaagtaccttctgataaaggtgaaagaacttctacaaaataatttcatttatataagtttcaaagaaccaaactaaataatgcatcacttgagaaccattaaagtctattaaaaaacacatacaatgcaatggaaggacagtggtcatatccagcaggaaataaaggagaacacaattggcaaggagcacccaatgggtgtctaaggcactagtaaagttctattttgtttccaatcctccaagacatctagtttttttatttttctgagacatggtggcccaggctggagtacgatagtgtgatcttggctcactgcaacctgtgtcctgggcttaagtgatcctcccacctcggcctcccaaagtactgggattacaggtgtgagcaaccatggccggcaaatgttctatttcatatcctgtatggtggacacatagatgttctcttttttattattccttgaacactaagtatatgtttttttatattctctgtggaatacctccttatttctcagtcaattcaggatacctccttacccccatcccctttttacttttcgtcatgtcatatagtttctgagatatagaaaagcttacatattatcctgtcatcagagcggcatggaggcatttggtagaataaatattatttgttgattattcatcctttcactttacagagtcaatcaaacaccaggtcatgttaattttactgtcacacacatttcttgaatttgcctccttatctctatttccactattcagttcagaccttgatcatcactcatctgcattgtagttgcatttttctaattattctgtttctagtcttgttctaaaatcttttttcctcccacaatgcagctagagtggtcaatttaaagcatcatctatctcaagaacaaaaaaccaaacaccgcatgttttcactcataggtgggacttgaacaatgagaacacggacacaggaaggggaatatcacacaccggggcctgttgtggggtggggggaggggggagggatagcgttaggagacatacctaatgtaaatgatgagttaatgggtgcagcacaccaacatggcacatgtatacatatgtaacaaacctgcatgttgtgcacatgtaccctagaacttaaagtataataaaaataaatattaaaaaaagaagcatcatctttattaaaacatttaatggtccgactattccttatgctataaatttcttataatttaataaatatttttccgtaattgtgactctcttctatagctcttgttactcccgatattcttctaattatcaggcagcagtacaaagctgcttacacctctttacacatctctttattttaggcctccttgcatttgctcatgctgttcctttttgtttgaaaagcttacacatttcttcatttggttaatccttgcacactttcaagactcatttgaggcctcattgactttggaaaccttccctgtaatcttgtattattaacttatcttagttttcacttattagctcttattagattactgtccttacgtgtgtaactctcccactagacagtaagcttttggacggcagagatgatgtctcattcatctttgcatctttagcgcccagcctggtttctggtttcctatagtcactcagtgttgagctaaaccatatttttggggcaatgacttgacaatgcagtatcatgatggaactatcacagatggacagaatgagtctcttgattcctacatttatttttctattgatatagctgatttaaaaagaaacctctgttaattatataatcatgtaattaccctgacataacatcaaactccataaattactttccatctctgcctctctctctttctatatatataacatatacatgttacaaaaatgcacagggaataaatatgagcaaaatggtaagaagtgcaggttctaggtcagatttcctgcatttacttgcaggctacgccaactttagagaaaagatttagtgaaaaataaaaatgaatcattaatacaccacttggcaccgataagttattcagtaaacattaacatatgtgcatttatgtttaaccaggggcttaagtgattatccagaaatctccctctctttgactatgtttgaatattagatacttcttaatttatgtttgctctgaatttgttttttttcactcgttgtatactcatggaccattttatgtgtttcaggaattgaaattttatttaaaaactgttactatagaaattaacttttggatagtcctgttcagactaaaactatcatttgtaagatctgtattactgcaatcattggtgttaatactttgcattaattaaaattttttatggacatataataagtatttctcccacctcgatttttgtggctatcattttattcattccattgcttttttctcccagtttgctatgaggaagttgataagtacgtaggcaaaacgatagattgttttggcagcttcagtgtatttaagtgcctgtgatgaggctatggtttatttttctaatgtagaattcataatgtagaataaattttaaaaacataaattttttttcctgcacattgtgcacatgtaccctagaacttaaagtatgataaaaatatacatatataacaaattaataacataaatttctttgcacagctttttctttctgctatttttattcaatgattatttgcttcccttgttatttaagagctgacttctggcttcatggccaaaaataaaattcttagtaggagaaagtaaatgtaatttactgatgaagatgccacccccaagtgacccattaaccactttccctacgttaccctgggacaaccaaagtgattccaggaggcaattcccgtgacaagtgatttctggctggcaatgccaggtctctgaagttccacttggccactgcccaagaacaattagtgccgttagttaactacctttactatgacagcattttgtgtaactctttgcacaggggagttttatgcaacagacagaaactttctgagttgttctgattgcctgaagatgccctgttttagaggagcaaaattttccctgtttactgtgtttcagtgttaaaaatatgaatgcattgtcaggattagctctggcaatggtagttaaatgcagatatccagacaaaggaggttatagattggagactttgtgctacttgataatgaagccttggttttgattttatttatttttaagttgaaaaacaaaacacacacacacacaatacaaaacatggcacaaaacaaacttatagtttgatttttgtaaacatccctgtaatcatcacataagtcaagatataggactttgccagccctgaagcatgtgactctcctcagttgcagccacctttctcctgaaaagtaacgataaacatgactgttccagtagaggtgtccttgcattttcacggctgtgtccttcctgcatgcattccaagacactatgatttagtcttgcccatttgttttcatttgtcgtgtttttaaaatcccttctaacatacaggtttcttttcaaagttttctttcccatacaatatatttgttgaaaaatttgggatttttgtcacttggtgtccacactgtgaaatttgctggtgagactctcagtgaagatcgacattttcactatcctttgcgttttatccaaatgacagttgaatccagaggtttgactaggacacgtgcttggttctatttttggtaagattgtaggtgatggtgtgttcattcaccaggaggtttaattatggcttttatcttagcacctactactactttctactaacacctgttaatacaaagaaagttaatattttctactagcacctgttaattttgttgatctctgtataattttttaattctcaatttcatttatctctgctctaatcttcatttccttccttctgctagctctggattttgtttgctcttccttttacggtttattgagtaaagtttggttattgatttgacatgtttcttttttaaaatgtaggtgttacaactctgagcactgcttttgatatatcacacccatcttgttatatatttgttttcaatcatctctaaacattttctaatttccctcatgatttgttctttgattcattggttggtaaatactgtgttgtttaatttccaaatatttgtaaattttctagtttttcttttgttattgatatcttatttcattccattgtggccagtgaagatactttgcatgatttcaatctttttaagtttattgagcttatcttatggcctaacgtatcatctgtgctggagaatgttccatgttcacttgagaagaatgtgtattctgcagtttttgagagaagtgttatctatagttattgcttatagttttattcaaatcctctaattcctcccttgatatttgctctggatgttttatcttttatttaaagttgggttttcaaatgcccaacaattttcgtggaattgtctgtctctccctttaattctctcaatggttacattatatattttggagccctgttagttggtgtacatatatttataattgttatatcttcttaattaattttgaaatcaatatatactgttctttgtattttgtaacagtttttgacttaaagtctattttgtctgatataagtatatttgcctcagatctcctttggttattacttacatggaatattttctcccatcttttcatttcaactcattgtgtattttgatctaaagtgagtatcttgtggacaatatagttggatcatttttaaaaaatccattctgtcaatctctttctttggattggagagtttaattcatttgtatttaatgtaattactgataaagaggggcttactcctaccattttgcttttgttttctgtatgtcttatacctcctttgttcctaatttcctcaattatcgccttcttttgtgtttagttgctattttgtagcatatcactgtgtttaccctctgctttccttttctgtattttcaaaagatattaacttagtggttaccatggggatttacaattaacattcttaatttggaacaatttagagtaaattgaaacaacttcaatagtatacaaaatctctattattatttagtttcctatgaatttctttatgttggtaatttcacaaaccacatctttatacatcatgcttcattaacatagatttatagtcattattttacacatttgttttaaaacatatagaatattaaaaaagacttacaaaaatgtgataattgcttttatatttacctatgtagttatctttactggagttatttctttatgtggttttgagttactttctagtgttttttagtttgtatgtgaaggagtctttttttttaaagtgtatcttgaagtacagcctaccaaacatgaacttttaaagcttgcttgcttttctttctttctttctttctctttctttctttcttttttctttctttctttctttctttctttctttctttctttccttctttttctctctctctctctctctctttctctctctttcttcctttctttctctttcttctttctcttctttctttctttctttctttctttctttctttctttctttctctttctctctctctctctttctttttttttaatctgggaatgtgtaatttatccttaatacttgaaggggcatcttccaagttatagaatttttggttgacagtgtttttttctttcagaactttaaaatgtcatcctaagctcttctggcacccatggtttataatgagctctctgctgtcaaacttactgaggatcctttgtaaatgacgcgttgcctttttcctaagctcttctggcatccatggcttataatgcactatctgctgtcaaacttattgaggatcctttgtaaatgacgcgttgcctttctcttgctgctttcaaacattcgctttgccttttgacaatttgaaacatagtgtgtcttggtgtgaatatctttgtatatttccttgaagttcactgagctttttgaatgtatatatttgtttttagtgaaatttgggaagctttcaaacacatttcttcaaatagtcttcctgcccctcactccccaccaggattctgtatgtaggcattcttgatgttgttacacaggtctttaggctctattcttttttgttgtcattctttcattttcctgctcttcagactgaatcatttcatttgatctatcaagttcactgattcttttttccagctgctcaaatcttctattggaaccctaagtaaaaagtaactttttacttagttattgtacttttcagcctcagaatttttttgtaccttttaaaaaattcatatttcttatttatttatatgtcattctcttgggtttctttagctctttaagtttatttacgacagttatataaagtttttgtctaatatttctaatatctgcttactcagggagagtctcatttatttcttctgtaaatgggccatagttttgtgtttatttgcatgcttcttaatttttgttgaaaactggacattttggatattataatgtgtttattctggaaaccaaatttttcccttcttcaaggttatttttgttacccactgtggaatgtagtttttatttgtttagtaacttttgtaaactggttttgtaatatctgcattcttttttatgtttgatgtttgaaggctcggttcctttagcttgtgttcatttagcatttagtgatttaaaaatgatttccttgactgcaaggagccaaaaaagaaaaaaatatgaaaaacatctcccagactttgcttactgactctgtattggggctccctcaacacttagcggagccatgtataattctgccttagccttcattttttcttgctgtgagcctaggaattactaaaggtgagttattagtgtcttctcaggccttttctgagcatgtgtcccaccttggccatgcttatggatttccaaatttttcattgtatgtaagcacttttgagtattcgaatttcccaaaggaactttctctcctgctttttcctcaagttttcagtacagtatatcttgcctcaattgtaatattttgccgcaaatggctgagggttgttaatttgcctttggacgatctgatttctaaaggtttggtggaattctccgtgaaaacatctaaacctagtgtttgtgtgtgtgttataattccatgacaactgtatttctctatggaaattgctcacataagtgctgtacttctttttttttttttgaagtcagttgtggtgaattgtatttttctagaaaattacccattccctctagctttcaatgtttttcatagatgtgaacaacattgtttttaatgattttttatttgctgattatcaatagttatttctctcaccattccttattcatttttgtgctttctctttttttttattcatgattaagagatctaatttttttgtcaactttgttgatttgtttaaagaacaagatttttggtttactgatttgatctgttttttggcttcttattttattaattttcacttttttctactttgggttctttcttgtactttctgcttactcttttagatactttttacatttttcagctgataatttaattcctacacttttattaataaatgtgttaaggctatagattttcctctgatcactgctttaactatatcccatatacagatgctccttgatgtatgatgaagttttgtctcaacaaacccccgtaaactgaaaatatcataagttaaaaatgcatttagcacaccgaaaattataggttggcctagcttactttgaacatgctcagaacatttagattaggcttcagttggtcaaaataatctaacaaaatgtctaaataaagtattgaataactgatatttattaaatatggtactgaaaataagaaacagaatggttgtatgggtacttatcattaatgtacgtagctgaaattacacagggcctgaagaatttttgaagcattgagctaaggttaattgctgaatgatgggactaatactttgacacagtcagtctctgtctcttccgatcatgagggttgagaatagctggtagaaagtattgatgcctgttgatggtaggcaggcattatgttcttcaggaagatatcaagatggattatctacctttattatcatttggctgactggaagctgcagctcaccgctgttgcacaacattgtgagagagcattgtgccacatattggtagtccaggaaaatatcaaaattcaaaattcggagtcgggtttctttcttttttttgagctggagtctcactctgttgccaggctggaggcagtggcacgatctcggctcactgcaacacctccgactccctggttcaagtgattctcctgcctcagcctcccgaatagctgggattacaggcacgcaccacaatgcccagctaatttttgtatttttaggagagacggggtttcaccatgttggccaggatggtcttgatctcttgaccttgtgatccgccctcctcggcctcccaaagtgctaggattacaggcgtgacccactgcgcccatcctggagcatggtttctaatgaatggatatcactttcacaccaccataaagctgaaaaatggttgaaccattgtaacttggaaacagtttgtattctggtatgcactgttttattatcactattcagaatatttatgtcttgtttttgtatttccactgtcatccttgtgtttggttttttttcttgctgatttgttccaattctttgtagattctggatattagtcctctgttggatgcatagtttgtgaagattttctcccactctgtgggttgtctgtttactctgctgattatttattttgatgtgcagaaggctttcagtttaattaagtcccatctatttatctttgttgtgtttgcttttgggttcttgattgtgaagtctttgcctaagccaatgtctagaagtgtttttccaatcttatcttctagaatttttatggtttcaggtcttagatttaagtctgtgaaccatcttgagttgatttgtttataaggtgagagatgaggatccagttgcattcttctacatgtggcttgccaattataccagcaccatttgttgaatagggtgtcctttccccactttatgtttttgcttgctttgtcaaagatcagttggctgaaagtatttggctttatttctgggttctctattctattccattggtctatatgcctatttttataccagtaccatgctgttttggtgactatggccttatagtatagtttgaagtcgagtaatgtgatgcctctagatttattctttttgcttagtcttgctttggctgtgtgggctcttttttggttccatgtgaattttagccttgttttttctagttctgtgaagaatgatggtggtattttgatgggaattgcattgaatttgtaggttgcttttggcagtatggtcgttttcacactgttgactctatcattcatggtgaacagcagggggtgtgggtaggacccatgggagacagacttgtttcttctttgtggtcgactgcagcttgttggaggtgtggataaagcactggggtctttgctcctttgttagttcaagggtagcaggggtagtaccactgtagaggcagtggcagaggggcttttggttgaccctgggggctccatctccaggtggagctgctattactgggaatgttcagcctgggggatggagcagctgtactgctggtgtgaggttagggctctgcttgttggggatcagggggtttagggctcactgggagaagagactggtctcctctccatatgggaactgtggcatgctgtaagttcaggtgcagccttcaggcgctttgtttctttccaagcctgaggacagcatggatagaactgctgctgtgacaggggcagagaggctgtcgtttgcctctgggagcctctccctagggaaagtctgggccactgccagtaggtaagctcagctgtgggtggggcaactgatctgcagttatgagctgggtgctgtgcctggtggagtgggtggtgggggttcccaggggagggggctggattcctctctgtatggtggctgtggtgtgctgaaggtgccactgtagtgattagactcttagttccttctgcagcccaagggctgttatggtggtaccactacaattgcagtggttgtgaattgactctggtatttcctccttggagaaatgctgggctacttcttattgaagtggtcaggtggggggcagggtagttgtacaggagtcccaggccaggcggccctgtttggtaaggagaagtgaggactgaaaactgcaggaagaaaaatgcagccactcttccgtgaggcaggtgctctgtgctgggggttcagaccaacccctggtccctgtggactctccagggtgagggctgcgagattggttttcttattagatgatctgtttaatgctgaaagtggggtgttgaagtccttcactattattatatttgagtctacctctctgttttgacctagtagtatttgctttatgaatctggctgctccagtgttggctgcatatatatttaaaattgttatatcctctttctggattgattcctttatcgttgtataataagcatttttgtcttttttctaaagctagttttgacttaaagtctgttttgtctgacataagtatagctactcctactcattttggtttctgttcatggaatacctttttccatctcttttcttttagttaatatgtgttttacaggtaaagtgcatttgttcagggaagcacatagtcaggtcatagttaaaattcattcagtcagtctatatctttcaggtggagaatttagaagaaatatatattttttaaaattagttaattttttatttttgtttgttttttgtacagatagggtctcactgtgttgaccaggctgcacttgaacctctgacctcaagcaatccttctgccttggcctcccaaagtgctggaattatagtcatgagccaccacacccagcccctaagtggacatttaatccatgtacattcaaggttattattgtctatatttgatataatcaaatacttagtcattttaaaattattttaatagtttcaaatatatttgttaaatttgctctatttgaatcaggatctaaagaagtttcaaagttgcattggctaatatatctttttagtttttaaaaatatatatgaattcctttctcctgctttttagctctgtgtatttgctgaataatccaggatattcatcctgttgaatattccataccttgtgattatcttattaaaccctacggtgttcttgcatgtttctctctttgacatatttcctgtatattatcataaaatagagaatatttaccaattaggctcatttctagttggttctatgtgctccatattatactttatgtgtattcacttcatgtgatataaaaattgatcagtaggttcaggtattttcagctgattcattccatatatgttttcttctgaaacagttactcgtcattttagcttctattggttgttatcttaggcccattaattcattgggttccaaatgaatttgtctgtatgttagtgtcctatgaaacaattcttttctccgatgttttataacttaattaaaatgccagatcttgatttttagcagttgtaatttttttctgttaatttaattacatttttaagttacataaaacagctacatgatttcaaagtcaaaaatataaaataagatgtattcagaataacttttatccctgtgccttgccctgtttcctcctcctgccataagaaaattatatatggattatgtttttgccattttaagtatgcttatttaaatatttataaaatatatacttatatatgcatgtaaatccaatgtatttatccctgttttaacataaaaataacattctggtgtcacttttttgtttcttttcagttaaggtataccttgtagattactttagagtagtatttggagatatttctcactcattttatagttgcttcatactctattgcgtacaagttttgcaagtagtactcactaattgtcatttggttactttccttttttttttttttttttgagatggagtcttgctctgtcatcctggctggagtgcagaggcacgttctgggctcactgaaacctctgcctcccaggttcaagcgatcctcccacctcagcctctcaagtagctggaattacaagtgtgcaccaccacacccggctaatttttgtatttttggtagagatggggtttcgccatgttagccacgctggtcttgaattcctggcctcaagtgatctgcccgcctcagcctcccaaaatgctgggatcacaggcatgagccaccacgcccggcctactttccgttctttactatgaaaaacaatgcttcaatgaatagacttgtgtgcatcaattattttgtatttttgccaatatatctttaggatagaagtaggattgctagaccaaaagtcagtaccatgtaaattttttaagatattgccaagagttgtaccattttgtattctcaccaacaatgcataagagtgcctctctcggtgttttagacatgaagtccttgcccatgcctgtgtcctgaatggtaaagcctaggttttcttccagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtcgtatagtttgaagtcaggtagcgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttatttgtatcctcttttatttccttgagcagtgatttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacatttattttgtatcctgagactttgctgaagttgcttatcagcttaagaagattttgggctgagacaatggggttttctagatatacaatcatgtcgtctgcaaacagggacaatttgacttcctcttttcctaattgaataccctttatttccttctcctgcctagttgccctgggcagaacttccaacactatgttgaataggagtggtgagagagggcatccctgtcttgtgccagttttcaaagggaatgcttccagtttttgcccattcagtatgatattggctgtgggcttgtcatagacaggtcttattattttgaaatacgtcccatcaatacctaatttattgagagtttttagcatgaagcgttgttgaattttgtcaaaggctttttctgcatctattgagataatcatgtggtttttgtctttggctctgtttatatgctggattacatttattgatttgcatatattgaaccagccttgcatcccagggatgaagcccacttgatcttggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttgtattgattggaatagtttcagaaggaatggtaccagttcctccttgtacctctggtagaattcggctgtgaatccatctggtcctggactctttttggttggtaagctattgattattgccacaatttcagcttctgttattggtctattcagagattcaacttcttcctggtttagtcttgggagagtgtatgtgtccaggaatttatccatttcttctagattttctagtttatttgcatagaggtgtttgtagtattctctgatggtagtttgtatttctgtgggatcgatgggacaaaagcaatgacaacaaaagacaaaattgacaaatgggatctaattaaactaaagagcttctgcacagcaaaagaaactaccatcagagtgaacaggcaacctacaaaatgggagaaaattttcgcaaccaactcatctgacaaagggctaatatccagaatctacaatgaattcaaacaaatttacaagaaaaaaacaaacaaccccatcaaaaagtgggcgaaggatatgaacagacacttctcaaaagaagacatctatgcagccaaaaaacacatgaaaaaatgctcatcatcactggccatcagagaaatgcaaatcaaaaccacaatgagataccatctcacaccagttagaatggcaatcattaaaaagtcaggaaacaacaggtactggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataagaaatgatgagttcatgtcctttgtagggacatggatgaaattggaaatcatcattctcagtaaactatcgcaagaacaaaaaaccaaacaccacatattctcactcataggtgggaagtgaacaatgagatcacatggacacaggaaggggaatatcacactctggggactgttgtggggtggggggaggggggagggatagcatcaggagatatacctaatgctagatgacgagttagtgggttcagcgcaccagcatggcacatgtatacatatgtaactaacctgcacaaggtgcacatgtaccctaaaacttaaagtataattaaaaaaaaaaaaaaaaagagtgcctctctctacagcttcatcaacaggttggattatcaaatattgaggtcagatatttgatattttataggttagaactgatatttaagtatcattttactttgcatgcatcttaatctgagagacttgaacatttttttcatatatttaaagatagtttaacatgtgctggtgaggctacagagaatggggaacacttctacactgctggtgggaatgcaacttagtccagccactgtggagaacagtctggggatttctcaaagaactaagagttaaactaccactcgatccagcaattccatcaccgcatatatgcccaaaggaaaatacattgttttaccaaaaagacacatgaacttgtatgggttgtcccagtgctattcacaatagcaaagacatggaatccacctgggtgcccaacaactttggactagataaagtaaatgtggtacaaatccaccacaaaatatatgcagctaataagaagaaagtcacatcctttgcagcagcatgaatgcagttggaggccattatcctaagtgaattaacactgaaacagaaaaccaaataccacatgttctcacctacaagggggagctaagcatcgagtacacatggacataaagatgagagaaacagacaccacagagtagcagagggaggatggaggaagaggggaaagagttgaaaaactacatattgggtattattcttgctacctgggaggtggaatcatttgtactccagaccttagtatcatgcaatatacctttgtctcaaacctgcacatgtaccctctgaacctataatgaaattagaaagaaaaccccaaatatggtcattgtagtccagaagctaagatgtggtataactgaatggtttatcaattaggaatggatgtaaaagtaacaatctctgttcttgattttaagaccaggtctatgtgccacattttatctagtctaacactgatgggcatttgggttggttccaagtcttccctattgtgaatagtgctgcaataaacatacctgtgcatgtgtctttatagtagaatgacttacaatcgtttgggtatatacccagtaatgggattgctgggtcaaatggtatttctagttttagatccttgaggaatcaccacactgtcttccacaatggttgaactaatgtacgctcccaccaacagtgtaaaagcattcctatttctccacatcctctccagcatctattgtttcctgactttttaatgattgccattctaactggtgtgagatggcatctcattgtggttttgatttgcatttcttgcagccataaaaaagaatgagttcatgtcctttgcagggacatggatgaagctggaaaccatcattctccgcaaactaacacaagaacagaaaaccaaacaccgcatgttctcactcataagtgggagttgaccaatgagaacatatgggcacagggaagggaatatcacacaccagggcctgtcggggggtgggaggcaaggagagggataacgttaggagaaatacctaatgtagatgatgaattgatgggtgcagcaaacaaccatggcacgtgtatacctgtgtaacaaacctgtacattctgcacatgtatcccagaacttaaactattaaaaaagaccaggcctaattcagataatatgtatgtatgtatgtatgtatgtatgtatgtatgtatatatgtgtgtatatatatatacacatatacacacatatatgtatatatataaaagagtaacatattttactacatagattccaaacttttctgcctgcctccttcccaggggagggatgcccataacttctggtcaaatttcaggagaaattctgaatatactggtttctcccatggcgttgtacacattaatgcccttagcagttaaatgaattatgaataaattaggggtaaattttacaaataaatgaaaaataaaagttttttgcctacaactgtaaaaaaaaaaaagactgattctccttatgtatgaactgtaagtttaactgttttgcccattttcctattaatattttgggttttgttttagaagttccctatgtgttagaagtgctagtctattatgtgagttacaagtagtttcttcccacttttaaattttctcatagttttattacgcattaaaaattaatttgatagtcaatgttatccatctttaccatattcatagattataaaaacattaacttgttttcttttaatatttgcatagtttttttgaaaaaagagttatgtcttgaattcacttagagattgtcctggcatttggtgtagcaaataaattaaatatatcttttcccatattgctatccaattatcccaccatcacattagtaggcctttcccccctgcactgatttgagatactgtcattattatttactacttttattatgtgtttttaatctgcttataaattttctattctacttttcctaagataaacataattttgacccttttatcatctgactctccttatctattaattcaagtcacattttgacaaactagattccttttttcttagaatatttagtgttcaattttattctggctcagtgattctccctggaaagagaagatatttgtcagaatcatttgctaaggttttttttttttttcaatttatattttccttctatcttaaattttcatcatgcctttctagggtggtaaggtggaagtatatgagtacacacttgcacacaaatatacacacttccactcacaagtacagtatcccaaatgagcatctgttaagattgggatgtgtcatatttcacaagaatgttgggaaaaagtaaagtttgaaacttttggctttgttaatatataggattttaatagtatctaatgtttattcatgcttaatatgtctcgaagtgggctatttgatttatatctattttgtcattttccttcataataaccatgcataataggtataatctcctgtttataaatgtagaaactaaagctcatgaaagctacgtaatgtgcccaaaatcatgattaataagagtcagtagagttgaatccagctctttgttttttactttaaagcctgtgcttttaaacattaaccatggaaaatgacatagatggatccaagtaatatactttgtgccaacatgatgagagcctggatccctctaaattctttctactgcttatgagcagttataccacagatgtctaggacctagaaggcacatttcacattggcaaacttactcttccactcactcctgataatgccctcatggattctgggttgttatagtggtgggaggtgaagtataaacttataatgggaggcgtttgtttttcaacctcttaaaagttgacatatatctccttaccactaagcatatattttttaaattaagatgtgacagttctttttttatgtttttcacaaaatggaccaaataaatttttttttaaatttataagctaggctatattttctctcctttcttctactaaacttaggatcacacaggaaggaacaggtgtacacaaatactaatatatttatgcctttcttcattctaagaattagcaaaagaatattttgaaagcataataactttgtatctgtattccaaaatataacacacaagttgttgaaagataaattgaggcaatgtatgtggaagttcctagacaattactaaattatatgggaatggagggcacaattttcatgagctttactaaataacttaccaacttcactatattttgtgtcattatctgagattaatctcacagttatataagatctaaaactttacactagaatgtgcatcccattttctcagccgtcttattgccgtcttcatgtctttgttcctcagtgtgtatataattgggttcaagagaggggtgatcacagaataaaatacagcaaggaatttatctaatgacttgatggggaatggccaggcataaataaagacacatggtccaaagaacaaaagaactactgtaatgtgagcagtcaaagtggacagagctttggacgacttatctaaagggcaatgctggatggtcattaggatgatagtgtatgagatgattagaagaacaaaagaacacacagtgagcacaccactgttagcaatgaccataatatctagcctgtaggtatctgtacaggcaagtttgattaccctaggaaggtcacaataaaaactatcgacctcattgggaccacagaagggtaagtgcacggcaaaggccaactggctcaccgaatggagaaagccaattccccatgcgacagccataatgccgacacatgcgttgccacacataattgtagtgtagtgtaggggtttgcatattgctatatatctgtcaaagcccatggctatgaggatcaccatctcactcccaccaaagaagtgaaggagaaatatctgaacaaggcagcccttgaaagagatgactttgcgctggctgaaaaagtcagtaatcatcttgggggctgtgactgaagacagagacagatcaatgagtgagaggttggctagcaggaagtacatgggagagtgaaggtgggagtcagataccactgttatgacaataagaaggtttccaaacacgattcctccatagaatacaaaaaacaacataaataggaaggtctggagttcctgagaatcagagagacccagaaaaatgaattcagtcaccatagagttattcgtttcactcgttgattcattccaggaaatagcctctgcagttaccttgaagaagagaaggagaaggaagtcagaattattatattcaaattcaaagcctcattttatatcattctgctcactcttacagtgactttctataatctattacttaaagacattcagaattcaacaagatcataattttgtctcgcactacttccctggctatgccttataattcagttatctcagcttctcagtgtctccattaatgttaggtttattcctaatataaaataccattatttatgcttgtctctctgccagattaagtctatgccataactctatgtttatctcctttttctttgaactacaaaacagtttgtagcacgcatgttatttggtgatattaaagttcttaagagaaaaaaataggccaaaatgaaatgaaagataaaaaatagaaaaaaagaaaaaatagtatcacaaatgtaatacttaaaaattaacagaggataaaagaatagggaattcaaaagtgaagtgagaaaaagtgaggaaaatgcaataaagtttaaatgagagaaagtgtgaaggactttcataggagataaaactggtaagagattttggaatgctttctaaagcatttctgttttattatagagacaagaactactgaaaaattttgaatgattgtttaatttagctctggactcaatgtgaattggaagggagggagcttggaattggaagggagggagctgataataattataacaagcactagtataacaatactttacatagagatcccttttaggagcagaaataaatacagaaaaaggtaaaggataatgatgactgtctagacacaaggaggtattgttggggcatctttgtaagttgctatctgccaggtgagagactgaacactgacttctgggcatgagttgagagccatttcaattgtgtatggaggagagaaaataagtactgtttcaagaagttttgcagtgaagagaagtaacaaataaaaggtgtcctgaaagtgaggcatagccatattaacaatctttggattaggtataagagttaatgggcaagtaagatgtaaaagggagaagtggaaattgatcactaacattccacgggagacatgaaggtatagagtttacacttgccatcttttttggaggaatactgttatttgatttttgctgttttttaaagaacagtaattcatagtgcttggaaattctacttttctctttactactctgaatcccatttcttagtcctacacactcaagcagcacattactgtttttaaagtcctataaaaatttagtgatcttaaatatttttaagaataaagagaagtctaatagtggaataaatcatgaacattcacttcagttctcttctgcttagcacggtaataaatataatcatactaatcattgacagtacaaatgataggatttttattgtgagataatttctgtcctgactggttggttggactgtttcttttgaatcaaagtgtgcaatttagaatagaccttaaatatgcattgacataaaattaattcatttcattgataggcaaggacaatcttgaagttatatcttcacatgaaatatgccaaggatgaggttgacccgagggttctcatctgtagcaaaagactttctatcatggctgttagtaagaattcaggaatgctattctttagcaaaaggaatttcttgctaacgtagttaagacatctctctcctgaatttgtgctgctgaggggatccttcaccaccataattctttcaaagctcatttctgacttttcaaaaattattcaaaaaaatttagaagaattgtatttattctaagttgaacattaagtttaggcttattaaaggagttcttcagaatcttacacactcattgtagcaaccatgaagagccagccactgttgacaggtaaaatctttcatgccatagattattcatggaattcaaccattagaattatatataat

SEQ ID NO: 717 - DNA, 95903 bp, Homo sapiens
aacttctctcctcagggttactgatcagaaaagattcttcagtgtctgatttcattatctacttacaaaatgttttcatgatgattacatcaaaaattagctgacttatttttcctccaagaatttcctttcttacataggccaacattagccgtccccctatccacgacacactgtggctgaccccaaaaggctgggccagttgggggtggcgtttggctgctagtagccaactgtggcttaaacaggaaagaattgttttttctctccggtgggaaagaaggcacagctggggtggaagctccctgtatccttggggacggtgtatctttcttgtctgcctttctgtcacaaacacatccttactccagcctgaaaggaggaggagagaagaaacaggcagaaaggacacaaactgcttccaaacgagtggtgtgtgtctggtcccatccaacaaaacaaaacaaaataaaaccagaaaccacaagaggcctcttttggtgatggatgttccggtggtcttgggttggtgggcttccacaagttccagcccgattcagccaagatctccagtcccaggcgtatcaagcaaaaggaagtgaagatgagagttgggggactgagaggaaaaggagcaaatgtggctgctgtggtgaccctgatattggtgattgcaggaagcagctgtgacccctggagccgagggagctcagaggaggggctggcgctgtacctctgaacccagcacgctaggccggcaggcagaggccttgctgtggccatgcccatcttctgcttccagagcagtggggctctccagggcacctgtttgtgtacccacagccaacagctctgggcagttagtgggaaattacagcaaccagtaaagtcagaagcactgaggctttagactcacacacgtgcagtatctccccagccgctagctaaagacattgaccttttttggtgatggatgttctggtggtctggggttggtgggcttcaacaagtgggggttttagcatgattcagccaagatctccaatcctgcagcctgggaccctgacttggtaaaacgaacacatctgacaccgcttgagtcgccatctataggaggtaagtgtgagtctgggttccaaatattttatcaagcctgtcagggaagcaagcgctgtctgtctgcaggaagatgtctgtggggagagggcagatctgagtccagtgagtctctcctgcagccagcctccaggtccaccctcccccaacagatgtcctctcgcaaatgaaaaacactcaagacgtggaaagcagacagatggcaggagggtccttagcccggactgatgacagccggctctgggccaggttctggacaggattgtgggcacacggtcccgacccaccactgcagttcttgtgggatggtcttggtccacatgcgagcccctctcaggccaaacacctgcttactccatattttcatgtaattctaattcatgtaaatgatgttatttcatcaaggacaattgaagttatggttggccactttgggtaacttattttttatttttttaaattttttttgagatggagactcactctgacccccagactggagcgcagtggtgtgatatcggctcgctgcaacctccgcctcccgggttcaagcaattctcctgcctcaggctccccagtagctgtgattataggtgcccaccatcatgcctggctaatttttgtatttttagtagagacggggtttcaccatgttggccaggcaggtctcgaactcctgacctcaggtgatctgcctgccttggcctcccaaaatgttgagattacaggtgtgagccaccacgtccagccactttgggtaacttttaacatagacaaaatagttattttgagaggcatcctaaaacaaatagaaaaaaaaaatcctgactatccaatggcctgcattctttagttggcataaggagacttctaaactcaattcagattctaaaattatctacctaagttattctactcaggtcagaaaaaatgtcagtgataaactgagacttgtgccgcgcatttatattctaggcttttctgacttcctctgaccaatcatttcccaggaggtgcgaagccttgctggataaaaggtaagcggcgtgaccctgaaaaggacacagggttaacacatcctcgaaaacacaaacacacaaacaacaaaatagaaactcttttgacaggaacacttggcaatagtgcgaacaaaagaataactggaaagtaatatcccacctaattacagaaaaaaagaactagtgagttctgagggattgtgaaggaagactccagccagcccctctcaccttcttttcccctgctcttcctccagctcttgaaagactctggaggttaattatagcaactggtattttctaaaaatggcctctgtgtggtttctagtttcattgctttttctgaatcttcctgccctcctgccccccccagtcagagcaggagttcacgtgtgctccccttggcttcgggtggatctttgtagctcactcaattaatgggctgtggtacgtgtaccgcagcttggcttctggagctgggttagaacagccgacacagcttccgcgtggccagccagcatgccggaagggagcccaaaccagaccctgcggggagaccacacggagaagcccctgtggagaggatccccaggcagatgactaaggagcctgtgggtgattccagcccccatcctcggagtctcccagctgcggccccaggcatcacagaacagagacaaaccattctgctgtgcctgtccaaatgtctgatgcacaatatctgtgaaaatgtgtgactgttttacaccactgagctttgaggtaatttgttacaccgccataaaaaatcagaacatcaagtaatgacacaaatgttccatcatgatgtgcatactctagaactaactagcacagataaacagataccccacaaaagaaaagtaatacatattacaaggtctattaaaatccatgggagatgctgtcctaattggttacagagagcttatataaatttaaaataaaacaatgcaagagtttccagaagatagagaaaaatgttaaccttctcgttatgtgttgattcattttattttcaaaggaaaaaagtttaactgtgactttcattaataactttggttactaggttacaaaaaaaagactattcacagcttttaaacatggctggaaatgctttaaaaatcattctataaatacagaagaatgtatttaaaagttcatataatgttcttgatagatggctttgtagacaaactagagtgagatggtgattttgaaacatctcgttttaaaacatctcattgctgcttccatgtgggatgtagaaagctgcaaagaataataaaaaaacctggctagtgtaccaacattataatttttcttgagtctatcaaagatctaagatggcaaggcaaccaaataagcagaattccaaagagggagcaggcactccagggagacacgagacacatggcgtttctcacctttgcctgagcacaggaaaaacatgtggcccccattaggtatgaagctatcagataaaatgttagtaaatcattaaagtccaagtgtggcctaggatgtaagtttggaataactgggaaactcagggagtcacactcactcacaaaatcactgagggctctcaagagacatattaggagtgggcaggaaacgggggctgctccttcagaggcacaggtatgtgggtgtgcaggacaagatcagctgctgttggaggacaggaacaaagccccacccacttcccctggatccttcctttctatgcagtaaacgccttaagacattgaggggaggggaccgcatcctcccacacacagggcacaggcaaaatccattgctcttatagaaagactagaagcaaaacttatatgcctctggaagaggggtaggaaaactctagccccaaggacacaggagaaaatcctttggtactgtgggaagggtagatgcaaaaatgtcctagttctgagataaaataaagaagctattccaggcccaggatcctataccagtaccaaccagaagtctgctacactgagggaggggagagcaggaatctcctgtccaagaccatcacagatacaaggcagaatttaattgccgtaggaaggaagagcagaattgctgagacagccccaccctaaggtttatatctgtctaagattgaggttgcagcaagacaacaaagaaaaccctatctcaccataagcctagcacagagtaacaagtaaagagagtctatccctgaagaggcgagagtatagatagagtccctctgtggcaaagacatgcaggaatagctaaaaggtaaagggagcattaggaacacagaagaaaaccacccaacaccccagtccccaatctagtacaagatattatagaaacatctcgtatttacagaaacttgaagccttagcagcactgaagatagcaatagcaacaaagtaaacccaaacccagctcagctcctaactagatcgacttcaccttgcacactagaagtcagacataataggcataataatttggagatgtgaatattatttacctcagtctgtactgttaacacacaatgtctggcattcgatcaaaaattataattttttaaaaagcaaaagataaaacaatctagagacaaagcaatcaacagaaatagacttgatgaccccaatagttggaaccattagacagagattttaaaataactataataaatatgttaatgcatctaatgtaaaaggggcaacaaacgcaaacagatagggaatttcaccagcgagaggaacactacaagacaaagtaaaatagaagtgctagaaattaaatatatgacatcacagataaagaattcttttgacaggcacatgagtagaatgaatacagctttgaaaaaaatcaacaaatttgaaaataggtcaataaaaattatccaaagagaaacacaaagaaaaaataatggcaaaagcaaagcagagtattcaagagctgtaggacatcatgagacgggctaacgtatatgttatcagtcacaggagaggagggaatgaagaagaagaaatattagaagagacaatagtcaaggattttccaaaagtaataacagacattaaaccacagatccaagactctcagagaaccctatgcagaattaataccaaaaataaaagaaaggaaaaagaaaacaccaacaccaccatcagcaaaaaatcccacttaactatacacatcatagtgaaactgtcaaaagtggaagatgaagagaaaagcttgaagatagcagagaaaaaagggaacattacatgcagaacagtaaagataagaattacaggacacttctgatcagaaactacacaagccaaaagacaatggagtgacatttttaaaatgctgaaagaaagggaaaaaatctctcaacccagaattctatattaaataaaaatatttttaaaaattagggtaaaataaaaacattttcaaacaaacaaaggctgagacaattcattctcgattcatttaaagaaatttcttcagatagtaagagtgtattatgatcaccttgaggaggatgggatcggccccctctcactggaatagtttaaatgtcaagaatgataaggccgtatgcaccgagaagatatggaaatgcttcttgctcatgccatgggactttctgaagagaaaaggtcaggtgcaagtcagtataaatggtgggagtgaggcagagttaatggatttggcttgtattgtgagtaggtggtgggactgaggaaaaggttcaagcacaaagggtggggcttgtgtggttcagacttcctgctgacaccaagggaagaaatatgcaggtccttgtaactggagaaggaatgaggtttgaaagctatcaaaggtcaaacataaaaaatggaatcttactctctattacatggaatgtgagagcagacaaaaattcgggtctacaccaggggtgtccaatcttttggcttccctgggccacattggagatagaattgtcttgggccacacataaaatatgctaaccctaaggatagctaatgagcttcaaaaaatcgcaaaaaatcccataatgttttaggaaagtttatgaatttgtgttgggccacattcaaagccatcctggccctcatgtggcccatgggccatggttggacaagcttggtttacacaaagaaatgaagagcatcagaaatggtaaaacatggaagtaagtataaaagattcctctcatttctattggagtaaccacattccatcttatatttcccactatttacaaccaaactctggatgaaatctctaaagcaaccatcagaagactgagaggcagagaaaagaaggtgacttggccagggattctgagacatgaggaacaaccaggtggtgagttccttgttatgatttccctcccgtatatcttcatttgagtaccggagaggcccacactcagaaataccaacaggcacaaaaaacaaaggctccaaggaaagcttactttctctaggcaaaagtattgataacgggcagccctgagagatagaacacattctacaccagatgaacagatggtataaaaaaaaaagtgatacaatcctccaaccccatgcaacaccgcagctgcagggactgagggcagagccctgtcaaccatccctgtcctaccctaatgatcagggaccctttcttctcccgacttggagtctatggtcagggagaccgtgttagtttgtcctcctgctgctaataaagacatccctgtgactgggtagtttataaaggaaagaggtttaactgactcacagcttagcatggctgaggaggcctcaggaaattacagtcatggcaaaaggggaagcacacatgtccttcttcacatggtggcatcaaggagaagtgccaagcaaaaaggggaaaagccccttacaaaaccatcagatctcatgagagctcactcactgtcatgagaacagcagcatagggtaaccgcccttatgattccattacctcccactgggtccctcccatgacatgtggagattatgggagctacaattcaagatgagatttgggtgtggacacagacaaaccatatcagagactgtagtggagacctgtttggccatttctgtcttgcattaaggagaaagaacccttcctcctctacaccaggactcagagcaaacttcagggtgaagccctttcaactattctgatcctacactaacatgggtagaagtggcacccctcccccaatacctatcactgtggagactgtagagtgaatcctttctaccatccctctgctgcactaagcaaatgtcagcaaagaggtgatgcttctctcccactccactggtgcatagactgtgaccatccccaccgtgcacgaagcaaacagcagcaaagaggcagcacctcctcccctcccaattagagcagggtaggtaggattacggaggagagaacctgtgtattaattcctgggcagacccccaagcagcctatgcctaataagaatcaacacattagaagattggagaactgagctgcagtgtcaaacactgctatcatttcacattggcctctgggcagcacataagctgggaagaccagggtagcaaactaaattggcatttgaatctcagcctatgaaagtgtaccggaacatgcatcctgaagctaaacaggttgactgcctgctgaaagaagatttaaatagaaaccagaacttcatgacacaacactcagaatgtcctagttacaatccacaattactcatcacactatgaccaaggacatctcaatttgaatgcaaaaaggcaaacaacagacagcaacaccaagataatacagatactataattgtctgacaagggttttaaggaaccagcataaaaatgctccaaaaagtaaatagtaacactgtgggagaaaaaaaaaaagaaaaaatagaaactctaaacaaaggaaaagaaaacttaccacgggaggagccaagatgtccgaataggaacagctctggtctacagctcccagcgtgagcgacgcagaagatgggtgatttctgcatttccatctgaggtaccgggttcatctcactagggagtgccagacagtgggcgcaggtcagtgggtgcgtgcaccgtgcgcgagccgaagcagggcgaggcattgcctcacttgggaagagcaaggggtcagggagttccctttccgagtcaaagaaaggggtgacggacggcacctggaaaatcgggtcactcccacccgaatattgcgcttttcagacccgcttaaaaaacggcgcaccacgagattatatcccgcacctggctcggagggtcctaccccacggagtcacactgattgctagcacagcagtctgagatcaaactgcaaggcggcagcgaggctgggggaggggcgcccgccattgcccaggcttccttaggtaaacaaagcagcctaaagctcgaactgggtggagcccaccacagctccaggaggcctgcctgcctctgtaggctccacctatgggggcagggcacagccaaacaaaaagacagcagtaacctctgcagacttaaatgtccctgtctgacagctttgaagagagcagtggttctcccagtacacagctggagatatgggaaccggcagactgcctcctcaagtgggtccctgacccctgacccctgagcagcctaacagggaggcaccccccagcaggggcagactgacacctcacagggcccagtactccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctagaaagcagagcgcctctcctcctccaaaggaacgcagttcctcaccagcaacggaacaaagctggatggagaatgactttgacgagctgagagaagaaggcttcagacaatcaaattactctgagctacgggaggacattcaaaccaaaggcaaagaagttgaaaaactttggaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagtgagaagggaagtttagagaaaaaagaataaaaacaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataactgtcagattcaccaaagttgaaatgaaggaaaaaatgttaagggcagccagagagaaaggtcgggttaccctcaaagggaagcccatcagactaacagcggatctctcagcagaaaccctacaagctagaagagagtgggggccaatattcaacattcttaaagacaagaattttcaacccagaatttcacatccagccaaactaagcttcataagcaaaggagaaataaaatactttacagacaagcaaatgctgagagattttgtcaccaccaggcctgccctaaaagagctcctgaaggaagcactaaacatggaaaggaacaactggtaccagccgctgcaaaatcatgccaaaatgtaaagaccatcaagactaggaagaaactgcatcaactaacgagcaaaatcaccagctaacatcataatgacaggatcaaattcacacataacaatattaactttaaatgtaaatggactaaatgctccaattaaaagacaaagactggcaagttggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatattagtctctgataaaacagactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgcgacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgcaaaagaacagaaattataacaaactctctctcagaccacagtgcaatcaaactagaactcaggattaagaatctcactccaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagactgcaggaaatagagacacaaaaaacccttcaaaaaattaatgaatccaggagctggttttttgaaagatcaacaaaattgatagaccgctagcaagactaataaagaaaaaaagagagaagaatcaaatagacacaataaaaaatgataaaggggatatcaccaccgatcccacagaaatacaaactatcatcagagaatactacaaacacctctatgcaaataaactagaaaatctagaagaaatggataaattcctcgacacatacaccctcccaagactaaaccaggaagaagttgaatctctgaatagaccaataacaggatctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcagtaaaatactggcaaaccgaatccagcagcacatcaaaaagcttatccaccaagatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagccaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaagagaatcaaatacctaggaatccaacttacaagggatgtgaaggacctcttcaaggagaactacaaaccactgctcaaggaaataaaagaggatacaagcaaatggaagaacattccatgctcatgggtaggaagaatcaatatcatgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactataaggctacagtaaccaaaacagcatggtactggtaccaaaacagagatatagatcaatggaacagaacagagccctcagaaataacgccgcatatctacaactatctgatttttgagaaacctgagaaaaacaagcaatgggtaaaggattccctatttaataaatggtgctgggaaaactggctagccatatgtagaaagctgaaactggatcctttccttacaccttatacaaaaatcaattcaagatggatttaagacttaaatgttagacctaaaaccataaaaaccctagaagaaaacctaggcaataccattcaggacataggcatgggcaaggacttcatgtctaaaccaccaaaagcaatggcaccaaaagccaaaattgacaaatgggatctaattaaactaaagagctcctgcacagcaaaagaaactaccatcagagtgaacaggcaacctacaaaatgggagaaaattttcgcaacctactcatctgacaaagggctcatatccagaatctacaatgaactcaaacaaatttacaagaaaaaaacaaacaaccccatcaaaaagtgggcgaaggacatgaacagacacttctcaaaagaaaacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtgcagaaataggaacagttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaaacgtcattctcagtaaactatcgcaagaacaaaaaaccaaacaccgcatattctcactcataggtgggaattgaacaatgagatcacatggacacaggaaggggaatatcacactctggggactgttgttgggtggggggaggggggagggatagcattgggagatatacctaatgctagatgatgagttagtgggtgcagtgcaccagcatggcacatgtatacatatgtaactaacctgcacaaggtgcaaatgtaccctaaaacttaaagtataataaaaaaaaaattttcttaaaaaaaaaaaagaaaacttaccacaaaatttagaactgaaaaataaaatatgtgaataaaaagaagctgtcactgaatgggttgaatagcaggtggagacaacattagaaacaatgaatctgaggctagatcaatataaattatcctaaataaggagaaaataagactttaaaatgaatagaatctcacaaacacgtgggacgataacaatctaaaattaatgtgatcagagactcaatggaaaagagagtgtggtgcccaaaaatatctgaagaaaaaatgattgaaaatttcccaaattgggcaaaagacataagttgacaaatttaagagattgagcaaactccaagcaggataaatccaaataaatccatgcccaaatacataacaataaaacatctgaaaactaaagacaaatttaaaacttttagaaacagccagaaaacaattattacctacagcattaaaactattcaaatgacagcatatttttcagcagaaatcatgaaggccagaaggacgtgtcataagacttttcaagtgctgaaagaaaaagaaaaactgtcacccagaattctatgtttggcaaaactaactttcaagtatgagggtgaaataaagatattctcagatgaagaaaatctaagaaaatttgttaccagcagaactgccttaaaaatttttttgctggaggaagtaattccgacagaaaataaatgataacagaaggaaatgtggaacgtttggaatgaagatgagcctcggaaaggatatattacttttctattgctttataacaaattactagaaacttggaagcttaaaacaacacgttgtggatgaatattttgggcatcgcttagctggattctctgtttcagggtgtcaccaggttacaacacaggtgttggtgggactgtgttcctttctggatcttggagtcttcttccaacctcatcacactgttagaagaattcaattccttgcagttgtaggagtgaggccctcagatcccgaaggacacccacagattttgcaatgtgttcctgaataagcagttcctatcagaccatctttcttcttcaaggactgctgtggttagggacgctcatctgcaacaacacagtgtaattcagcacttctcatgctcttcttctcacgctcctcaaaaatccacctttttcagggtgatgtcaatgaagtccaacagtgagctgaacatgaagccccacctgggcctgcagactatacccaaaaagaagaagaatttaaaagaaaaaacaattagttcttatgacataatatccaacatgtccaggagacaataaaaaatccatataccaagaaccaggacattcacaacttgattgagaagagatgatcaaaaggtgccagcgttgagaagactcagacattgggattacctgacaagaattttaaagcaactatcatgaaaatgcctcactgagcaattactaacactcttaatacaaatagaaagtagaaaataaatagaagatataaaaaggtaccaagggaaattatgtaacaaaaaatataataattgaaattaaaaactcactgggctgcctcagtagtggacaagagatgatagaggaacgaaaaatcgatgaactcaaaagcatatcaatagaaatgtccagtctgggccaggcatggggactcatgcctgtaatcccagcactttgggaggccgaagcaggtggattacttgaggccaggagttcaagaccagcctggctaacatggcaaaacaccgtctctactaaaaatacaaaaattagccaggtgtggtggtgcatgcctgtaatcccagctactcaggaggctgaggcaggagaattgcttgagcctgggaggtggaggttgcagtgagccgagatcgcagcactgcactccagcctgggcgacagagcaagactccatctcaaacaaacaaacaaacaaacaaaaaactgaaaagagaaatacagaaagccaccattagagttggagactgcaacatttctctgtcagtaattgacagaataagaacacggaatattggcaaagatagaaaaatgctgaaaaatactatcaagcaaattgacctaatcgtcactgataaaacacatgacctggaccagtggaatacacattattttcaagtgcacatgtaacattcagcatgatagaccgtatgtgagccataaagcaaatcaacaaatttaaaataactaaaataatacaaattttattctcttaccacagtgaaaaccagctacaaactaagtacaaaaatatatcttgaaaatgtctttgaggacatttttaagaccaataactcatttaaacaattatctttaaatgctttatttaaaaattatcttttgggccaggtgcagtggcttatgcctgtaatcccagcagtttgggaggccaaggcaggaggctcacttgagcccaagggttcaagacaagcctgggcaacatagtgggaccctacctctagaaaaaaatttaaaaattagcccaccatggtgatgcagacctgtggtcccagctacccgggaggctaaggtgggagaatctcttgagcctgggaggtggagattgcagtgaactgagatcgtgcctctgcactccagcttgggtgacagagcaagaccctgtctcaataataataatataaatcttttgaccaaaaggaattcaaaagtgaaattataaaatattttaaattatacataatagaatttgtgaaatgttctcaaagttcagacggaaatttatagcattacttataatacttatattagaaaaggagaaatgtctcaaattagtgacccaagcatctaccttaagaaactagggagaaaaaaggaatactgtttgcaatctgtgagcattttttatatttagtgattaaaatcacagcctggctactatcagggccattttccactttctcagcatgaactcacttttggtgccacatttcttttactgtgaaataaattctttgatcagaagcaatcttgtgtgaaacagtgaataaagctagagaaggcgaatccgtgttcaaagtaagcatctattccagtgtggacaaatcaacgttccctgcttgatggggaggggcgggggttcagtggaatcatctctttgtgcttatatttttgtgcacaagaatatgacatgcttcatgaaaggaagaacttagcttagtgctaaatccccagggctcaggagggtgcatgccacataggggctcagtactttcgctgaatgaagaaatacgcttaagtgttctatagtacagagttttcgcaggggcttttcctgtgtttcttggattatattttcctcaagatgaactcttcatctttctttcgcagactgtgtttcttcctgtctttcctttcatctgggttctctcgttccccttctatcatatgtatgtgtggttactgagccgtttctttttttttaagaccgctttattaagaagtaatttatatgctgtaaaggttaccagcttaaagtgtaactggctttcttcccttagcaccgtgtttttgaggtttattcaccttatggtgtgtatcagtacttcattcctttatgtgatgaaatagtattccattatatgaatgaactacattttgtttatgtattattcatcagtgggacatttgggttgtttccacttttttactatgaataatggtgctgtaaacgagttttttagtgtatgtcctaaaacctaaaataacaatagacagataggctctccaaaggagtttatctgggattggtgggggattgcaatccaagatacccatgccacaatgaaccaagaaacacccaaagatgctggggtcaaggcaaacttttataaagacaaaaaggagaaagtcatgtaagctggtttgaaacaaaaactcttgactgttgaagctcatagctcctcattggtcacgctggctgttgctggggagatgtcttcacagcagcagcttaacatggagtgtttatggtttccagggagtccttgtaatagttcttatcataggtacatgtgcgtgagtactcctccttcagggcctcccggattcattttgctagggtttgacctaagtgaccccattttggtgctgacaactttcacaacatatctccacttctcttgggtgtatacctagaagattccccaagtcacatggtaactctatgtttaacattttcacaaattgccagactgttttcctgggcagctacatcactttacatccccaccagcaatatatgaaggttccaatttctccacattctcatcaatacttgttattgtgttttctttttcttttattttttagagacagtgtctcgctctgtggctcaggctggagtgcagtggtgtggtcacagtgtcgatgaagagtccaactctgtaaaatatttgaagagatttattccgaaccaaatatgagtgaggcacagtatcaagaggtcctaagaacatgtgcccggtgtggtccggctacagcttgaatttatacattttagggagacataagacaccagtcaatacatgtaagatgcagactggttccatctggaaaggcaggacagctcgaagcaggggcttccagatcatgggtagattcaaggattttctaattggcaattggttgaaagtgttattgtctaaagacctctaatcaacagaggggagtgtctgggttatgataagggattgtggagaccaaggttcttatcatgcagatgaagcctccagattgcgagcttcagagagaatagattggaaatgtttcttagactgaaaaaggtgccagatttgtgactgattctctgctgtgtcagggaaaagacctgaaagggaaggggattctttgcagaatgtagatttttccaagagacagctatgcggggccatttcaagatatggcaaagaaacatatttggggttaaaatattttgatttatctgtcatgtgatgttatgccagagtcaggttggaaagtaagccacatcacatagggttaaataaaactgctttgagattttataaggtgcaactccccagccccttagataggaatttgggcaagagggaaaaaaggtcagagtttagtcctcagtagctaactgtaactccacctcctgggctcaaagatcgctcccacctcagcttcccaagtagctgggaccacaggcgcacacctgcttatttttatttattttttttagagacaggcgtaactacgttgcgcaggcaggttaagaatgccttttattatagtcattctagtgggtggtgagtcatttcattttgttctcatgtaaaaggacaacttcataatatgtgaacaaattcccttggttttctcttcgagcattttgcaagttgtattttgtgttctattctacattccgtgccctgatagctaggagtgaggcagggaaaagctcagctgagactatatctttgctagaatatctggtctctggtttcttgactaggattttctaaatgtcctgaatcaaagtttcctccccagggaatgatgcaatgacccctgggggtcaccccaggctttggatcctttatctggttcagcagggaacccctgaacccatcagagtccctcctgtttgttcacgagccctctctcactggtctcttcccagcagcccttttcacttcccccagcagtaacaggagaaagatatagatacctctctttctccgaattaacctgtttttcctcaccagtgagacccccccaccttttttttttttggagacagagtttcgctcttgttgcccaggctggagtgcaatggtatgatctcggctcacagcagcctctgcctcccaggttcaagcaattctcctgcctcagcctcctgagtagctgggattacaggcacctgccaccacgcccacctaattgttttgtatttttagtagagacgggggtttcaccatgttggccaggctggtctcgaactcctagcctcaggtgatctgcccgcctcggactctcaaagtgctgggattgcaggtgtgagccaccacgtctggcctccagtgagactttctgagttttgttgcgccagcagggccatttgcgggagtaatcttacacacctgagcaataattttttttccctgtattcacaattttttgacgtttttggcatttggctgtatccttttgcttgttcgctgtggagttttcatttgtttgctggttttgggcaggaaggaggtgctggcttttcctacagtgtgtttatcatttaagtatttgagaagggagatgctgcaatccagctgcactctaccactttaaaaattctcagcaatacttttaggtgtttagcttactcccagcaattcctccttactcattcatcaaactcctagtcactgtgcacctgctgcatggccggcagggctctcagagctgagctacagcagagaaccagagccctgccttcgtggagccttagtaaattatgtccacgtgtctccatcaaagcgtattttgcataaaagtgttgtgtttatggaagacaatttcaatacatttaaaagaatttaaatcaaatttgcctaggttacaaaattaaccaataggtctagtgcatagcatcactacagttatcatattataaatttgctaagagtagattttaagtgctcttaccatgaaagaaacgcatacgatgtatatacaataaaagtttaaaaaatgtgtctaccccctaacattcatgtgacacttcatactctaccaaaagggcagaacagaggggaagctttagagcaggagcggaggaatctgcctccatttttcctgggtgtttttttttttcctttttatgcatattctacttatgtagtgccttcattttcaggctttttcaatgttgtatttgagaagctgcatcaggtacagctcattttccactcattgcttacaggatgaattaaaatcatttgcatattccgtagctgatgatatatgcccaaaataaatgcaagtctggcataaggcattaaaaaaaaagtacagagaaatgaagttgtgtggcatagagaaggtatttttacattttaaaatcttgaagcataagatctttgaaaaaatctttttatacgcaccataaaccagttgttcctcagcaatttgcagaaatcagatcaacatggtgttacagacaaatatttacttgaagccaatttctatatattatctccttgcagccacctcaactgccagtccctggaattgtacacagtcccttcaaaaccttgaggacacccgtggcattaactcagcaaataaatgagagcctctgtgtgcacggcattgttctagggacaatggagggggtagacataaataacccagcaccttcccgtgaggcattactggggtaaatggaagagagctgacaaagcaaggtagagattcttaaggggaaatcatgacagatggcctgctgcagtgataaattctgagtgtctagagaactatcaatagaggatggttgactgatatggttcccaacctgtgtgaacaggatggctatctaatcatatccctgggtcagagcccatagctcacacatgatggactgagtatttgtgtcttttccaccccaaattcacatgtggaaatcctcaccactgtaatgatggtatcaggaggtgggacctttgggaggtgatcaggtcatgagggtggagctctcaggattgggattagtgcccttatagaagaggccccagagagatcttccctgcctctaccatgtgaggatgtgagaagatgttatgaggaagaaggccctcaccagataccaaatttaccagcaccttcatcttggactttctagcttccagaactcttaagaaataaatttctgttgttaagccacgccgtttatggtattgttatagcaatcctgaaaatctaagacagcagaggaatagaacctgaaggtcagactccaacatggcattttgctgccagcagaggcccatgggatttgctacaagagattgcacccacactccctagtgccctttgaaagtatagttttactttgcagtttctttttggggctgtgtatgagttcatcgttcataaatttgtttgtactatttgaaaatctcttcgtatttcctgctagttctgtctcaggccatcagctctatcaaagtccttgatctgaagcattcctgactggcttacatccttcaggttccaagggctatgcccttgtgcaaactttttaggatttgggaacaagttcatttatgcctcctttcatggattctgaatctttgagctttactctcagacactgcagcttcattatctaattcaggccccagagccacaaaaatggttaatcaaggatgctgttacctatttccaccaagggcaatgcatacttcctactaacttcccaccgactccctggttccaccttgcatggttgctcaacagggaagtattagattctcttctacacagagctacataaggagactcaggagacatttttattatagttagcaaaggggctacttcttgaagaaaagatcgtcttctaaagaaacacctgctcaatcaacagtttaacggatacaaaaagtgtgtctttgctctcagaaagaaaggtccacataaaccgggttactcccatcctgaagaactgctcatgctctgtgacaagttcctcgtaaacaaaacaaaacaaaaccagtttttttttctgtttctggaactagaatggggaagcaaatgtaatggggatgcgccacctagcgacgagagatggaactgtcactcaactaagaaaaggactgtgctttaaacagcagcaagtgatcactgaaacctttcaggtaaactgaaatcaataaatcatctgctgaatgaaatatgcagatattttatagcttctagatatgatatggtggttaacagtcttctggataatacacacaagtgtttaaaaagcagtaactcagatacccacatttgaaagaaaaaatgctaagtttttaaatgtttcaaaagcaagcttgagtaaaaatctttttgaataactgagttttttttccccgataaagggtctataacagatctatactcaaaaacatttatatatttccactgtgtcaataaaccagccaattatgactctgttagaatggagtaatgccctgaaagataaaaatgttattcttaacaataaaggtaagttgtaatgattattcaagattatatttaatatagaaaacaggcccacagtatttcttaacttgcaattttattaatttttcagtactcttaccttttatatactactaagaaaatttaaaccataactagacataaacattctgcagtttaattcaaattttcatatatacagaccagactacatatgtattacactgcaaaacttacacatgactgaagctgagcctaataacttcaattagccaacaacagaaacactcccacttcctgcagtcacagcaattagctaacaataaaaacactcccacttcctgcagtcacagctgaaagacttttcaaggcagactacatttgggctggagatacaagtgatgtagtttgacttgggcaatacaaaacaaaagtcataggaattaaatggattttcaatcactgtataattcattctcctggcttaagtacgttttaattttttcacagaaaaaaatatatttcaggcaaataaaaacaaattccagattagcatagttcagcgtttcatttatcttacctttatcaaggcaaacaaagtacagatgctgtacattaaaaacatagaaatatatcactcacaccacatcaactcctacggacaaaagggctttttctaagccctgctcctttctgaagcacacaccacagctaaatgtacaaagagccatctgctggtccaacatagccaactccaatgagcaggacgtctatcagcgtccatattcccaggccaccgaagctgaagagcttgccgaggccttcccgccactggcccaggtagaaacggtctgctccaaacccaccgagggtgatgctgcgatggcaaacagacaggattccatgagaccacctccaccccagctgtggccagtcacggtttaatcaccacattatgtcagatttgagaaagggcttcccctgatcgtagcccttaactggaacacaagtgactatttcacaaactgacaccaccaaataattacgggcaggaagacagtttaaatgtcaaaagtaaacatacaatttttagctgtactaaaaaaccaatgttttctttttttaaagttatcaatctcattgctttttagtcaaaataaagcaaagacccagtctaacaggaagtgcactaacacggggtcagggctggagtcaggaggagctcaccaccacctggacgacctggatcaagtcatccatgttttcagtctattttttcattcatctctaaaatcttaatgttaggaataaatccttaaaagatttaaggatcttttaaattctaagatctaataatactgaaactatattatggaaaatttctaaacacctaacaataaaaagtaaagagaacagtacccatgactcagctccaataatcaacacttggccagctgtgtttcatcaaaaccctcctctttcccctccagagtaccctgaagcaaaccttgggcatcatctcattacagtgatgattttaaaagaaaccatgttgccgggcgcggtggctcacgcctgtcatcccagcactctgggaggctgaggcaggcggatcacaaggtcaggagatccagaccatcctggctaacacggtgaaaccctgtctctattaaaaatacaaaaaattagccaggcgtggtggcgggcgcctgtagtcccagctgctcgggaggctgaggcaggagaatggcgtgaacctgggaggtggagcttgcagtaagccgagattgagccactgcactccagcctgggtgacagagagagactccgttaaaaaaaaaaaaaaaaaaaaaaagcaaaaaaaaaaaaaaaccatgttgagtgctgagaagttttaattgttgaaagtatgttacagtatagtactgtaagaggttaacaatgtagggaaaccaggttaggggtatataagaactctactatctttgcaacttttctgtaaattaaaattattccaagtttcaaacatttatttatttttttaaaaagccagttgttaatttgaaccattgtcagcaatggttactaatctttttttttgagacagaatctcactctgtcactgaggctggagtgcagtggtgcaatgccagctcactgcagcctcctcctcctgggctcaagtgatcttcccattgcagcctaccacgcagctggaaccacagacatgaaccacgatggcaggcttttgtatttttggtagagatggggtttcaccatgttggccaggctggtcttgaactcctgacctcaagcaatccgccagcctcggcctcccaaagcgctgggattacaggtgtgagccatcgcgcccgccctatcttatttttgttagtctcattttctatcctggcaccctcttttacttttcagttacacttttcctgccaggcaagatccttctttcctcagctcaaattctaatgcagtggttctcagcaaggggcaattttgtcccctaggggacacctggcaacatctggagacacactgtcacagctgcaagggatggggggtttgctactgacaagtagtaggtagaggccagtgatgctgctcaacaccctgctatgcacagcacagccccaagacaaaaactcattcagcccagaacgtcagcagtgatgaggctgagaaatcctgccctatggctgcaatgctgcaggcctcagggtctcaggcacgaactcaaaacttcaagtgtaggcagcgtaaccttttcactaatcagttaaccagggtcttacctgcccttccctttggtgggaagaactgctataatttcttaaagtactgttgagaagtttaacaaacagcacatttctatgtaagaaatataagcctataattatctgctgctgatgaaattataggtaatttttaatgtttttgtcattttcatttttccagttttcagtgttcatcatgtattactttttataatagttacttaaaattaaagatatacatcataaaactgcctattttggatagtccacagcattttactgattcgtggtacattcagaatggtaaacgtaatgtgcaggcatcttgggagaaaagctaacatgcctgccagtcaactccacggaggtactggtctgatcatctaaactcttccagctgtttgctagagtctaacacacgtggtaggatctgagtgaagaatgaaggggactgagctcaatgtctgaagattccaccaatcccaaagaaatgcaaacggccttttacacttacgagtaacaaggcttaccttagagccagagccgtagaccacttatagcctccagtccaattgcaatatagcattttgggaaaagtacggttaccttaaaaaaaaaaaagaaagaaaaatacagggtataaaaaatactctcagaaagacttaattgtaacaaatgggctcaaaatttaaaatgtgaaaagtcaactctctttacggtaatacatgttgaagtgaagagtacaaagcgcttaccatctatctacatagatgtaatatttaaatcagctaagttaggattacaacgtgaggaacatgaaatgctcacccacatatcaagacctacggggaagttacgagtatataagacagtgtagtcttgaggcataaaaatcacccaataggaaaagaagagaaagtcaagaaccagaaatatacaaacacttcatgtatgagtgttatgacagaggtcacacacggatcaacagggaagagttgagacaactggccatccatgtggggggacaattaaagtagaatctacctcacaccatctaccaggaccaattccaggtggattctaaacctaaatgtgaaatgttatacttacaactttcaaaagaaaatgtagcaaattgtctttattaacctggggtagaaaaagatttcttaaaaccaccacaaaaaaggactaactctaataacttccagtaattatatttttaaagttctgttcatgaaaatatacaataatgcaaaaaaaaaaaaaatcaaaatctgggagagggtttcagggacagcacaggtaatatccaaaatataaaagaagtctagacaactttaagaccaaatttaagaataaccactcttggagagaatatggctcatcaggaacagttacatagcgcgggtgggaatgccagtcaatacagccatttaaagaatgacacacgctggaaagtacatgctgaagaagctcttgcacctgtgccattgggagacaggcaaagaaatttgaacagtcacaacagcggaaaacagcacttaaccaaatatattggagaataaactgtgatacaatcttacaatagattattacacagaagtaaaaaaaagaagagaagtcacgtggatgaatcctagagccacaatgtttaggaaataagcaagtcccagaagagcacacagcctgaaatcattttacacggttctaaaacatgcattattgaatattattttattacatatagacaataaaactacagaaaaaatttaaaaggaagtgaaataaaaaattcaaaagggtggttaccttggaagaggaggaaaggcaaccaggtgaaggcaagcactcaggcactcaggcggccgcaatggtattggtgctgctttcattgttattttgggtaaaggtcaattactgtgtattatgctttatacttcaaatgtttttcttattttatcaaatattacatttaaaaagaactgcaattttctggatgctttactttagtacgttgagtttattgatgatgcttggcacatctaaagagctgctgataaatgtttctaattaagtaacttgactcgcaaatttctggttaaagtcccttcaataaacttggagaaaaacattttgttgacaaatgtccttgaactctgacctacccaagcagtggacgtggtcccgcaccgtgcagttggcagggtagcgctgccgaggacaggacaccgtcatgcagctggtggagttggtacactcgtaatctgtttcaggaagctgccagcaaaatctgcaagtcatgttaatgatgaagttcttttgggatttgaagtcttgatcctatgtagcaaatgacacaaaactcatcaatcacaatggtgtagtctgttaagatgtcagtaagactacacagtcacatggcacaaaattccgtaaatgcttgtatttaggacctaggagtaagtgccagaaaaacagttaccaaaacaatatgtatgtaaaacaaatgcctatgatgtgacctcataatcataaaactacacacccaaacatatgtacttaagggaaaaaactagataaattcacatcaaaatagcaaaggttatttcagggtgatataattatttcataacttttgcttagctaaatttttcatagtaaacgtatacttttataatgcagaaaagaggaaaatttattttagaaagtcacaatcacggatggctggaaggaactgatgaatgcatttgttgaaggtcactgagcttcaagtgaggagtggaatccaggtccctgaactccagcctgatgcttctgtaatggttaacacaccgccttgcttccgagttgccaaccttccctaacatcccctaccttgcacagcctggcaactcagggttgttacagctgctcctaccaccagggcatgtggcatgtttaatccagaggcagcccaactcagaagcaccacatggtgtgtggaggctcagtgagtgttcactggtggccagagaatttttcatttcaattttaaaagccattattttgtattctgcttacaaaagtagaatgttctttgtatgttacatatttgaagattatagacaaaaacctataggtgttcagagctaaccacttttaatcttctttccgtttcttctacatgtatatttataaatttactaaaatggaattatactgaaagcactttgtagtctttttactctacctgacattacattgcagtgcatatttttcaaaatcatttttatgtggtcacacatctctggaagcatcatgtatatatatgtatacatatatatacacatacacacattatttttttttctttttttgagatggagtctcgctctgtcgcccaggctggaatgcggtggtgcaatctcggctcacttcaacctccgcctcccaggttcaagcgattctcctgcctcagcctcctgagtagctgggattagagacgcaccccaccacgcccagctaatttttgtatttttagtacagatggggtttcaccatgttggccaggctggtctcaacctctgacctcaggtgattcacctgcctcggcctgccaaagtgctgggattacaggtgtaggccaccacgcccggcccatgtttgttattttttttaacatttcacaaatttgcatgtcatttttgcagaagagccatcctaattctctctgtatggttccaactttggcatatgcgctgatgaagcaagtactattcattttcttatcaatgcaaaaaccactttttatggaaaacattcaaatatgggtaaggcatcacttgatttaggcaaacagttggatctgcaaaataatacgtttacatctgcctattttcagtgatgtgcttaaaacacactttttttaatggttttttaaaaagtaggtgacacatgtacatggaacacatgtcaagacacaacaggagagtgagaagtgagccggcctcgtctggcccagccgccgggagcccctgccctccccaggccaagtacgctctgtgcttccagagagagctgattctacacataggcacatttatgtcacctacatttaatgttccccaatactttcacttaattttggacatctatcagtacattacctctagagctgcctagttctttttaatggctacaaggtgtttattctattacacgtgtaccataaattaagcagttcttagacatttcacttcttttgaatcttttgctttaatgagcaatgcagctaaaaaataagcacacttatctgcatccatgtataatgatatctataacataaattcctacatgtacaactacgagctcaacgattgtgtgcatgtgtaagtttaacagatatggcaaatcgcctacaagaggttgatcaatttgattacctattaataagatatgagcatctgacccttatactctcacaaactcagagttaatcaaattaaaaaaaaattgccaatctaagggttaaaaatgtattaattaaatactatgagaaaacttatatgtttttcatgttatatatctatttgtatttcctttcctatgaaccatctgctcatgtcctaacactgtttttctacaagactgtcatcttttccgtgtgggttttaggaagtgtttatatattactgatattactgtattatttgtcacatattctagaaacgctttttcctagtttgccatgtcttttgcctttatgcttttttttttaggtcatgcagaaatctccaatttttaggagtcaaatgtatcaattctttattttatggcttctaaactttatttcatacttagaaaaatattctccattttgggattataacagcaactatctggtgttttctgtggtacttcagggtttcatttttcacattacatctttggactatctggaatttattctggataagacaggcgttccacttaattttgttctagagagctaccaggcattccggcatttactgaatccatcttctcaccacagataagcactggcccttcaaaagctcatctatggcagaaagacactgccaccccctctgtacactagctgtcactattgagaacacagaatccatctgaacgaattagacttgcttcagatatgctagtagactgagatcttctccagtcctacaaagcaacatttctgtcaagtgcatttccagcagacatcaactggcttgacagttatcattataactaaaacagtagtgagctgatatggaaaggtctattgggttttttaatttatttctgcttacatactcaaaagggaaatcataaaagaatataaaaattcttcagaatttcttcccaataatcaagtctgaattgttcttctaacttaaagtttacaatgaatttatttagaataagtaagctgcagtacttacaacacaggtaacagatggtttcactgcacagtcaaaagtgacaggcttcccataggtacaggagaaatttgttgtgcagtctatacagtctgcaggaagcctgctacacaaaccattgctcggacacttcatcacataaggtgggatttcagtactttctgtgagaggcaagagagaagcttattctcctataatactgattcgaataacagagaacaatcttctaaggttaagagacgtgatcattagcaagtagacactgcactggaagggaagaagcatgggactggagtcagagacacctgcaattaaagcagaattctgcccacggccagctgtgggacctggtgagcaccacacttgtaaaacattacttcattcctgcctcccacgtggccgtgaaaactaaaggtgctcatatacaaataatgtatagaaaattctgggtatacattaagggcttaaaaaaaagactatcattttgtaagttgaaaaaaaacttacagtagggttttgcaaaatcacagaggaagtctgtggcaaaactggaactagaacccaaatctctccatttccaatcccgtgttcttttcatctgaattcactaattcagaaatgaagccactgacatcctcagggcatcaactttaaaatgtcattatttcacactggtacttcgataagccacatttgctaatataatatttacagttttacgctaccaaagttcaaaacagttctctactttaataacatcttcagtaagctgcaacttatttccaaccaacctaatgagtgtgcaatgtatttttaccaactgaaaggatcaaaattgcaagtattcctgaaaagaagggctttcaaaagcctgcaagagttaagaactcttgtgctttctctaaaaagtaatctgagtttaaaattcaagtgcactgctgttttttacatccaaataagaatcagtaaaatatctctgccagtttcaattcactgaagtaatgtcactttaaagtgatgaaattatagtcagagcctccacctagcaaaacacactaatgcttgtttaaaactggtcctactttactcactgtattaaggaacaattctacaaaatactctttttgatcccgtgactatgtggctggaaggtggacacttagaatcacaaagcagaaatgactttaggtcgtcagaccaaccccaccgctttaaagatgaggaccaaggtccaaagaggataaataatttgttcaagatcccagtagcaaaaccagatctagatttcaagtctccatcagtcccgctgtaatccttccatttccacagtcctgagggagcctttaatattccaacatcaggaacagggttttagcagtagaggaaatttgctgaagggaaagaagcacggactgaaggttattttgatggatgaagtggaaaaataatagaaataaggtgacaaatgagcgtgggattggaaaaagagaggaggcagaaacgtcaaaaggtataaatacgaagactatctactgaaaatggctgtgtatctacccttaattcacataatctaaaatacaataaatattcaaaaatggaaagtgacttcgtatactaaagggaatttttataaaaacaaagagaaactactagagataactacatgtatttactagaatagaaaacgtctagtacctgctgccctgggaactactgtgaatgtgcgtgttgggcccggatcctttattgactgagccagcgcctgcgattgctctaaatttaaggatcgtacaattagagaaacacgttatcccgggacaagaaaaccttattttgtgtggttaacacggcgggtctacaccaggccaataagctgctcatgaaaacctcacggctggtcagccagaaaacacaaagcttagggacgaaacgtcaacagagtagacatcagttcaggtcagccggcaacgagggaccgaaggatgacatcgcgctccagttccgcctccccggcccagcccccaagcgctccatctccgtgccagggctccgcagccgcgatggcgggctcggtgtcgccggagcggaggggcggcctcgggccgggcggccagggcgccagactccagatgcagcgacaagcggcccggagcccggcactcggcctcctccccgcgtcagcgtccgcccgtgggcccggcctcctcgcagctcccggggccctgctgccactcagccccacccggcgctgaacccagcctttgactcaccaccgcccgacagaatgcagaactgcgagaggaagagcagcacgcgacacaaggcgcggaggcccctcagcgggagcacccctcccgccatcttgccagcgcctgcgcacttccgggccggggggcggggcgcgcctgggagccggagcgtgaactggacgcaggcgcgctgcgactcctggcggccggcgtttgcgctttcgctgtcctcgcgcgggtcgcgggttttcttccggttgagccttctgggaggtccccgaggaggatgcgagcctgggaggttgttccatttccacgcgcccctcacgcccttggacgaggccctcacccctggttccactgcaggagacctgttaaaggtcatccgtggaccgaaatgcgcgcccgaagcaaccaagagcagaggcgggcgaacgcgggaggctggccgccccagtgtgtggtcggatgttgtgtgctggatctcgtgcgaaggttccgaggacactatcgcgtggcgtttcatcctaaagacacttatttacagtcggggaagcggccccgggacgacgagggcccgagggacccctcccctggggccggcgctcaggcctgccgcggctttcacttctggccggcctcttgaagatacgcagcacttccagaaagttcctctcaggcctggagaagcaggatggcccgaggcgctgggaagtgaggggagggtccagagcccagccctgcctggggaaggtcgcggccgtctggggagccgcgctcaggccccagcttgcggagacccttgccggtttctgtcacagcacacctgggagaaagcgctggtgacaggtgctctcctcccacccacgtgcttcgggatcgttcattccgcggtcttctgactaccaccccctcacgtgcatgtttgctgaatgactttttaaaaaatacatggaaaagtgccggcacataagccctgaatgttagctttaaaaatcgtatcacggccgggggcggtgaatcacgtctgtaatcccagcactttgggaggcccaggcgggcggatcacgaggttaggaaatcgaaaccatcctggctaacaacacggtgaaaccctgtctctactaaaaatacaaaaaaattagccaggcgtggaggcacgcgcctgtggtcccagctactggggaagctgaggcaggagaatcgcctaaacccgggaagcggaggttgtagtgagccgagatcgcgccactgcactccagcctgggtgacagagcgagactccgtctcaaaaaataaataataaaaatcatatcacacaatctgcaccttatactactacacaagcctgatatatattgttttgtttgccaactgtttcactgttcacatccctcaggaagttaactaaatgatcagtatattgaaaagagattatttcttacatttcttttgaatttcacagcatatcgcaaaataaacaatacttcttgtttggtagctgaattctctattgacataatgccattttaattcagttctgagcacgtagagcattcctctctttaaaatctgaaatccatttcagtacataaatccatggaatgtcatcccatcaaaaaagtaacaactctaggtgagcggcttagtggtggtagaagcccacagctgaaacgctggaaacactgatgcaattcatttgggaatttatttttttctaaagcggaacaaaacctaattatgaataagaaacatttaaatggcaactcttaacctatagtgcaaacaccagattccacaaaactgaattcctttgtcagtaatccaatatttagcagtagctgctgcttttgtggttgttggttagttaaaattaagtaatgattccagtttagaagataaagtttcagtgtgaattttagtagaagtcataaaaatacctgagacatattagaaaataagattttccctcctatttaaaaaaaactctgcagacttttatttgaagcccatcttttgaaaatcactaacatttcataatcatttcctagtgttttgtttcactttctcgatgaataatatttccccatttaagtttctcaaggcattgattgctggaaaatttcccacgtgccctctaaacgtcccccgtggacatgagtaaattaaacttcgtgcatgtcagctacacgttcatcgtctcctttctcagctgaggccatgagtggacccatcagtggctccaaagtcgtagaagtactaacatgttaagaaaaatacatttttaagggtcaaaacaaagttacacagaagcaaatatcagggaaggacttcaaaaggcctcctcagcattgagtgtccgtgtcttcctgagattcttcagtttatcaatggcagaagttactaaaatctctccatgaattttgttgtctcttgttcgcacgtttacagcattatctatcttttccttttctccaaccactgcagaaaagaaaggtaaagaaatgtattttaaatcagcaatttaccaaacattaagtcagcagtcccatgacatgtttttatcaagtttttcttcactaatattaaatatcatctaatgagcatttggttcatcctctgatagttaagtttcttgagggaagcaatgacttctgatcccatctctctattgtccacctgagagaacagctcttgtggtcctggggtgcagatgagaggggggagctcttacagactcacactgactgcacctggcactagggcgcaaatgagagcggggagctcttacaggctcacagtgaccccacctggcactagggcgcaaatgagagcggggagctcttacaggctcacactgaccccacctggcactagggtgcaaatgagagcggggagctcttacaggctcacactgactccacctggcactagggcgcaaatgagagcggggagctcttacaggctcacactgaccccacctggcactagggtgcaaatgagaggggggagctcttacaggctcacagtgactccacctggcactagggcgcagatgagaggggggagctcttacaggctcacactgaccccacctggcactagggtgcaaatgagaggggggagctcttacaggctcacagtgactccacctggcactagggcgcaaatgagagcggggagctcttacaggctcacagtgactccacctggcactagggcgcaaatgagagcggggagctcttacaggctcacactgaccccacctggcactagggcgcaaatgagagcggggagctcttacagactcacagtgactccacctggcactagggcgcaaatgagagcggggagctcttacaggctcacagtgactccacctggcactagggcgcaaatgagagcggggagctcttacagactcacagtgactccacctggcactagggtgcaaatgagagcggggagctcttacaggctcacactgaccccacctggcactagggtgcagatgagagtggggagctcttacaggctcacactgaccccacctggcactagggtgcagatgagagcggggagctcttacaggctcacgctgactccacctggcatacctgatgagccaaggagtggacaccagacccatgcgagccagccagaactttctggaatgtgggtaaaaagtttgttctctctagtgacccatattgtgagatgatgcaggaatctacagccatgcttcttgccacacagaaggaagaaaccggtctgcagataagtggaataaggtagatattcaagagaagcataaagaaccagagcaagacaggaacgagaaatggggagaaatactcctggtgagggttgagctcctgattgctcttctagtggtttggctatttaattctacctttcatgtcatgggatactccaagacccttccaacaaatgctgtctttgtctaaaccaagttgagatttctgccaccataagaagcctgactgaaacagcacaatacctactctggtgtcaaacattatcattgaaacactgtcaatagaacaatgctatgcatatttatttcgccttctacagactctcaacttacaagaaatagcaatactgtgcctgcagttatatcagtgttagtttctcttaattttggaatcatttttaaagcctaaattttagattctgcatctaattagtcatatgctaaaaggacattttacttttcatctaaatcttttcctttagatcattttaaatttgggatcttttctttctgttagtttaatcccaaagtttcctaataagccagaaaagtgagggaaaatattacaggcctgtgaggctgaaatataaagtatataattctactgatgggatcattttcagagttgttttcgttgtttgcttgcaatatgaactattgctagtaaaactatcccaggggattcaggtgaaactttacaactcttcttccagcaaacaacaaagagtacctaggaacagctaagctaggaatgctatggactcttccttttgtgtaagtattaaatagacaaatcatgataatcaagtagttgaaccatatttcttatttggtcttttggaattgaagtgggaaaaaaaagcatttggaaaaatatatacaaacttaaattacccaaaataaaattatactgagccagctgtgcatttcgtattttcttatttagtgtacaactgtgatccaagtcaacgtcagccataaatccttcttcaaaaaattcactggatacctagaagaaaatgaaacacctttactgttacattatggtacctagcctccaagaagaccccgttgttccccactcttggtattcacacctttgtatagttccctgctcactataccagagcgggtctgcgtgaccataaagaagtgcggaagtgtcggcgcatcgtttctgagactagtttataaaaggctgcagctcccatctctctcagatcacttgctctgggggaaaccagccaccatgcagtgaggacattcaggcaagcaagcacccaggtgatgaggagctgcatccaccaactgtgagcgagccccgagctccgcagccctggctgacagcctgactgcagccccaggagacgctctgcgccagaatccaccagctgagctgctcccagaccctgactcgtaggaactgtgagatcatcaatgtttgttgtttaaagctgctaagttttggggtcacttgtgacacagcaacagataatattcttccctaatagagctgtgtagaaatgaataattatgatatgttttaaaatactaatttctcaaaaaacattaagaatgaaatagttctgagacagctgcagagacatgattcgtgtgttactcccacctgctgaaaacacggtttaagctaatgtgtcagttctgcaatattttaaagcatgaaggacactccaaatcgatgacctacacagaatacatgcaagattattatgtactttaaacacctctgattttacctgaagtgcatatttttcacaagttggccccacagggatgaccatcacctgacgaggagatagccagaaaggcctgaaaaatatatataaaatatgtattttcaaagtgtaataatggctacttattacatgattttcaaataaccaaagattcttttaaagacttcacaagagggcagtttcagtagcgcagcatggaagaaaactaaattatattaaagtttgaaggcagcaaagtaaatgaaaggagaattttggaattttgatagcacaagtgcaggtagaatgagctggcagacagcccaaagggctgagcatgcacttactgtctgccccagcaattgcactcctggcatttgtcccagagaaatgaaagcgcaggttcacacacaatactgctcactaacgtccatagcagctttatttataatagccccaaacaggaaacacacaccccaaatgtcctttagcgggtgaatggccaaactgtggtgcatccacactgtggaacgtggaacaccatcagcaaaaaaaaaaaaaaaaaaaaggaaccaactaatttatctcgaaacaaaacaacatggatggctcttaagggaattccactgagtgaaaaaaaaaaagcctacttcaaaagtttgtgtactctgtaaatccatttatgtaatattctttatatgacaaaatgatggagctagagaacaagttcatggctgtcagataggaggacagggtgggatggtttgagtgtggggaaaaaagggcagcaggagggagccttacaagtgatggactgtcctgtgccttgactggtggccttacaccatctgtccgtgtgacacagctaaatacacgttcacacaaatgagtgcatgtgaggctggtgaaatcggaacaaggttggtggacagtctcaatgtctagttcttggctgtgatattgtatctagttttgcaagatgttaccattgaggaaaactgggtaaagagtgtgctggacttctctgtataacttcttttttattttttttgagatggaatcttgctcacccaggctagagtgcagtggcgtgatctcggctcactgcaacctctgcctcccgagttcaagtgattctcctagctcagcctcctgagtagctgggattacagccattgccaccacacccagctaatttttgtattttcagtagagacggggtttcaccatgttggccagactggtcttgaactcctgacctcaggtgatccacccacctcggcctcccaaaggttgggattacaggcgtgagccaccacatccggcctctatataacttcttagaacaacatgcgaacctacaattatttcaaaatataatttttctagaataaaaaagatggcagggtaggtataaacagtgtccgctgtgggacatgtttgccctttccctgtcatagtgagtatttagtctgaaggtgaaaggacatgcaaggaggactatttcagatagcattttataaatgtgcatatttatatatttattctcaaattacaaacacaaaacaatacatgataaatggtagaacacagaaatacagggtatataatggcaactacatatttccttttgagctctgtccttatcccatccccagccctactcctctcaaggacccacactttagccatctttacttttggctcctggggagatttccccacaaggctgactgctgtctgaagtctggatgtatgaagtgcagggagtatacttccgtctctgcgacaaaggaaggcatgctcagtgcactggccccaaccacctcctgtctccctctccatctcctatttcactagttctctctcttttctttaaaccactttcactgcaaccattctaatgcaaaacaccatcatctcttacctatggtaaactatttaaaaccaactggaaagaaatataaacatgttaactcatactcaggcggcatacatattcatacccatacttttggcttaactgtaacttcaacagcttagaaactccatgatacctaagtatatttctctatgatcacaaaatatcaggaatatacacagactctctagctacccaggtcttttggaagacactttgtttgggaaactttccaccttatgtttcctgctcaaaaatttgcttccccagtctcgctggacatgaatggtagtatgcatgggtgtgatctaggttctgctaatgtataaacatggcactctgacttaagacagagtggagaaggaggcaccacatggaatccattatggcaaggaaaggtgatgcagagacatggagcttttggaggaactggttgcagtgaccctagcagtatcatccggtgcccagtgtccacagtgggagctgcagggactgtgcccggcaatagtagcagtgggggcagtagtttctgaagagagagctaaactgcatgagcagatgcttagccaatttctaaaaatggaatgggaggtagaaatttcacaggtggttgctggtttgcagcatttccacatactaggatacatcatcacaagatgttgtctgccagctggtgctataactgctagtaaagccacttgcttctgaatgcatggtgatagtagtgaatcccttaatgtcagtgcaatgctttacttatttgctataaaatctctttcatagtcagaagcactgttgtgttcctggcagcacctaagtacatatttggtgccactggcagaagcatggcagcaaagaagagcaaagcaaaatccacagtgagtctctcttcagtgagaatgaggcattgctccttacatgatgaaagggatccaacgtaatcaacctgctacaagaccactggctattaccccaggttatggtaccatcccgggggatcacaattaatcactgactgatggcaacctgaattctcagaagagatgtagccagatggaacttagtgaggcaaagtccatgtctttgagcccatgcctatccaccagtggccactttgcccatgagccattgagcaacaactaggggaaaaagcagctgattttaacagaatgggtcctcttgtattggaatactgaaaaattcctcaacagcgggggccttttggtggcaataccacctctgttggcccattctgagtgatcatccacatttctgcttcccaaatctatgtaatttgtttttcaatctaattagttctaaatctttgactctgtggccaaagcagtaactagagcctgtgcatccatgtaactccttatctccggccattcttccttccgggcaaaaaggaccacaggatgcaccactcaaaaaggaccacaagatgcaccactcaaaaaagaccacaagatgcaccactcaaaattctgcactttaggacacttcccttccccactgtcatcctaaatgggctgtgctgctgagccatcctctttgagtttgtgccatttatgaatcaggtttacatgttttcctcctcagtggctgtagggaaccccaaaggcaaacaatatgggttgaaggaaggatggctggagggcaagaggtggtacctaggagtgtgggtcacatgttttcaggacagcaactagatctctgaagggcttgaaacaggtaaaaagataactttaattctaccgagtcccccaaaaggtaaatggtacagttttatgccactctcccttagtttttattttctgatctggcaaatcgaataagaattctttatttgctgtttggacaattgctaattacaaggcaggaaaggccctttcttttgttactacttttttcttttacacatgattttttaagaatagaaatatttttaaaaaggaaaaatgagtaaattaataaaaattaaaaagaataatagacatatagtttttcttttccatatcacttaccattttccgccatagttttctgaaagaatggctatcattctttccactgatcccaaaatggctcgatgaatgatcacaggtctcttcttatcatccccatccttactaaaaaatgaaaattatacatttaagtcttttcctaagattcaataactatcttctagccttatatttaattttgagaatagatttagattagtgatatcagatctctccattaaccttatttgttctgtgactgtcttgttttctcattgctttctttgctaatcttttttcttttattttaaaaactttttattagagcgcactgaaacatatacaaaagtagagagaagagtataatgaacttccacataccctctctcagcttcacaaaatgtcaactcacagccaatctcatctgatccaaatgcacccccattcttgccactatctcccacattataatcttcatttttaaaatgttcctgatatgtgttcttgaagtccactggtcaaattccctgaaaccctcatgaggtgtatcttacatttaattattccctcttccccttaggaaaaaaaaatgaaaaaagcaaatgatgacttaattgtaatgaagtaagccacttcaagatctctgcacaagcacaagcttctcagaaagataaatttcacattattgcaacaaatgtgacatgcgacacttacaaagttcttttgataaatttttatctaaaaattataccagctagctactactacaataaatgaaacaaatttaacaaataaataataaaataaaacaaacaaaaacagagaaacccattcattaaacctacttcaaatgagttgtaactggatatcatcactgccaaccatttctgctaagagccattatagaataactgcaggcaaaactctctgtctggaccctacaggaagctttggggtaggggtgagcggcttgagtccattcctatgcaggtatatgaagaaattcatcccaaaaattgaaaccagtatgaaatattcctgaatatcccatcatgttgattttgtgtagggaagaaagagaagcaaactgatcctttcacagagcctgggtatccaaaatttctgtcccatcatttctttgaatcatgtctagacttaagaagagcaaatagtgacataaactatgattacacatctgtgctatcagataaacattggaatgaatgccaaattcccccaaaataaccccagtggatttgcttacaattatattagattaatagataaatttgaagagaataacttcacaatgttgattcttctcattccaaagtgtggtacgaatcttcatttaaataactcttttttgtggtcttggagaaaaacttatagcgtatgcttataaataacatctatagtcatgtgttgcctaatgacattttggtcaacaatggactgcagatatgatggtggtcccacgagattataaagaagctgaaaaaaatttttttttaaattatactttaagttctagggtacatgtgcacaatgtgcaggtttgttacatatgtatacatgagccacgctggtgtcctgcacccaaggaagctgaaaaattcctatcatctagtgatctgtgttacaagtacctagagcattcagtacagtaacattctgcacaggtttggagctagcagcaataggctatcccatacagcttaagtgtgtagtggcctatgccatctaggtttgtgtaagtacactccgtgatgttcacacaacaatgatattgcctaacgacacatttctccaaacatatccctgtcatgactacatttatggggatgcatgactatatttatatttattaagtttattcatattttctattttgtggttgctgttgcttctgaaatgttttttccattgcatttcctagcagattattgctaacattatgaaggcaaattgatttttgcatttttaccttccattattattagtgcccatttctccatttgattctgttggatttctctatattttaacatctactaataataattttatctcttgctttcatgtatttgtaatcccagaataattttgagtaacaatacaaatagtagtcatattcgtcttcttcccaactgtgttgagatgctattgctgttttctgataaaagctctttatcgtgataaggaaatttctgttcatttcacaggaatgaatgttaacttttatctgatgcctttctgcatgctgaatgtaatgaatgacaacagcacactctcatccacccctgcttttttagggaaaaacccttactcaatcatggtgatgaccttgatgcttctctctctcctctcatacataagcctgagcaaatcacatcagttcttcctccaaaatacacttccagtacccctactttgttcatctctatgccacctggctccaactgtcatcatttcttacctggtctgcaatccactgcttccacctttgcttgcctactcgccatttgccacacaacacctatgatggctggctgggctgatttgtttctcctccacgtcctccttaaatgagtagtttcacttgcattctgatggccctaagcaattttgttgtaggactgatcctgaaggtttgactttctctctaatagttctgacccttgctcctccaaaacggagagattagacttttcggagtcctactaactccactgtaccaatcaggcaaaaagttagaggtcaactcccagaagcttttccgttttggcacacggtatgacctatgggacttggccactgggtggcgaacacatggaacagatgtgaatatcactataaaggcttcgataactgaactgacaccgaaccgcagcccacaaaagtgggctggaaatttccacctgaacctaaccaggcagattcactgccaaaacaagacaaccgccttaggatttaaacaagacacagcatctcataacataatattcaagacattcaggatataatcctaaattacttagcatatgaatcattaggaaaattttcaatttgtgagaagaaaagacaaacaacagtccagcagcaagaaaacacaaatgatggaattaccaaaggctagaaatagccattataactgtaccccaggaagcagggtaaacacacctggagtgactggaaagaccaaagtctcaggaagaaacacaaaacacgaacaacagagattgtagaactgaaaactacaatcacagaaagttttaaaaagtcattcgatggattcagtagcaacagagatggtaaagagttggtgaatttgaagataagtaaatagaatgtatccaatctgagagatatacaaagaaagactgaaggaagcataaacagcctcagaaaactggaaaaataccaaaaggtctaatattcaggtcacctgcgtcccagaaggagcggaggtatagtaccaaagaaatatggaaaaacaatacaacgtttgcaaaccaataacttacagattcaggaagttcaaaccgccacaacatagacttgaataagtccacagacagacacatcacaatcgtgtgacacataaaggaaaagtgactgcaattactgcatatttctcatcagaaaccataaaagccagcagcatgtgtaacaatattttttgtttttactttgcaagaaaataaattatataacttaaaaaataaaacccccaaactaagcagttcatcaaaatatttcagcctacagcctacagaaactgctaccatttaaaattgtacagcgttatcatctcagcgtgtagtggcacacgtgcaaatagcatagaccacatgaggacagattacaacttaggaactcaaatttgttcaacactctaaacaacatacagtgtagatgacaggaaagctctcatgtaatgtttattttacaaacatgaccttggaagaattaataagatggcatctcagttatttacataaaaatagaaaaatcagcttgagtttaagacggcaaatctttctataaaactagccaatctttcacccagattgaagttttaaaatttgctctttgaaagggctaatgacatcttactgcaaataatgtaaaatattttttaactactcaggtcatattttgtattaaatttaatacaaagtaaaagtaagaaagctaagtttttactttgggaagcgttaacatttatgcacaagatgagaacaagacttgaaaaaacaagttgatagaactcgggagcccctccaataaatgcaaacattggaagacttcagaattcatttcgagatcctcactgaatcattggagcagtaatgttctaatatttacctcactgtaagcatcaaaattgttctgtattttcccttcataaattttatttcatgtctacttactctggaaatgagatgcaacaaaggttaacacaaaaatggatgtctctgtttttaaattagaagatgagtgttctaggtcaggatcggtggctcacgcctgtaatctcagcactttgggaggctgaggtgggcggaggtaaggagttcgagaccagcctggccaacatggtgaaaccctgtctccactaaaaatacaaagtttagccaggcatggtggtgcatgcctatagtcccagttactcaggaggctgaggcagaagaattgcttgaacccaggaggcggaggtttcagtgagccaagattgtcccactgcactccagcctgggcaacagagcaagactcatctcaaaaaaaaaaaaaaaaaaaaaaagatgagtgttcaaagtttgcattaacctcagaagcgtcctcttgctatactactaagttaatatatatttttaaacaatatttttaaaatattaaaactaaataactatcaacccagaattgtacaagcaaagaaggttattttctttgaaagtacaacaaaataaagacattctcagatgaaagaaaataaggcaattcatcttcaaccgacctgctttaaataaactgtttattctcttatatcttcagatatatgagaaatgatactagagggaaccctggaacatcaggaatgaaacaagatcaacagaaatggtaaatatttggtaaatataatataatgttctcctcctaagctctttaaaacatgtactatgattgaaaacaaaaataatattgcttatgaggttgttaatgtatatggcatgtagtgtgtagtatgccttccaaaatgaatttttaaataacaagacttgaaagtcaaaattgtgccttgatccatgggctgcagaatggatgttgtgttaataggcatgagaaaacattaatctccttgtacgtctccatcagagctcttggatgaccaggtgcattgtcaatgagcagtaatcttttgaaatgaatctttttttttttcctgagcagtaggtctcaacagtgggcttaaaatattcagtaaatcatgctgtaaacagacgtgctgtcatctaggctttgttgttgcatttctagaacacaggcagagtaaatttagcattattcgtaagggttctaagattttctgaatggtaaatgagcactggcttcaacttaaagtcaccagctgcattagctcctaataagagggtgagcctctcttttgaagttttgaagccagtcattgacttttcctttctagctatgaaagtcctagagggcatcttcttctaatagaaggctgcttcatatatattgaaaatctgttgtttagtgttgtcatcttcatcattgatcttagctagatcttctggataacttgctgaagcttgtacgtcagcacttgttgctttaccttgcacttttatattatggagatggcttttttttttgagatggagtttcactcttgttgtccaggctggagtgcagtggcgtggtcttggctccctgcaacttctgccttctggattcacatgattctcctgcctcagcctcccaagtagctgggattacaggcacccaccaccacgcccagctaatttttttatttttatttttgtatttttagtagagacggggtttcaccaaccatatggagttggccaggctggtcttgaactcctgacctcaggtgatccacctgcctctgcctcccaaagtgctgggattacaggcatgagccactgcacctggccctggagatggttcttttaacttcatgaaccaacctcttgctagtttcaaactttgcttctgcagcttcttcacctctctcagtcttcacagaattgaaaagttagggctttgctctggattagtctttggcttcagggaaactttctccacatcagcaagaaggctgtttcacttccttatcatttgtgttcactggagtagcacttttaatgtccttcaagagcttttcctttgcattcacaacttgggtaactggtgcaagaggccgagcttttggcctatctgggctttcaacagtccttcctcaccaagcttaatcatttctagcttttgatctaaggtgagagacttatgactcttctttaaacatgaatatttacaggctgttgtagggttattaattagcctaatttcaatgttattgtgtctcagggaatagggaaggctgaggagagggagagagattagggaggggccggtggagtggtcacaacagacgacatttatcggtaaagttcatcgttttaaatgggtatagttcatggtgccccctaaaattataagagtaatatcaaatatcactaatcaccataacagatagaataataatgaaaaagcttgaaatactgcaagaattacctaagtgtgacacaaagacatgaagtaagcccatgctgttggaaaaatggcactgacagacttgcttgacacagggctgccacaaaccttcagtttataaaaaatgcaacgtctgcgaagtgctatacagtgtgaagcatgataaaacaagctgtgcctgtatatatatataccgtcatgcactgcgtaacagtgttctggccaacaacagagcacatacatgacagtggtccagtaagattataatggagctaaaaatcttcccattattcaggtgtttgtggtgaggctggtgtaaataaatctaccatgctgccagctgtataaaaggacagtgcatacaattatgtactgtacatcatacttgataatgataataaacaactgttactggtttatgtatttactacactatacttttaattgttatttaaggtgtattctttcacttactttaaaaaaaaaagttagctgtaaaacagcctggggctggtctttcaggaggtattccagaagaaggcactattatcatgggtgatgacagctccatgcgtgtactgcccctggaaccttccactgggacaagatatggaggtggaagacagtgatatcgataaccttggccttgtgtaggcctaggctactaggctgatgaatgtgtttgtgtcttagtttttaacaaaaaaacttaaaaagtaaaaatttttgaagtttttaatagaaaaatgtttatagaataaagagataaagaaaatatttttgtacaactataatgtatttgtgttttaaggtaagtgctataataaaagattcaaaagttttaaaatgtcaaaaatgtataaagtaaaaaagttacagtaagctaagcttaattaactattgaagaaaaaaattatttaaatttagtgtagcctaaatgtacagtgtttataatgtctacagtagtatacactaatgtcctcggccttcacatatacttacaacttactgactcgcctggagcagcttccggttatgcaagctccattcatggtaactgtcctaaacaactgtaccattttttatcttttatacctaattttactgtaccttttctatgttgagatatgttttgatacacaaataccttaccactgtgttacagttgcctacagtattcagtagagtaacatgctttacaggtctgtagcctagaagcaatagtctagaccatattagcctaggtatgtagtaggctctaccacccaggtttgcgtaagcacactcggtgatgttcacacagtgaacaaagggataatcagtggtcccatagaacagaatttataatctagaaacagacccacatatatatgtccaactaatttctgacaaagatccaaaggcaagtcgatggtgaaatagtggcctgttcttacatcatctgatgtgtgaataatgagacacttagatgcaaacaatgaatcttgacccaaatgtcacatcttacacaaacaatgaactcacatcagatcttagaactagaaaacttttaatataaaacatagaagaaaatcttcatggcctgtacttaggcagagcttatagatatgatgccaaagcatgatccataaaagaaaaaaatggagaaattaaactttattgtatttaataactcaggatgaatgggaaagtaaagatattacaaaaaatgaaaaagcaagctacagaccagggtaaaatatgtgcaaatcatatattcctccaagggctagtatctagaatatataaagaattctcaaaactcaacagtaaggaaacaaatcactcaattaaaaatgagcaaaaagactttggcagacttttaaccaaagaggataaatgaatagcaagtaagcacatgaaaagatgttaacatcattagccactaaaaaacatgtaaaatcaaaagataatgaaatactactacacacctattagaactacttaacaaacaaaacctgacaatatcaagtactggcaaggatgtggaacatctggaactctttacacattgcaggtgagaatgcaaaatggtgcagctgctctggaaaacagtttggcagtttctacaaagttaaatatttaattatcatatgacccattcccagttatttaacctaaagaaaacttctattcacacaaaaacctatacactaatatctacagcagttctattcataatcaccaagaactggaagcaacccaaacacccttcaatgagagattggatccacaatggcacactagtcagtgacagaaaggaacaaactatcaatacttgcagaatcatggatgaatctccacagcactgtgctacgtgaaagaagccagtctcagaaggctcgatactgcatggctccgtttacatgacattctggaaagggcaagactatggtgatggggagctcattaacggcagccaggggttaggagtaggaggagtgtgtgactacaaaggagcagcacaagagaacaacagaatcataaccatcaagctgtacacacaacacacacacacacacacagagttaattttactgtattatttttaaagaagttgttggtttacagtgataaaattgccttttttcccctgctttttcaagaaaacatctcatccttaagacacagacccaatgccagcattttgtgaagtcttccccctgtaactcagggagagtcagcagcctggatcatattttcatggaactttgttcatatctctactctcatgtttacttatcttcctcccgctactagaccagaaaattcaagttgattcgcaactggattatgatcaggtaaacaaatatatattgcgtgtatagcacatatactagacattcactaatgtttatttttgcattgctaatactcaaatgacaaaaaattagaatattagtactataatatttatcacattcaatcactcacctaacatatgtgagattaaatctaataggcagttggaagtccagctgaattgtagcacattgatggtatctgccaatagcatccttgatttttatgtcaatctacaaattaaataatgtttgctcagaaaagagtatttatttttcttttacattttgctgttttgaagcatgtggtcgactcactttagggccataaaatgctccatctcctgggttcattttccacggttctccaaagtccatcaagctgttctgcagttgctttttcaaaagaagaaaaaagatacaattatacactgtatcttttttttttacatacagctcacaaaagttactataactcttcattacagtctatgttagttcaacatatatttattgagcatcttttacattcaataaactattgagcagggactacacagagatgattaaggtggcacctgctctcaaagaaacataaacatttcaactggggagaaaagatcatttataaattgttccagtgaattccaggtaagcattagggaggggtcgcttttgaccctcctcccaacacaggccccctgtgccctacacatcaaccagcttctgcctcctggtgacgggcctccacacatgaaaaagcagaaaagccttgatcacactccctcttccactctgagtctgggtgggtaagaaggccaagagggcaggccttactacttcctttttgcctttccttcacctctgcacgtgtctgggagggtcacttataatttataggggtgtggaggcatgaggctccacttttgtcttcagcctaagccaccacatgccttcaacttagcttgtagtgaagatgttccacattgaaggtgaggatgcaagtgtattaatgaaaaatttcccagagtcttccagtattcccgtgaatccagcttccctgggaagcacgtgggcattcctgagtccttggccaaaagtactgccaaaacacgagccaaactcccatcatcacctccaacatacgggtgcccatgagggggcagacttgggagtgacgcgcctcatggggaaatcagagccgtggcagagtcttagggccgaagctgccatcatcaagaaagctgactcctgggaaagctgactcctggagtcctggcagcctttcccaggacctcagtcaggatctgatcttgagagagacggagatttttttcctgggatcctgggagtgtcccgcataggcctgatcttacagaagcagcttcttttctacttaggaccagagaaagccaccccacggagacacttccggggcctggaggctgcgctcccctgttccactctgtttctcaaaggagaaggaacacaggtacatgtttccaggacaaatgaggccctcctacagcagataccaagtgatggaaagaattctggggactgcaagaagctaaaaagccaaggaaaggccaagttttggagaagaggataaagcaggggtcactgctgctcctcgggccttggaggacacaggacaggagggcacagtaggagctgccagagccgagagagcatcggatacatgaagatgtgtctctttcaaaccatttcagacacttctgaagacaaaatatttcaatgctcacctcagtgatttccaggccagggttagttattggagagaaatatctcaaaagtggaagcaggtccatccagtcacacccctgggtgacctcaggcttggctgctaaactatttacccccattaattaagaaaggagcaaaaatgctgggacttccagcctattctccccatgccaggtctatacctggtccatccccttttcagctccccacaccccaccaagtttcaaatgaatggagtaatgacaacgataccaacacctgacatctactgggcacttacacgtgcctggcactatgcctaacactccatgtaaattccttcatttaagttcaccataccctcaggaagtgggtgtcattgctacatcaccaccaccaccatcaccaccatcgttatcatcatcaccatttcatgctggatcctgatgcttatagatcttctataatttactcatggagataaagtactttcagactttaaagtctggagcaaatggctccagagctgagctctgtgtcctcatttcctcttcctgcttccacatggctgttaggtaaactgagtctgcatccttcccagggtagataggctatctcatttggccctctttgtccatgcagtggatgtggaagaagagcttaggatgggcacgggtcagtggggaggagaaggccctccttagagctcaaggctaaactgcttctgtgcagcctctgctcggcttctgcacctattaatcacgtaaaaataattgttatactattaatccagggcttctctgattcttatttctcatattggtgtgttaagctcccaggagtacagtagtcccccttctctgtggtttcatttttctcagtttcagttacccgcagtcgactgcagtctgaaaatattaaatggaaaattccagaaataaacaactcataagttttaaattgggcactgctctgagcagcaggataaagcactctcctactctgccctacctgggatgtgaaccgtcctttcgtccagagtctccatgctgggtgcactgcccacctgctagtcacttgggagctgccatgtttatcaaatcaactatgcagtatcacagtgcttatgttcagtcacccttattttcctgaaccatggcctcaaagcacaagagttgtgttactagcaatctggatatgccagagtgaagccacaaaatgcttcctttaagtgaaaaggtgaaagttatccatttaacaaggaaaaaagactcctatgctgaagttgctaagagctatggttaaaaaaaaatcttctatccattgggtaagttgtgaattagtgaagaaggaacaagaaattcatgctagtttttgctgttgcacctcacactgcgaaagttccagccacagtgcatgaacagtgcttagttaagaaaagaaagggcattaaatcccagcactttgggaggccgaggcaggaggatcaggaggtcaggagatcgagaccatcctggctaacacggtgaagccctgtctctgctaaaaatacaaaaaattggccgggtgtggtggcgggggcctatagtcccagctactcgggacgctgaggaggagaatggcgtgaacccgggaggtggagcttgcagtgagctgagatcgcgccactgcactccaacctgagcaacagagcaagactccgtctcaaaaaaaaaaagaaaaaaagaaaaaaagaaagggcattaaatttgtgggttgaaggcatgaacagatacgtgtccttaacctgattgccatcaatttggtaccatccagggttttgggcatccacttggggtcttattcccatggataagtggggactattatattccaagaagaggagaactaacaggcagagcagggtgtctggccatgacaccatcctcatttttaataaaagtgaacacaggaaacacactatatcctttgtgtttattaagaaaaaaaagcaatgtgatgatctccttatcttggttttgcaaagcttagatgtaacatctttgggcttgagtgtcttcagacagacacagggcagggcacgacaggacgtgactacgaaggggactatgcacatctacatctagaccatgcagccctgggactctacagtcggactaagatgactcaacaggcaatgctttaaaataaaccacacaaaccgagagttacagcaatcagaggatttctttaaaatcctgggccagctattagtgaccagcactgcaggactataaataaaagccagatatgaactttaagtgtgaagcaaatgtaaggtattattatcaccgtcacaaagataatgggataaccacattctacaacctatatatctatctcataatttccaggttcaaaatttctattacaaattattgcatcctcctgtgaagactgcagcctctcaggtgtcttccatacgactaaaatgaagaggaagcacaaggtgtgtctcttaccttctcagcctcattccacatctcaatctctcctaggaagttttccggccttgttgacaggtttaattgaaaggagaagccaaatgttgagtaaacagattgcaaaaactgcaaacacccctttatttcttcttcaatctgaaatcaaagcaaatgaaacattcaaatagaacatcaaattcatttatgttttaaaaaatacaattcttcatgtcagacagaaataaagcatgtttttaatggagtacagttgatgatcctgttttggttgcttatccaatcctgagctgaaccttcgtttgagtgctaggcacgtgcagggaatggagaaggagtaggcgagggaaccgtactgtgaaaaggcagcgccgcgcacaggagagcggcacggaggggctgcccagaggaagtgagactgagctgcagcaggggacaagcaaacgctctgcatggagcggaagctcaggagctctgtgagcagaggacacactgagttgaaggctccgtggacagaggagcagactaagtcggggggctgcatacgatgggctgaagggcagaggggcagtgtggtaggtgggcaggggccagagaaaattaagtgctttcaaagccaggcgaatgtatggattttttaggctgagaacaacggggaggcaatgaagggtttttgttttgttttgttttgtttaagcaggggactaacatgagtcaatgtgttctttcacagtatgtggaatgaactggcaagattagaagagagccccatcaggaagctggctgagtcaattaggagcaagatgacagtggcttaaaccagagagaggcagctgaaatgcagggaatttgatggatttgagacatcaagtctttcattcattaactgcaatggctagttttttgttttgttttgttttttgagacagtcttgctctgtcacccaggctggaatgcagtggtgtggtcttggctcactgcaacctctgcctctcgggttcaagcggttctcatgcctcaggctcccgagtagctggaactacaggtgctcgccaccatgctcggctaatttttgtatttttttttttttagtagagaaggggtttcgccatgttggccaggctggtctcgaactcctggcctcaagtgacccacctgcctcagcctcccaaagtgctgggattataggcatgagccactacacccttttttttttttttttaagttcctgggtgcacgtgcaggatgtgtagtttgttacataggtatatgtgtgccatggtggtttgctccacctatgaacccgtcacctaagtatttaagcccagaatgcattagctatttatcctgatgctctccctccctcctcttccctccgacaggccccagtgtgtgttgttcccctccctgtgtccatctgttctcattgttcagttcccacttataagtgagaacatatggagtttggttttctattcctgtgttagtttgctgaggataatggcttgtgatggctacttttaagtgttaactcgactgagctaaaagatgccagacagctggccacccttacaacatttatttctgggaatgcctgtgagtgcgtttctcgaagagatgagcatctgaatcagtggaattggtaaacaacttccaccctcaccaatgtgggtgggcctcatccaatctgttgagggcaggaatagaactcaaaggcagaggaaaggcaaattctctctctttttgagttgggacatttattttctcctgttctcagacactggagctcctggttctcaggcccaccaactctgggacttacaccagctccctcctttgctcaccccactgaggcttttggccttagactgggagttataccatcagctttcctagttctccagcttttttttttttttgagacggagttttgctcttgttgcccaggctgcagtgcaatggcacagtctcagctcaccacaacctccacctcccgggttcaagcaattctcctgtctcagcctcctgagtagctgggattacaggcacatgccaccacgcctggctaattttgtatttttagtagagacagggtttctccatgttagtcagtctagtctcgaactcccaacctcaggtgatccacccacctcagcctcccaaagtgctgggattacaggcacgtgccaccaagcctggctaattttgtatttttagtagagacagggtttctccatgttagtcagtctggtctcgaactcccaacctcaggtgatccacccacctcagcctcccaaagtgctgggactacaggtgtgtgctaccatgcctggcctttctccagcttttaattggcatatcatgggacttctttttttttgggggtcattttttttttttttttgagatggagtatcactgtcacccaggctggagtgcagtggcatgatctcggctcactgcaacctctgcctcccaagttcaagcgattctcttgcctcagcatcctgatagctgggattacaggtgtgtgccaccacacccagctaatttatgtatttttagtagagatggggtttcaccatgttggtcaggctggtcttgaactcctgacctcatgatctgcctgcctcagcctcccaaagtgctggaattacaggcatgagccacctcacccagcctgggtcatattttttaatctactatgtcaatctcttttaattggtttatttagaccatttacacttaatatgttagggctttacactgcctttttgtttccttcttgttctctcttgttattcatttctgttttatttttcctgtcttcctatggattactttaacatttttctggaattcaattccaatttatctataggttctcttagtgtatccctgtctatagcttttttttttattggtttctctaggtattatataacttatcagtccagatattgtcactttaccagctcaggtgaagtacaaaaacttttattccctataccttaccccatttatagtataattttcttaaacatttcttctacatacatttagaacatcagaaagaacatgtgatttttacttcaatgatcaaacataatttagaaaacgcaaaaggagaaggaaaatatattgtatttacctgtttttattttcacaatctttttcttcctaaagttccctgattcctcttttcatcatttcctttctgtttagaaaacttcctacagccattcttttggtgggtccaatgtcttgatttcccctcaattgctgaagggtattttctttagacatagaattctgggttgaaaattcctttttcttttttcagcactttaaaagtattgtgccacttccttctggcctccaggatttttgttttttgttttttaatgagaaattgctatcattcaaattgtttttctctttaaaggtaatgcataatttctctctcattgctttcaagcctttcctttgtctttagttttcagtttactatgatatatcttggtgtaggtttcttggagtttatcctgaacagctttcttgaatctgtagatgtcttttgccaaatttggcaagttgtcagctattatttctttgagtactttttcactcccaccttcagtctcctctccttccaaaattatgatgatatgaatgttagatatcttgttatatcccactgttctcaggctctgttcttttctctttcagtctgttttctctatgtttttcagattgtgtaatttctgttcttgtcattatgtctgtcttcaccattctgctcatgaatctattcactgaatattatatttctcagttcaaaatttccatttggttcttctttatatcttctatttctttcctgagattttctgtttcttcgctgactttgtaatttttgtttgtttcaagtgtgttagtaattgctcattagttagtaattgcatttttatggtggttgctttaaaatctctggcagataattgtaacatctttgttatttcagtgttaccgttcatagattgtctttttaaattcaagttgagatttttcttgttcttagcatgatgagtgattttcaatttcttaaacctggacattttcggttttatagtaagcctctggatcttaaatgttgttttagctgacttccactgacactcttccagcagagggaggacagtactggacagttactggcaagtgggaaaagcagtccaagctccttttagaaaggaagtaaggggagaggagctcctcgttacttctgggttgcacaggtgttctagcccccctccatggcctttactgcacacagaaagcatggcctcatgaccaattggcagtgagaaagtcttatctttccactagacgtcttctgacactactcaagcaggactggaagaggcacctcattacttccaggggagggcaaaagtccaggctccccacatagtcttcactgacactgctgggttgggggagggggatgggatcttgttaatgcaggagtaaaattcccagcttcctaataagccttctcttacccattccaacaggtattgaggtacttatttagagcctgctgagagttaaaatataagcttctcaatcagccttagctggcatataaagggccacagttttttctgtggtgtctggttgaaatagagtagatattgtctaaaacttttctatctttctaggctgcccctttcctagtcctttggctacagcaagcagacttctgttggcctgttttatcgatgcctgttggcatctgttggttgccaagtctggaatatatgtggcaaaacaaaacaaaacaaaaacacctaaggaactcactaccatgttgtttcttaggtcctgatgtccatagccagtgtgccctttttctcaacacctttcagagtctcgtgtttgttttatatgtaatatccaaggtttttacttgttcttagagggaaggaaagggaaagcacctgcttcatcttccccaaagcaggtcttttttgctcattgtttaactgggttgtctgttttcttattgaggtttgaatatttgttaagtattctggattcaagtcctttatttgatatatgcctcacaaatattttctcccagtctgtaacctgtctttcctgtctatgatcagtattttttgaagagcagaagttttaaattttgaggaatccaatttatcaacttttttcttttatggattgccctttggtgtcatatctgagaaatcatcacctatcacctaattacaaagattttccccaatttttattctagaagttttgtatttttatgtttgacatttaggcctgtgattcatcttaattttttcatatggtatgaggtatgaatcctcatacctcatgttttgcatatggatacacaatcattccagcatcatttgttgaacatattacctttcctccattttattgccttcgaatcttaattaaaaatcagttgtccatatatttgtgtctatttctagactctgttttgctgatttatctatctagaccagcatgattactgtagtttctcataattcttgaaaccaagcatagtgactcttccaaatttgtttttatctttcaaagttcttttggctattctaggttcttgtgctttctatacgaattttagaatcagcatgtcaactcttacagggaaaaaaggtctgcttgggtattgactgggattgtactgactttatagatcaacttggggataactgatattttaataatatttagtcttccaaaccacgaacaaggtatatttcatttatttaggccttctttaaatttatctcagcaatgttttaaagttttcactgtataggttgtgtatgtatgtattactcagcttgggctgccagaacaaaaatccataggctgtgtggcttaaataagaatcatttattcttcacagttctgcaggctgggaaatccaagatcaatgtgccagctgattcagttccctggtgagggctttcttcctagtttgccaacggctgacttctcactgtgtcctcacacggcagagagaatcagaaagcctctggcatctccttaaaagggcactaatcgtatcatgagggttccatcttcataatctcatctacacctaattacttcccaaaagccccatttccaaacaccatcacattgggggttaggacttcaacatataaattttgggagtcacaattcagtccatagcaacatatttgtcagtcttatcccaaagtactatcatatgttttgagatgctattacaaattgtttcttatttgcaatttccaagggtttattattatgaaatgcatatacaattcatttttgtatgttgatattccatactacaatttttctaaattcaccttacttctaatagctttctgtagattccatctgatctctacatagatgatcatgtcatttacaagagttttaattctttccaatctaggtgttttttatttctctttcttaacttactgcatcagaaagaacctgcagtacaatgatcagagaagtaatgagataatccttacctaatatctgattttaagagtaaagcattcagactctcactattaagtatgaggttagctgtaggtttttcatagaggccttttatcaggttaagaaagttcccttccattcctagttttgagagtttttatgagatatggatgtagaattttgccaaatacttttccctgcatctactgagaagataatatgctttttgtctttttgtttgttttcttttttttagtttgtgaatgtggggaattacaatgattcattttctaatgttaaactaccttttcattcctgggattcagtccatttgattaagatgtcctttttaaaaaattactagatttgacttagtaaaatgttgtttaaattttttgattttatgttcatgagagatgttcagtagttttcttttaatttctttgtcttatttttctatcacagcaatattagcttcattagcttcatgaggtggtgaagatttcctcctcttcaattttctggaagagtatctctagattggtattattccttctttaatgtttggtagaattcaccagtaaaaccatcttggcctggagttttctgtgtaggaaggtttttaactatcaattcaatttctgtagtagacacagggctattcagatgatctacttcttcttgagtaaagtttaatagttttgtctttcaaagatttatccatttcatctaagctgtcaaatgtatgagcataaagttattcataaaactgccttatctttttaacagctacagaatctgtagtgatgacatctgtctcattcctgacatttttatttgtcttttttccctcatcagtctgactaaaggtttatcaattttattgatcttctcagagaaccagcttttgttttatttttactctttattttctatttcagtgatttctgctctgctctttcttattttctttcttttgcttccattacattgggtgtaatttgttcttctttttctatcttaagtaaaagctaagtcattgatttttcttttctaatgcaggtattcagtgctataaacatccctctaccacttaaatcgcatcctacaaattttgatgtgtttttatttcatttgttatataaaattgtctaattttcctttggattttgtgttatctatttttaattctattgtggtcagttaggattagggttaaacattagggttaattaaacattttattttaattgcatccctttcaactcactgagacttgttttatggtccagaatatggtctattttagtaaatattctacgtgcaatttcaaagaacaaatactctgagctttttgtagttcataagcgtgatgactgggtgtacacacatgtgtaagatgtacctccctcacacctcggtacaacattggcatattacccaccccacatgaagcacattggatacaacactggcacattacccatccaacatgaaaccaaagaatgtatattctgctgttgttatataaacatcaattaggtcaaattgtttgacagtgaaactttgcatggcaattttaacttgaattaacacaaaaacttgaaaaagtaaattttaagttctaggcgatactgaaaaacaaaacatccagaattccaccaaatcccttaaaatactccacttaatggaatttaggttaataaaatcactgaaggaatatatttcatgtcaagagatgattaatctattgacctaatttagagaatcacagcaggttagagctgaatgaatctcagagactagaccaaacgtctatgtttcagtaactctgaaagaatacaagatgtgtgcggggcatcacactcaatttgtgaccacactgcttcactctgtgttattgtttacctgctccactgtgcaaaaaatgtgagcatcgtcctgctggaagcgcctcactctggtcaagccgctgagagtccccgacagttcatttctatgcagaactccaaaatcagcaaatctaataggcatttccctccaagatcgtggacgatgggcaaacattagactagaaaagatgtggtaacacacagcttttacacagcacagaaatattaaataattatctaaatataaagaaattacaattaagcctcaagattcataaactccttattctagttcttagatcaccaggttaaaaaaaaaattcttccacaaattagtgaaccttgcatttacatcactgcagcactctgagaaagatgcttgtctattatctcttcccagaaatgctgttccctccccttatccacacagtgaatcaccatttactgtttatgattcatttcaaaggctacttcttaaatgaagccctcctagacatttcccagacagggctaggcagtttctcctcacgttcctggaacacctcaaacatgccatcattatggcactggtctttttataacagattgtctacatgcatggccctgcccactctgctcatgagttccatgagggaatggtttgtgtcttaatcacctctgcacttctagctccaagcacaaaaagcactcaactatgttctctgttgaatgaaagacttctctcctgcagaaagcactcctagcttccatatcccattgcctctaagccaccgtggtcttgctttcttattctgaggtgtaaaaagacaaacttaaattctctactttcattataaagtacgaggctataattttaaaggatgcctttgagaagatgagttaagaaattgttaacacaagtgttttacaatgcaaaacactagcatagcttctaccttctgtttagaaagagaggatacagaatgtttacataccggtgttcctaaaattaaagttatatatattttttacatgacatcatcataaagttaaatttcttctcatcttcacttaaaagggcaaagagctttcttcagtgttcagttaccggttttaataattatcttctaggtaaatttacttgaaactatgtatgttgataatacaaaaactacaattgttgggattgttttttgtggacaattatgcctattcagtttcagttgtacaatatgtttgtcttacaaggttgaatttgcataccaactttatgataattagtctttcatagaatcaaagacagcattgattgtaaaatgtatcttcattttatgtgctacaaagaaagaaaataacctattaattaaattatgatataatgctaagatgccaccaactataagatgcatttcaacttcagaaatgttgaaatgtggaagaaaaatggtatcttggaatcagtgaaatccagaaacccattgattatgacctcattgatcttgttataatccacccaaacagtatgaaagaactaaatattctgcaaatatgaacatgtgaagtgcattactataagaaagacaaatattataaaacttataaaattgacacataacattatcctttaatcagcacaaaaaaatgcaatggttaccagctaacatcccatacctgccaaagatcaaatatattttcaaaagtaaatccattctccggaatgaaacaacttagtaaaaattagtaatcaccactcttcagattaaagggactctttcattccacaaagcattaaaagataattgtgacgaagcgtgctatgtgctctcatgaaaaggtctgcttcgcttttaatactcaccagtgccctggacaattcatgggtttgagggcaaaagtgtccttttcaatctcaaaggtaaacatgttctcgctgtaatgctgccagtggcctgaggcttcccagagtttactgttgtacatattgggagagagcacctccgtgaagtcccgtttgtgatattcctccttcaagatacatgcattcaacattaaaatctgctagggcagatcacaattccatgcaaagtaacactatgagcaaatattttcaaattgggctcatgtcctatattaattcatgattaatgtaccctcagttttaggtgtggtggtttctggatcttggaagaaagatttacatatgcttagtataatttctattgagtatatttattttatagcatataacagtatatagtatataatgttttagttctttgaaaagtagtaattgaaatacaatatatatagaaactcactgtaactactccaaagtccttctaaacaggttttttcctattaagaggcagaaaaaatttataatttaataagcctgaatgccatgttgcatgttataattttgatttatttagttttaaacagaaataagaattttagtgtataacgatttaagtagttgaaattattaagtcatgagctggcctctctccctccctacctattaacagcttccctaattgaattactggagacaggagaagagagtttttttccaagcaaagttttaactttatttaaactttctttaaaaacaaaacaattaggtgatctttgttgggtaaatattttatgtgcactttccaaaaatgcatattctgctgttgttttacaaatgtcaattaggtcaaattgttttgacagtaatttgatagggaccctttgcatgacagttttaatttggatgaacacaaaaagctgaataagtaagaattctgagaatccttagattctcaacatttgtaaaccacttaatggacatctggcccaaatctagaatgccatgtatactttgagcacatttgaaaaactgttttcacagctaaaaaaacataaaacataacattttaagattactaacaatggttttatacaactgaaaggaatgttgtctgttattcttcagcagggcatcctggcagtccacggtagacagcttaggtctcggccattcagtgagctgctttacctatcctttgtttttactaaattagaaaaccttaacaggtagggtgtggtggctcacgcctgtaatcccagcactttgggaggccaaggtaagtgcatcacctgaggtcaggagtttgagaccagcctggctaacatgatgaaaccccatctccactaaaaatacaaaaattagccaggcgtggtggcacacacctgtaatcccagctactcaggaggctgaagcaggagaatcgcttgaacccaggaggcagaggttgcagtgagccaaggtcacgccattgcactccagcctgggcaacaaagctagactccatctcaaaaaaagaaagaaaatgtttaacaaaatgatgtcattaagaatggcagtgattattggctatttcagatggttccatatattcagattaaacaaggtcccagaaattaagggtgagtgtgtgggtgtgtgtgtggcagggtgtgcgtgttcgcttttactaaaaactacttttaaagtctagctcaggagatactgctcaatgcatttttaattcactctgaatgcaaccatgttaggaatgtatgtcttcttgagatgtttagaaatgattttaaactatccctgcaatggactgaatgtgtctcccccaaaattgtgatattgataccttaaccccaaggtgatggtattaggaagtagggcctctgacaagtgattaggtcataagggtagagccctcatgaatgagattagtgtccttataaaaggattcgcagagagctctctggtcctctttctgccatctgaggttacaagaagtcagcagtctgcaacctggaagagggccctcaccagaacccaaccatgctgggaccctaatcttagacttactgcctctagaactgtgagaaatacccttatgttgtttataagctacccagtctagggtactttgttatagcagcacaaactaatgaatataatccctatgagatgaagtgtcagcaactattatatttttacataaatatataggagatatctatatatattatgctgctgtatctctccatattgtaatatacatattgttttgtctctcacacacacatataaataacagagagataaagcaaactggcaaaatattaccaactaatgaatccaaatgaaggaaatatggatgttcattgcattgcattttagtttttctctagatttgaacttttcaagagaaaaagttggggagtaaaatatgtctcatgccatgccattaatttctttctctaatgctgggaaagagtaaactctcagtgactgagcagttcacagctcagtccagtctcctgaagaaatccagataacttatctggaacattaaaaatcatatttcatcctggaaataccagtttaggttattgaaggagctgagtctctacccatacctagtgatctggccacttaaaaacatctaaatagcttctaagaatcagtgtcataaatttgttttcaagtaatttctcattgtaaaaaataaggcaattccacataaacagctcctttccaaaaccccattaaaataagagtaaagaaagtttttataagagcataaatctaccaggacaaagaaaataggagagaagatgaatgctataataagttagaatctgcaaagtaggtgatcaagtgttaattgcctcagaagacctaggaaagccaaaactaaattggcagtgggagaaacccagaagcaagctactttaactgggtatagatttctaggcttcgcattactaaggcattgttcctgtcttctgtttttcagtgtttccactgaaaatttcaatgccattcagatacccagtcctatgtctgtggcttttttctctctggaaacattcaggatattttctttatccttggagctttggaatctttcgataacatgttttggtgcccaaagtatgttttcaccaaaaactgagacatgcttgggagttgagattgtccattgcccattatgggctccctttactatagaactgatagacagaaaaggacttactacccttgatcccaattacttggggaaagacttactacccttgatcgcaattactgggagaagtcgtattgcttacaatggagtaaggaggactgtgtctggaattcagtggggagcctttgatatcaacacatctagcaacaaccatcagtgggagccctgaaaccccacaaagagcattactaaaaccttggatcctaaggacagactgaggccatccactattattggtttaactgtattctccaaataagatattttgaagtcctaactcctagtacttcagaatgtgtccttatttggaagtagggtctttatagaggtaatcaaattaaaatgagatcattagggtagatcctaatactatatggctggtctctttataaaaaggagaaatctggacacagagacagatgcacacaaggggaagacaatgtgaagacacgcagggagaacatcacgtgaagacagaggatgggaatgacgcttcaacaagccaaggaacactaaagatgactggcaaccaacagtagctaggagaaggcaaggaaggattcccccatgggttttagagggaacacagcctcgtcaacaccttgatttcacacttctggcctccaaaactgggagataataaatttctgttgttttaagtcacctagtttatggtattttgttataataccctaggaaactaatgcacccaccaaataaaacaatgcccatctggggtgccaccaggataaggcgaatgtggaatgagtgatgggaaaagaaggctctgatgtatcagcttggccctagcgtccatctacagaggctgaaacagttacatttagttatgacttttccttgcattcttacatgaagggcactcatggtggccaatggcacgattcagatttaggtgaaactgaaatgacatcaccacatgatgacacatcggctgatcggagtttgtgggaggaaaccaatgtcctcagtgtcctccaagcaaaaggcaagaatgtgctgagaggcacagggggtgagccaggctggttattttccatttgccactgcctgtctcgcctcatcttggcccattttccttccttctctgccctgcactgtgttccccaaagctgacttctgtgggctccgcacaaggcttacttgctgtgattattatttttttattttataaaatatatacttttaaacacaatagtataatacaacatgcttaaattatgtttcatgtggaaaaaaataaggtgtataaagaaaacctgaacattttctctcattccaccctttactgccctgagataatgctaatggcctgctgttcctgtatttcaaccctctcctccatgactgtgcaaacacaaaacacacatacaggattttgttgttttttgcttttacctataaaaagaaaggatacactatacatttactctgtcacttccagttttcaatggtgaggtatactgaacccccttcaagttagtatgcatagatgtatttttgtactaactgcatagtgctttattgtgtggacatgtcacaaagtatttaatccttctactattgagaaacattagacttttcatttttgaatactacaaactattctgcagtaaagtttttttctatgtgattttaattgtatattttagattcctttctaagaatattgctaggagtgtgcatttttttcacattaatatttgttaccagattagtagcaatttaaactttctctctaagtatatgataactgtttcctcacatttccttcagcaatgaaaattatttaatgggtatcaatctttttttttgaaatggagtctcgctctgtcacacaggctggagtgaagtggcgtgatctcagctcactgcaagcttcgtctcctgggttcacaccattctcctgcctcagcctcccgagtagctgggactacaggcgcccaccaccacgcctggctaatttttttgcatttttagtagagatggggtttcaccgtattagccaggatggtcttgatctcctgacctcatgatccacccgcctcagcctcccaaagtgctgggattacaggcatgagccactgcgcccggccaatgggtatcagtcttagaactattacctcagtatttatatatatatatatatatttttgaaacagagtgttgctctcttgcccaggctggagtgcagtggcacaatcttggctcactgcagcctctacctcctgggttcaagcaattctcctgcctcagcctcccaagtagctgagatcacaaatgtgcaccactacgcctggctaatttttgtatttttagtagacacagggtttcaccatgttggccaggctggtctcgaactcctggcttcaagcgatccacccctctcagcctcccaaagtgctgggattacaagagtgagtcactatgcccagccttttaaattttcttcaataaattttatttcacatatttgagattcacaacatgatgttataggacacaaatagtaaaagagttaccttttttgtgtgtgtgacaagagcagttaaaatctaattacttaacaaaactccctgataaatataattttgttaactttagtcctcatgttctgtattagatctctggccttgttgatcctagatatctattttgtatcctttgatctatatccccccatttcttccccccaacccctgaccatggtaagcactgtttaattctctgtgtatgtacctgagctctctcctttttttagattcatcagctcccctggttctcaggcctctgcactcaggcgagaattacatctccaactttcttggaccctcagatcatgggatttcttggcctccataatcacacaagccaattcctcataataaatctcttcttttctatgtatcttgttggttctgtttctgtggagaatcctgacatgccaatatactttccatatggtttctgattgggtctgaccaatgggaagttccaaaggattcacagggtagtggaagagagaggtctggatatttctttccctggttctccctgctgtgggtttactcaggttctggctgtgttccacagttacagcttctgttgtgtggcctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccatggctccaagctctctgtgggttctggtattactactccatctcctcacttctctcctccatggctccaagctctctgtgggttctagtattactactccatctcctcacttctgcaggcctagtgatggaggggaagggattcttgctattggtaatccctgggcgctctatcatcccttgttagttaccttagccaggcccatatctccataaatacttccttcactagactctcttcagttaaacccttggagtgcatctttcaggactctccctgcagaagagctgaatgttttgaggcctgccatgttcacaaagacaagcttggtctagaaattcactccatctaaggttgtgtgaagaggaagcaaaaattccccaagtgggttattaatataacaacaagagaagccactcccctccccactccagggtttcaagacatgcatcaacaagtcaggcagattccaggaaatgcaaaaggtgtgactgagatgagctttacaaaagcaaccctcatgcacagctggtgggaatgcaaaacagtagtcattttggaaaatagtttggcattttcttataaacttaaatttaccatatctattctcacactgctaataaagacaaacccaagactgggtaatttatgaaggaaagaggtttaatggactcacagttcagcatggctggtgggggggcctcacaatcacggtggaaggcaaaggagaagcaaaggcacatcttaaatggcagcaggcaagggactttgtgcgggggaactcccttttataaaatcatcagatctcaagagacttattcaccaccacaagaacagtatgggggaaaccacccccacgattcaattatctccgcctggccccacccctgacccttggggattactacaattcaaggtgagatttgggtgtggacacagccaaaccatatcaccatatgaccctgaaatcacactcctaggtatttactctagtaaaatgaaaacctatgttcatacaaaaaactgtacatgaatgacaatagcagttttcataactgccaaaagctgaaaacaacccaaatgcccctcaactgcaggatggatctgaagcagtggtatgttcatatgatggaatactgcccagggacaaaagcagaggcccgctggggacactcaactcggatgcatctccagggtgttatgctgggtgaaagcggtcagtctctaaaggttttataaaagtatgattccatttatatgccaatattttaggggtagagaaaaaatcagccgttccctgaggtcagggctggggaggatttgattttaaaagggtagcatgagggagttttgaggggtgacggaactgttctgtatcttgattgctgaggtgataacacagttctgcatgttatcaaaaaggcgtacattttactgcatgacaattaaaaaagttaatttaaaaaaaggtaagaaaagtacagaatcagctgacagatattttccagaatgcagggaaaaaaaaattcaaggagactaacaaaaagatctatttattcactatcagttgtccacacagtcagtaactaatatacaaacaaaagttcacttgcctttacttaaacctaagtggaagtcattttacctgagtcaaaaactcagaaatcctgaaatttccctcagtgggagcagtgtgcacacccagcccatcctggcctcctacatcccttccacagaaatgcagcagttccagttctgaggaaaaggatgcttcctggtagaatgcggccatatattccatcgtgctcagcaccatgtatccccagcactctggctactactgactggtctaggactcagcaccaaggcaaaggctactgatattggaccagaccatggcccctgaggcagcccagctgtgactgagagtctgtcccacaagcacaccctctactggctggtgactaacagaaccaactggaacctcagggaggaccttgaggcacatggaagagggcagagaggaaaaaagacacaggcagatagactgaaaaatatcaagacccaacagtattcttttctccagcaacgtactttaaatatagaaacagaggcagaaaataaaaggataggaaaagatatatcatgcaaacactaatgtaagaaagctagcttgcctatgtcaacaccaaaggagacttttaaaaagatagttttattacaaaaggtcaaatagcctatgaacccatttatatgtgacacctagaaatagtcaatttcatagcgacagaaactagagtggtggttaccagaggctgggggaggcaggcatggaaattagtgtttagtgggtacagagattaagtgtaggatgatgacaaagtcctggcgagtttcggatttgcaacgtggaaagagttctggagatggaccatgacagttgcataataacatgaatgtacttagtgagaatgaattgcatacttaaaaatagttaaaatggtaaatttttatattatgtgtattttaccacaaaatggcttgaggtaaaatttacacgccataaaattcaccaattttaagtgtacaattcagtgactgttgacaaatgtatacagtcatgcgacttctgccacagtcaagatatagaacatttccaccctccaggaagttccctcctgaccccctggagtcaatcccctctccccacccactggactcctgatcatctttctgtcactatagttttggcatttctgaaatgtcatataatggaatggtgccttatgcattctctgacttatctggcttagtacgatgctttcgaggttcctccttcatgtgtatatcagtatctcactgcttgtaaatgctgagttgtattccacagcatggactttccacattatgtttatcttttcacaagctgaatctggggttgtttctggttctgtgctattataagtaacgcttctatgaacatccaaatacaagtctcagtgtagatgcgggcatatgtttttatttatcttgggataattagaagtgggggctggcgtggtggctcacgtctgtaattccaacactttgggaggctgaggcgggcaaatcacctgaggttgggagtttgagaccagcctgaccaacatggagaaaccccatctgtactaaaaatacaaaaatattagctgggtgtggtggtgcatgcctataatcccagctacttgggaggctgaggcaggagaatcacttgaacctgggaggcagaggttgtggtgagctgagatcatgccattgcactccagcctgggcgacaagggcaaaactccatcttaggaaaaaaataaaataaaaaaataaaaggccgggcgcggtggtggctcatgcctataatcccagcactttgggaggccgaggtgggtggatcacgaggtcaggagattgagaccatcctggctaacacggtctctgctaaaaatacaaaaaaattagccaggcatggtggtggcaggcgcctgtagtcccagctacttgggaggctgaggcaggagaatgcatgagtccaggaggcggagcttgcagtgagctgagatcgcgtcacggcactccagcctgggcaacagagcgagactttgtctcaaaaaaaaaaaaaaaaaaaaaaaaaaaaaagaagtggggcacgtttatctttacaggaaatgccaaactgctacaaagtagttctaccattttacgttcctaccagcagtaagtgttatacttgcttcatattcttgccaatgcctgatgtttttagtctttctatgatgggaaggggacattcttcaatcaataaccctggcatgagactctacctgaatacagtcatgtaagggacccaatgcgagaaccacccacaggagcctaaaatttggaactatgaaagacagtaatgatgaaatggcagttttaaactattaagttctgggatactttgctatgttgcaatagccatccagaacagaattttgcactggatgtaggtactgctataactgagaaataaaaataaaatcctaagctccccaactgactgaacagacaccctcttggccaaaggaccccagagaaaccttaaaaactgagttactggcagtgacaagaggttggacatgcctaattatacccactctgtcactaacaaccattaggctttctttcctaagagttaatcagaaacaagcccttttgaaagacttgttccaccactgatttacacaactgagcagcatttcttcctgttaaaagaccactcaccatgcactggttctggttggtttataaaggctgcacatgggatgcctccgtgtcctccatttgaccttttggttatacagcctaatttaaatgcattgtctccaccccaaagtgaacaagggatgcatgtaacatgcatgtttgcttactatgtatataaatgtcccccctttgtgaatattcatagctcttcttataacctgttaaatatttatacttggccaatctcatcagcataaattcctgtcttacttttccctcccttgaaatgcctgcttctggtttctgccagaagctatgaagcttcctagcctgcaagatttcaggctgcaacccctcagaagaaatgaagctctcctttacaattttatgaacctcatgattcttcagttgacataacaataacctaaaacatgtagctttggggccaggtggtgggcagaagctagaagggattcttattacgaggtgccagaaacagatggtgggtaacactgtcaccagaagtaacatggaaaacagaaagggtacccaaagaactcatggacttagctggggagacgtccaggcagaatgtagaaaatgacagccgatttttggctccctatggtaaaatacaagaaaagaggtataaaccaaacgtgaaactaattaactttttgagccaagtttagaggaaatataaagccaccaggacctgctgggttcaaaaatgaaaccttcttatccttagactgtaccaaaaaagactcacgaggcttcaggacacggatcaaattcagattataatcatcaaagcacagccttacggtaaagatcttaagggcggggctgtaagacactgtgaaaacctcagaatgatctactgtaagtgcacctagtaaggcttctgaaagtcttaggagtgtgctttgtagaccctttccattaaacacgaaggctctgaagactctgcagtgtactattgtctcacagtagcctcccaggcaaagaaggatcggtgtcagaaagatgtggatgtggcttttatctaaccgtgttgatgataaatttatagaaaaggactcgcaaagtttttaaaggaattgtactagcttagattgaaaggcagcacaaaatgaaataagggctttggattcccccagccttctacaggaaggaatcaggttgagaacaaagctaccccaggccgggcgcggtgactcacgcctgtaatcccagcactttgggaggctgaggcaggcggatcacgaagtcaggagatctagaccatcctggctaacacagggagaccctgtctctactaaaaatacaaaaagcctggcatggtggcaggcgcctgtggtcccagctgctcgggaggctgaggcaggagaatggcgtgagcctgggaggcaggaggttgcagtgagctgagatcacgccactgcactccaacctgggcgacacagcgagactctgtctcaaagaaaaataaaaaataaaaaaatacataaataatttttttttttttaaaaaagaaagctaccctaaggcacatatgggccatttcttatggaagagaaaggatgactcagagggcagaatcacagccaggcagagcaaaactggatcttaatcaaagtgtatcttttgaccctggggcagtgatgaccggtagataccagaatttctacagatggtgactaccatgtgcctcctactctaccccactcctttttgagtaagactatctattgcattattcctcaagcaccattttacaatgtgagggagatgagaggatgaggtggctgatagataacttgagtttttagttcacaggtcttaaactgtagaggaaatgtacttgataatctgttcccaacaaactgcacccgaggagcctcatctgcagctaggcctgattcagaagatgtcctggatttttgagccaatgtagtaattagatgagccttggaattatttgttaagaatagaacactttggaagagtagaatggacttccctacagtcctttggggctgaaaagacataaacccaccagcctgtcaagtggaaacccaagggggtcatgacctagaaacaggaatcaaaagttgaatcttattaaagtggaagccggccctaacccagtgcaatctctgatcgaattcaatgatcagtccttaatagtggcagagggtgaatgctccagtgggagatatcatctagagcctctacacctaaattacatgtaatacttggcatctaacaaaatattacttgatatgggaagtgacacaaccataataacaaaaaaccaacagaaaaaacagctgagttctccaaaaggtttttttcatggtaaggccaattccttcagacaaaggtatccagaaatgcaaagttctcagtgtcgcctgtgtctgtcaaatattcccattccaagcctcagggacccttcccaaccagtgcccttaccttagaataagagatcactgggtttgtgcatttaagtgcctttacagtttggtgaccctcacaatcaggccctgctcctgttcatcagccacatctgtcttgcatctataaaaaataagagatccccttaatgccactgtaaaggctttctgttcattctccatctattgtactcccaacttgagagtacaaggtgccaggggccatgctgattttccagagaagacagcacatccaaatcagcagctgtgatggtcatcaccacctgcctaaatgtaaatctctgataatcttcagtgattcttcaagtctcttccactgccctctgatctcctaccattgcctcgcattggccagtccctactggaagatgtgtaccccaggtgatagaatacagacatgtcagcctccaggggcacagcacaagaagaaaaagacggagaacaagactggagaagcaaacagagaataaccagtgcaggccacatgccatggattgtcttctcagaaagttactgaagaaagtgatccccaaatgagaattaaagataagcaacgaagagatatacagggaccaggaaaagagactcagcataggaagagacatgaggggagtggccaagatgatgatgaaaagaagtcctaagccatcagtttgcaagaatcttagtagcaagttaattctggagtaggaccaaatttgaaaaaaaaaattactgagcaattacctgaatcattgcagaatatgttgcaaggagatttgtagtttttgagagaaattggagcatgaattagtggtaggcacataaaaaaactaagtaaatgaaaaatttaggtaatgattataggaaagacaaaacagtgcaagcatggaaatgtaatcccagtagtccacccggatcacctgtgaacactatctacacagtccttatcatgtaaatactaaagactttcccacctatgaacttgtaatacaagtaggtattttgcactgttggttttttcctctttcctctggaactgccaaatcacctgggagtcatgctataggcaaagggaagcatcagtggcccatggagcacatttggagaagcaatgcttcatggcttaacactctgtaccagagacgacactttctcctttcttctttttcacagggagtgccacacttagtctaatgcttacctttatattctacatggtttagaaacttatatggacaaaaagtgaattttatgaaatccaggaatgtattcaggggaaacagaaattatctccatgttattattagaaggtacaatctagtacctcactttttttttttttttctttgagatggagtcttgctctgtcaccaggctggagcgcagtggcacaatcctggctcactgcaaactctgcctcccgggttcaagcaattctcctgccagcctcccaagtagctgggattacaggtgtgcaccaccacactcggctaatttttgtatttttagtagagacagggtttcaccatgttggccaggctggtctcgaactcctgacctcaggtgatctgcccaccttggcctcccaaagtgctgggattataggtgtgagccaccgtgtctggccagtatctcacttttaacctcaaaattcttattaatgttaccaaagtaaagttaatggaaacgcttgaccactttattatgagagaaaatagtaaaaatgtaaactggaattgaataagaataaaacattttaaagttaacttactcgtatgaaatctgtaagcgtattataaatgaaggctcctctgggaaggaaaaaacagcttccaggactcaaatcgtggaaaaagaaaagttcttgttcctagattgaaacaaaaattgcatttcaaatgtcatctgctattgcttaatatttactgcacacacatataatactcagttatttccatcttctctagtaatagacattccaaggccattcaacacttatacctaaatgcatgcaacagcatatgtaaaatttccaatcatatttatgcctaattagctttgaacttagcttttacttcaccttctgctattctctgcgaattttcttacttggcacacttggagtacggcactcatggggagacaacacggtagaaagaccaaaaaagttcattgcaggaggtgggctttaggtgatgatgatcatcatggctgctgcctactgagagcctatcctgtaccaggcaccgtcacccagtttctgtcttcacagccaccctgcaaggctacccagcaaggaagacaaggacacggagcttgcccatcatctaacacaactagtgagtacaaggactgggcataaagctcaggccgagctgctttccagtctgagcttttccttctacacgctgctctgtctcccagatacaaaggatgctataaagtgcacagaatgtaaaaaacaactctttttttttttgagactgagtctcactctgtcgcccaggctggagtgcagtggagcgatctcagctcactgcaacctccgcctgccgggcccaagtgattctcctgcctcagcttccagagtagctgggactacaagcgcgtgctgccacgcctggctaatttttttgtatttctagtagaggtggggtttcaccaaaaacaactttattttttatcatgacaaaaataagagaagggtacaattttcaaaaattaataaaagatacaggaaggaaagaggttagaagacatctggggtattaaaatgaaagcactgagcagcggactgtgagtgccagcaaaataggagagaagaagaagaaatcttatttttaaagcaacttagttttgtgagacagaaacattcctatgttggcttatgattacatctccagtgattaagatgtggggcataccttcccgatcttcctgtgatctcggttctttgcttcctcttggaacttttcccagtctctcatcatcttgttatcaggaaaggatattccatagatcctctgcaatgtttccatttccggattgccctcccaatatgttgaggaattctaaatatcaaagaggattttggtaaatatatcatacattcagttgtaagtaaaactgctcttaaatacaaatgcaattttccactatcatatcaacaaagcagccctgcatggtggctcatgcctataatcccagcactttgggaggccaaggtggttagatcatttgagctcaggagtttgagactcgcctggacaacgtggcaaaaccccatctgtacagaaaatacaaaaactagccaggcacgatggcacatgcctgtaatcccagctacttgggagactggggcaggaggactgtttgagcccaggaggtcgaggctgcagtgagcagtgtttgtgccactgcactccaacctgggtgacaatgcaagaccttgtctcaaaatcaaacaaacaaacaaacaaaatcaacaaagcttaaagaagactatttgtagtgctgggaacaatcttaaaatggattctaactaaaccttcccagcctaaattataccattaaccagcaaattatgtagagtctgctatggattctaggaatgacagtgagagcacacagaaaggagggaaggctaagcagcaatcataatcaccaaggatggggcagaacagacagtaggtatggggaagtaaaggtcggtcttgctgacctacagtcaatgattaagaacagtgccattagccagccccattttacctgtaagaaaatcaaagccaagaaaggctgggactgccaagtcagtcccatgcctcctaatcccagagcgatgttttctccattacaacatcatatcccctcctgctgttttctttatgccgcaatacattactttcacatgcagacaaatattcttgcttacatcagggctattcaagaaaaccatagtatatagaacaatattttaaaatagtgtatgaaaaaggccaggcgcagtggctcatgcctataatcccagcacttcgggaggctgaggcaggcggatcacctgaggttaggagttcgagaccagcctgaccaatgtggtaaaaccccatctcgactaaaaatagaaaaattagccgggtggggtggtgcaggcctgtaatcacagctcctcaggaggctggggcaggagaatcgcttgaacccaggaggcggagattgcagtgagccaagatcacaccactgcactccagcctggacaacagagcaagactctgtctcagaaaaataaaaaataaaataaaatatcgtatgaaaaagaaatgttataacacttacaataaggtaaaatgataaacaaaagccacctatagtgttctaattatcaaaattctaaatgattttattagttttcatcaaataagaatgaaatattttaaaatatcatgatgttcagactacaaaagatatgattgaataagatatgattaaaatcctttaatagctagtgcaccttaagtttactgtattaaaaaaaaatcaatccttaccttaaaaattttgatggttttaatttttccagtgtgtcttacatgtggacctttgcaaaggtcaattaatggaccgcacctataatgaaatatttaggacatgctcaggcacagttacagtgttctggactattcattataagccataatatcctatgttttaggtagagcttcacttatttatatgtagcaatgccatttttaatttagggtgaaggagagaggtgattcatctagcctcagagtccactctgccctctagattcaaaaaccacagaacatcttctgaaagaaactaggcaattctctgattaaaaacttaaaaattacaatgaatacaaaaagggactggcttacagagtggcaaacacgaaaatgtcatctctctcaatggtcagtctttgtgtattgttctctagggagagagcttgtaaacaacactcagatgaagggaaggaatgccaaattagcatgaaaggcttcaatactctaatctttacatagaaagtcacagggccgggtgtggtggctcacacctgtaatcccagcactttgggaggccgaggcgggtggatcacgaggtcaggcattcgagaccagcctcgccaacatagtgaaaccctgtctctaataaaaaatataaaaaattagctgggcgtggtggtgggcgcctgtaatcccagctacttgggaggctgaggcaggagaatcacttgaacctgggaggcagaggttgcggtgaaccgaggtcgcgccatcgcactccagcccgggcaacagtgcaagactccatctcaaaaaattaaaaaaaaaaaaaaaaagaaagccataaaagaaaagctttatttttttttcaaaaattaaatacaagccattcaaattgaaaaactacaaaaagtgtcaatgttgacgtaagtaaggttctcaaacccaagagctcaagcattagaagccagaaatttaaaacttggcctgttttctacattttcatttatttttaagctttaagaaatgcaccgtgcatagctttgcacaaaggggatatgattttacttacagtacaattaaaccagagaaccataagtccttgactgtcgaaagtaagtaccatgagggagaatatctgtggttataattaaataaataccaggtcttctaaggcggtactgtgatagtcctagcagcacccagatggccggaacacacggaaaggggaacagcaatgacatataaggcgtatacacacgaataaagaaaaaggtgctcaggaacctgaggttaaatgaacagagctaagtgattctggtattaacttcacttgtctcctcttacatttgatcctgcctttgtttcccagtattttcttttggtctcatcatgagtatcctgctaatgcatgaagactgtacacttggactctggacaatggggcagactcttctacacttgcactctggacagtaagtatgaggcagagaatcactgccgaggagatggcttgtaatggcccccactgccacattaataagaacgtggaaggacagaatagaaactcctttcccaacagtatcactcacatggagaaaaatcctgttatagctaacacccaggaaacaaaatatgggtctcagtactgtcctgattactaaaaaggggaaaataatcatttctctttagtgaaaacattttgaagattgtaactacggtagattatcaactacacaacttgaaaaatcgatctccaaccagaaaacaaactcggcctctactgctaacaccttcaagtttaccactgagcagcgtttaccatgtgtggacacaaacctgtacacggtggtagttgcagtgttaactttctcattcagaatgcggcatttaaatttattgtactacgaagaaaaacatatttacacattattacacacaatgttgaaatgaagaaaacaactctacttttcttcaagaaacattgaaaggtcatctactgatgttctaggtgctgagacacgagggatacaaagagctcacagccttgagcgacaccgtgcagcatggaggccacaagccacgtggctactgggcatttcaaatgccattaatttgtggttgttgttgttgtttttgagacagagtctcactccctcacccaggctagggtgcagtgccaccatcttggctcactgcaacgtccgtctccctggttcaagcgattctgcctcagcctcccgtgtagctggaattacaggcatgtaccaccatgcctgtattgtatttttgtatttttactatgtgctaatttttgtatttttagtagagacagggtttcactatgttggccaggctggtctcaaactcctgacctctagtgatccgcctgccttggcctcccaaagtactgggattacaggtgtgagccaccacacctggcctcaaatgccactaatttgaaagaagatgtgcagtgagtataaaacacactggactttggaagtataatgttgcaaaaagaagaagaaaatcattcgttaatcattctttatactggctaccattgaaattatactttttatatattgggttaaaaatttgttaaaattaattgcaacttttacttttaaaatgtagctgccataaaattataggttacacatgtagctcagactagtggattccattatgtttctattggacagtactgttctagaagatctaattttaacattaatcaataaaattctgacaaggacacagctatattattaatttgtataaaaacaaaagcaaagtttatcgtaatgatgatatatttataaaactaagggtttttttccttttcctttcttttctgcttccatcactactatcggggtatacaaggcactttatattaaataactacttaaagaagctagttgttgggagaaaaacccgtatctgcatgatttaactgtttcgtatctatatattcacaacaaatcattttccttaacaaagattaattgtgtttagttcttaaaagtagctgcaaaaaaggcaacccacagaattaaatatttgcaaatcacatatctgttaagaaatggatatccagaatatatcaagaactcttataactcaaatacaaaaaaacctaattaaaaaatgggcaaaagagctcaacagacatttctccaaagacatttcttcaagaaaatacacaaatggccaataagcacattaagatgctcaccattagtacgtcatcagagaaatgcaagtcaaaacaaaaccccaatgagataccacttcacaaccattaggatgtccatgattaaaaaaaaaacaaaacaagtgttggcaaggatgtggaaaaactgaaccccctgtgcatcactggtgggactgtaaaatggtgtagccactgcaccaaacggtatggcgagttctcgaaaacttaaaaacagaattgccataggatccagaaattccccttctaagtatattcccaaaagaagtaaagcagagactcaaacagaactttacacacccatgttcacagcagcgctgttcacaatagtagccaaaaggcagaagcaacccaagtgtttacaggtggatgaatggatcaacaaaatgtggtctatccgtacaatggaatattatccaaccttataaaggaaggacattctgacacacattaaaatattaaaatatggatgaatcttgaggactttttgctgagtgaaacaagccagtcacaaaaggataaatattgtcatgattccactgatatgaagtgcctggaggaaccaaattcagagacggagagtagaatggtggtggccaggggctgggggcagggcgggaatggggagctaatgtttaatgggtatagagtttctgactggcaagataaaaagctttggagattggtgatggtttgacaacattgtcaatgtacttaatgccacagaactgtatacttaggattaaatggtaaattttatatgttatatattttactgcacaaaaaagaatactgcaattttttaccaaaaccaactctatttttttattcaagcccacaaaactgataatactgtgttttcaaagtacatgtttttggttgggcgtggtggctcacgcctgtaatcccagcactttaggaggctgaggggggtagatcacttgaggtcaggaattcaagaccagcctggccaacatggcaaaactttgtctctactaaaaggatagaaaaattagtcaggcacggtggcacatgcctgtagtcccagctgagggactgagacacgagaattgcttgaatccaggaggcggaggttgcagtgagccaagatagtagtgagccaagatagtgccactgcactctagcctgggaggcaaagagagactctgtctgaaaaaaaaaaaaaaaaaaaaaaaaaaaacccaaaaaataaaaaacaaaatgtatgttttctccaatatgtatgttttaaaacataaaatcaggaatatatttaagtacgttggtcaaaaaaatataaagagaaagttactgttttacacaggttactctaggttaaaatctgaaacaaaagttaacagaaaactcccacagaaaagagaaaaaggcagcattttatatgggattataaatattgttgaatttaggtgacagatattcacaatactcagaattaatcagatttataaacacacatgtgaaaattattcacctggccctttacctacctatgtctcccctcaaatgttcaggaaatagatggggagggaaatgtcacagcaagtaactggtaacaacctcacagtagcttaacaggattggaataatttggtgagcaacaggtaattatttgggggaaggtggggaagctagtctatattgatttttaatattcctagtaagaggtttaggagtttccccaagttaccttaaacatttccaggaggatttccttgctgacttctagtctttcaaaaggttgcttttcttttatgatggctttacatatattctccagggctgacaattctgtgctggacactgctctaaaaagaagagcagagaaccgacatccatcttccagacattatgcattccctctttcctttgtcctggagcctcagcagccataaatttgaatctgctgtcttattgttccaggacttcagaaagtcaaacgttcatacagtcactactcttgtgtctcagtgagggagactgggcatcaacagttgccaagacctgcctcatttctcctctgctgcaaggggagaaggaagccctgctaggagacacccaggtggactgtgagctcctctgaggcctgttcttttgtgtggtcttccttacccttcacatgctttagttttgctcaagagccagatgcagtgctcatcacgtccctgccctcactggctatggaaccaaggctgggagacatctgtatggactgcagagtcgcggtgctcccagcagcactcagcctccgctatgcatggactaacttcctttcagtcaccccctggtcagtgctcactccctcctgccacactagcttccttgccactcctcaaacaagccacacatatccccacaccaggacagtcccacagaggcctggaaccttctccctgcagatgtcataagtatccccatcctcagggcttgctccctccctccactccggtcggcttcaatgccacctgctccttcctgcccacctgcctgtcatggcacacacctcctacacctggctgatgttcctatagtcatcaccacccggcagcagatggctgcttgtgcatttgctgtcttcccccaaacactgttagctccatgaggacagactggttccttcactgctgaatcaccagcacccagcacagagcacacagcaggcagcaaaaacatcttgttgaacgaatactggagccatgttaacaagagatgaacgggatgtgatactgtgatacagtaagaaacacaaatttggtcttcatccagatttctggcacagggtttttaaaatcctgaaatctctggagtgatacgagtgtcttttgtgtgctgatgagatgactggtggctaggtcccctaggtagcttcagagcaggaactggtcaccacaaagaccaaggcatgattaaagggttgggactttcagcacccccacctgcctccttaggggaaaggagaggggctagagattgggttatcaccaaaggtcaatgatttaatcaattgtgcctctataatgaaacctccattaaaatccctaaacaacaagattcacagagcttccaggttgttgaacacatccaggtgcttggggcatggcgcccagagacacatggcatctctgtggtccctcccacatacctcaccataagcatctttcatcaggctgttcatctctatcctttgtaacatccattataatacactggtaaggtaagtaaagtgccttcttgagttctgtgagccagtctagcaaattattgaacccaaggatggggtcatgggaactcccgatttgtagcctgtaggtcaaaagtatggaaggcccagacttccagctggcatctgaattggggccagtcttgtgggactgagcccttgacctggggaatctgcattaactcagggtagatagtgtcagaattgagttcaatcattagacacctcattggtgtccagagagttggagcactggccattgatttgggaaaaaacccacacctttgagataagaattgttgtaggtaaacacagtttcatgcttgtgagtaatagtggttcagattggacaagtctgtaagtagtagctacacagcattgggtgctcggttggggaggtcattaagcagcgtgcaggagaaggtaaagacaaaatgcaccatagtcatccaggccagagatgccatggggctaacttaaggcagaaacaagagaaggagaggggggtgggagaactatttaggagataaaattggcagaactggactaaacaactggatggtggcgtggtggtgaagaggagggaggaagtagaaggatcagaggttttggttgtggcagttggaggtaccctaggagctatgaggaattcagggcaggaggtggacggggctggctgtttgctaacgattcaagcataggcctatggaatgtgaagcatctgtgacacatccctgtccggcactcaactatgtgagatgtttggctgaggttaatgaggtccttgattatcacggagcgaattaaactagcctctctctaggaattaagctttcaattctggtcttaattaataccatgctctagcaagtccaagattagataaatagcatatcatattcttctggggacaaaaaagaaaacaatcttagaagtatctcttgaatctaaactagatttgactaaaaataattttcagttaaatgccttagaccatttctaaactaaaaataattttcaaaattggtcaaccaatctataatcatcttatgcaatacagttgacccttgaacaacaaaggttagaactgcatgggtccacctatatgtggattttcttctgcctctgccacccggagacagcaagaccaacccttccacttcctcatcagcctactcaacgtgaagatgaagagctttataatgatccacttccactaaatgaatggtaaatacattttctcttccttatgattttcttaacatctcttttctctagcttatttcaagaatacagtatatgatacacctaagatacaaactatgtgatactcaactgtttatgttttcattaaggcgtctagctaacaacaggctattagttaagtttaggaggaatcacaagttgaactcggattttcaactgcatgggcgtcggtgcccctaaccccacattatgtaagggccagcagtatacagttactaggctagtatgtaaccattacagaacaatacaattgaaacacatgcattcacaagccagtattcagtgtgttacctgtcttcaatgaacatgtcataataaaatccattttcaatgggcggaccgtagcacaggtggcctccatagtaaagctccatggcctccccaagaatgtgagcactggagtgccagtacacctgcatggcatggacaaagaggccattagctaccaaaagtatgtcatggaaaattagtagtaaaatgatgtaaaccagtagaaaattttaaggagatacatggcaagaccaagggcagcaacatcaacttgaaaggaaaatcttcgatgcccacttagaagagaatgctttctgagccctccctgacattccaccggagtcacttgctcagtgccagtgtgaagctgctctgctgagtggcagctagagctcggccacaaccccatttcctctgtgcatgtcagccacgagagatgaacacctctcagaacagccagcagagcagctgtgtgcaaacctgattgaagcccagagtaggaggaaggccgaggagtgccagatgctagctgtcttctttttctccaggggcaccctctctgagctggacacagagcactgaagtgttcctgacaccactacagttaacgagatcctgcatctccagagcagtcttcgtgtgttgaatagcatgtgactgtggaagtttgaaagatgtctcaggaagaaaaaagtgttgccagggaacgtctgctggctgcctgggacgcctgagaagtgtatatatgggctcattagccacagtccagagcccggttgtcagtcctccaagttcaaaaagttgatactgttttgagttcccaaggaattcattttagtttatggataaactgaaattaaccaaagtcaccaaataaatataggtaccaaaggagtaagataatcaactcatctttcagcactttctttctttttattaaatagaaagcaagttacaattaaaaagctgtttgataaaatgaatcagggcagaaggagtcagatgatggagcactatgtgcaatcccagcccacagcaataggctgggatatgatttgcagacagacccagagggtcagtccttagggcacagcactgctcctttggatgctgctaggatggcaggctgactgctagcatcagcccaaatctcccatgtggtgcactgtccacacctacacatttgttgagccaaacactgtgctgggtatacaatagtgaaagaaacagacatagtcacagcccccacacaggtacagcctattggcgaagacacaggcaataaacaaacctggacgtgcataattctaagatgagaagggtgtttaaaaggagatgaacagggctctgtaatatagaaaaatggtgagtgtcctgcattcatggggactcgggaaggcctgtgtgactaacacgtaggggatgtgacaaagcatagcttgagaaaggttagagaggtaaggaagggccagagaccatgcaggccttggggaggagcttgcattttactccaaatgcaatgggatgcattaaagggttttaagcaaaatgattaaatttacatttacacacatcatttgatagctcgatgggaatgaatttcaggggacaaaacagcaagtaggcagtttcttgggtggttctataacaaggtgagtgcggattctcaggcagtggcaatggacagattctagatatttttaggaagtaaaatctactgggcttacccctcactggagatggagttgagggacggggaggaatcacacaaaacctccaaggttctggaatgagctattgggtatgtggtggagtaatgcactgacttaggcaaacaggaagaaataagttttggggttaaaatcgaaaatttcatggtgaatgtactgaagattcttgtacaatatctacatgcagatatcacgtagacagtagtgcataaaaactgaggcatggctagctatggctggagagttgtgaattcagtctacagtactgaactttctgaaaatcacttttaaatatggttttattaatagtgtactgtttacatatttaatggttatactttgcatattttaaacagaaattataatatggttcttatagtttaaagaaatttagcataagccttgcaattattgtaacctaagctaatcataacttaggtttcatgaagataatggacagcttgaagggcgactgcaacgttcaggcgacaacgtatatcagaaatcatatatcacatgcatatgtgaaaaatgtggtatttattttatagaaaattatattaagtatttaaaggatatctgagtcttgtaatttcttccaattctcctatacatattaaattataaagtagacccatttttaat

SEQ ID NO: 718 - DNA, 282155 bp, Homo sapiens
gtcacttcacttaaccctctgagtgtgtagtttgtagatttgttaactgcactgagaggtcccctggtgtgacctcaaaataacggcctctccaggagccataaacatggatcaaccccaactcaccgcccctcagcccggtagctggttgagagaggaaaaagggacccgccgggaggtcctttgagggtaatgccgcctttgtgcccagggcgtggcctgcttgctcactgacagaagaggggacagccgagggctgcggggctgggagggccccgtgggggccggtgagggtcaggccccggtccaggctctgtggcaacgcagcattagatctttccgacaacccagcggtgtagacattgccactgactgcaaaggagcttgtcaggggagcgacttgccaaaggtcacaccgctcggccatcagaaccgcggcagaagcccccacacaaagcgccctccctccgctcctggagaggttttaaacccaggacccccggccctgcgctgtcccaaggcctctccgacggcggccgggctccagggtgcaggctcccggccatctacccccgggagccgcggacaccgagggagcgcgagtccccgagacgccgggccacgctcatgtcacccaagcagcggccgcggccgccttggcgcgcgcaccgggtccggagctcgcgccgcccgtcgagggcagaggggccgctcccccgcgggggagagccgggtgggcgcccaggacccagcggcggacggcgcgcgacgcctgaggcagcccagactcccccggagcccggcaggtgtccgcgccgccccggcttctgaggccacacttccgagcgcggggttgggcggcactgccgggggacttgcggtcggcgcgccggacctgcgtgggcgcccacgcgggaccccagtcccccccaccccgccgagtgtcccgcgcgcgcccccccgggcgacacccccccccgcagggcgccccggccgcccgccgtccccaagcggtcccggagccttcccacgcgcgcgcggggccggggccgggcggacaggactgcggaggcgcccccctcgcgcgcgccggaggccgccgggaaagttttgggcgcgcggggccggccgcactcacctggcccaagttgaggtacccgtgcgccgccgccacgcggtccgcctcggccgggccgcccagcacttgcaccgcccagtggttggtgtagacggggcgcggcgggggcggagcaggcggcaggcagcgccagcagcagcagccagcgccagggacgcggcgcgagcggccggaacccgggcccgccggcgccccccgcgccccccgcgccccccgcgcccgcggcggtgtcggtggcggcggcggcccggggcggcggccggggcccgggcgcaggcggcgcgcgcggaggcatagcggcgacaggctcgcgcggcgcccgagctgcgagtgcgccggggggtggagtgccgccttttaaagccgctccgcgccggggaagcgccgccgccgccgccaccgccgccgccaacaccgccgcgggcgggagccggggaggaggaggcggccgcggcgcgttcccgcccccgggcccgcgctcctgcgaccgggctccggggccgagagccgtccgggaggcccgaaacgccccccaccgggggaacttccccgccgacttctggggctctcgggacgcggtgccgccccagaggcgtcctcggcccgcgagttctgctgggagcggggaggccccggcgtctcaggtgagtccccggttccctagaccggccggacacccgaaggccgcactcacctggcgggggcctcagacgcctggcggcctcgcccgcctccctagacggagggctcgcccgtgtgcggggtcccagggagaagaagctgcggggaagacagtgggtcgcccgggaccaagcctggctgaagggacacattgagcggggcaaaggcatgtggcgcatcagccgggctcacgagcgtgtacccgagaaaccaccgcacggagcccatggcggaggccgcggcccatgctgggaggcaggccgtgcaggtgaacccccaggccgcgcaggtgaacccccaggccgcgcaggtgaacccccaggccgtgcaggtgaacccccaggccgcgcaggtgaacccccaggccgtgcaggtgaacccccaggccgtccgcttagcctcgctgcgatcttgggcaaatgactgtggtggctgagggcaggcgccccacctgcaaaatgcggggaacagtggcatctaccccgtcgggctgatttgaggatgaggtcagcttttgctgtacaataagctgtccgtaaacgttcgtttttatgagcccagggcctgccgtgtggtaggtgttcactagacgatgtacactcttaaaagcacccactgagctgggaccagcagtagaaagtcagctgaatcatcctcacccctgcttcctggagcagcctggtatccagtggataatgatttgaagcaccctggagatggatggaaatgttcacaccataatcaaggaattatgaagggtaaggatcgctgctggatctcttctgtcatccctcccaggacccattggtcctactggcccacttccagaaagcaagccatcaacctgcttaatataggaagtaaaacaaaaaggtcgagaaggccttgaggtgggaaggaagctgcttctctgatggtcagttccaggagcggtctcttgttgagcgtgcaggattcacttggagtctgtggcttggcagctggaggtgagaggctggggcgagaggggatgggctgaggacaggatctgcatagatggtttccgaggtcctttccagcctcgctctcaggagccctttggttttgtaacccacgtgattcatcatttcttcaggtgtgagtcacccctaatggaggtgggagaacaggaggcgtggtgggaggccccatcccaacaggccacatccatgttcacaagggctcctgccaagggcccatcttggaacctggagatcaacgtcccacatggccttcgctttgctacactagatgtaacttcacctccctgcgttcccctggcaagtggggtcagctgcttgggccgtcactccaggcctgcccacactgcagaagacagccaccgtgtgtccctcctacagatggactggatgctcaccagcccctgccagtggagagacatgaggccctcatgcaaactggcagccctagaggagaaccggccatacttgttggacagaaacagtacccagaactctcagtctgcctctgcctgacatggccctggctgcctagccaactggcttgcagaagagggacattggcctgagtcaaggggacggggttggaggcattgcattgtcacctagcagcagtatgtctgggcagcatgtgttacctctcttccccttcccctgctggccggatgtccctcagattcatcctggatctggtgccgttcttcaaatatgtggcctgcttcaagataatgtaactgcacatcagctaaatgattataaagcagctggtgcctcccaagacggagcccccgcaacggcagtgattttgacaggcagagataagggtgtttccataataatgtggtagattaagggattcagcctgctgtactgaggggagactaaaatgcatctgaatttttatttggagagatctgaatgtattttactaacaagtctggtccttttgggctgaactttccatttgtcatggaagtgcccggcaatatcttgactccgatgttgtaggaagaccagcttcccaaaatgaacatcctgaatcgaatcgcctcctgtgggtttcctattgattcacacggtgacgggattagctcagtcacgggagtaccagcccttttcattgtgataggatctgtaataaaacttggctagtcgtcctgcagggaggggatttattactcaggctctggctctccacatggcccccgaggtccacacagctctgtggggagggagggggtgctgctttcctagattgaggtcttcgagcctcaggagggacaggacatggaccagaaaggtgattggagcctggtcatatttcggaagttttgtgatatttatactgacatcttctaaaatcagaaaagaggagaagacattgaatgatgtgttctcatgcccaccactgatccctttacagcaagcatgggattatccggccagagtccgggaatacccacgcagccaagaccacaggacagcaagagcctttgcacagccttctaggatgtgataagacatactttgatgcagaaattgcctctgtgtagggaatagacactttattgaacaattacatttttggcaatatgctaggttcagcaggccagactagcatcccttgaaaaatagctgatggacaccaccttcaggataccggagatgagcgtggactcaaagcccagctttgtcatttactcatgtgcagcctcagtaaagttgcttcagtttgccctactgaaaataatagtaacgctgctgtccccatacagaggggctatgaggatgacaggagctgatgtgagcagagcctggcacccagagcctggcatgaagtcagcactccataaatagtggcaacagtgaccactgctgaccaggcgctctccagtgggatagagtagttagggctgaatactctgaccttctctggataagggctcactgtcctcatctatgcctgggtgcacattttctcacatcttaacatccccaaatcaagaaacatctcacagttggtgttttgcaatcatcactggcctggactgaaattgagttcttccagagagggtttgtttttgcttctgccagtgatctggggacacagctcctgaaactccttggggatctgctgaatggtgtgaccccagtgtgagaaccagcttatggttctaatgatcagtgcagggcatctccctatttctccctcccctcgccagggccaagatagaaacctgatgattccttgctgttcctctccatggtgggtttatttctcattttcccctgtactgacagtagagtctttattttccctcccctcccctctctctcctctcctcctcctccttctctctcttccttccctcctttctttctctttctttctttctctttctcctttcccttcccttcccttcccttcttttctctttctttttctttttcttcttctttcctgagatggagtttcactcttgtcacccaggctggagtgcaatggtgcaatctcggctcactgcaacctctggcgtccgggttcaagtgattctcttgtctcaacctcccgagtagctgggattacaggtgcaagccaccatgcctggctaatttttgtatttttagtagagatggggtttcaccatgatagccaggctggtctcgaactcctgacctcaggtgatccacctgcctcagcctcccaaagtgctgagattacaggcgtgagccaccaggcccagccaacagtagagcctttcattgttccatctttagagaggcatctcctgtgagcctttcattgttccatctttagagaggcatctcctgtgagactttccatcttggatgttttttttttcttagtaatatgttaaataatgacacatcttccaattgagggtgtatcttagatttgatgacatatgatattaatgccttcaagacatattgcagtaaagaaacttgttgaattcttccaaatatatttgctgtgtctgtgtatgtgtgagtgtggcatctattgatatcctacagaaaaggtacagagagtacagcatttttcatgaaaatctgttgtgaatcctcagcaaggtaaaggctttttcaaagtaattgcctggctcagttgaattttcaaatacatttctatcgggagaatcctcggatactttgggccagacagcactcagaggtgagatactgttgggacgtacagtcattccttagacctgacagtgcttcttgagcccagataaacacccaaggtccccaggaacaggaggtgtgatgcaggtcgcacacagccagtgggcctgagacatggagaatccggggcagactacacctctgcctcccaccagcccctcccaccgtccccaacaaacctttacccaagcccaggtttctacaaaccggggatttccccagccaggtcctcttctctccctttcacgcttttcttttctctcctttttactcactccaaatcccactcacagctgctgcccatagcagtggtgggtcaggggcctttgctcccctgcagcttcaggctctgcgtccttctgggctctgccttctgctcggtgtacacagtttttcagcggtctcttcagtatctgctcattcatactgagctctactccctgctggggtggggggacatgtgactatcgggggtggggagggcatggagcagctcccactctactctcctctctgcttaaactctctttatatctagatcctagttttcttaagaaagagcccttgaaaactgcttctcctgtgaaacgattaccgtgggtctagcagttatgtatcccagtgttcctttcctaaactcccatgtggaaatttagtgtcaaacagggaatttaggggcaaaaaagctgaaactccctgagaagctcttcctgactaagaatgagagcttggcaattcatctcgtttcccttttcacctcagcatccaggaggctcagagccacatgtgatagaaaaattgtagttctttatttcttctttgttgcaataggtaagatgcctttggttacaaaatatgagagtgcccaactgaaatgagtgcagacaataaggacaattcattattttgcaaacaagaaactggtattagtggacccagggttgttaattcagcagctcagtgatgctgggactcaaggtagcttttctatactttacctgcctttctcctattcttatatgactgccacagatgggaggatcatatcctctcaagacagcctccagggaagaagcgcaggagcgactttccatctcttgaatgtcttcatctccctggggaggaagcacctaaccctccagtccacttcctctcaggccccacctaccagatctgggtcacaggcccaccctctgctgccaggtaatcgtagacaaggtgagcagggcggctcaggttgctttcgatcagtctttgctcttctcctggggaacgctccctgagcacattgctgccccagattgagcaaaaccaggatgctgttagcgaggggcggcactgtggaggctgctgggcgagttccttgggggtctacctcttgctctctgtttctgttggatcaccttcatatagattttctcaggcacacagcagactccaagcaaatatttatcgaaaagtggaaaggaagggaggtagggaaggagggaaagggggggaagggaagggaggaggggaagaacaagagggaaggggaaggaaggctcaagtattatttagaattaatgtgttccacaaattaaatacaacacaaatcagcctaagcagcggtgactctgactttccccaccttccctgtccccacgcccggcagcgcaaggatggcgttgcactgtccacaagcccagcagtggggtgtgcctttttcctgtgtgaagacaccccttggctccagggtgggtttcgggtttgtggcctaagtgttcttcccgagtgagagtgaattgggagctggggctccctccctagtcccggcaaagagagcagagcagaagacaggatgggagtggggtcctcgcggcgacaagcagaggagaagagctggcaggttatccctctctacaaaagtctggttttgagaagctgagcgcagaaatacatcatgggaaaataggcattgcgggggacctgctgggctgtggtgtacacgaagtggccgggctgggtggggctgaggaattgcagctgaagtcctcgccctttagctgctctctttcctcaagagcacagaaggcacaaacaccattgcttctgcaccccctgccctgtccctctccaaagctgcccctcccttggtgccctggtccccagggaatcctgccctctgcagggtcatgctctggcagttccccaaactcctaaccctctaatcttttcctgtccccagatccttccccttagttgcacgtgtgccagagctcccccacccggctctgagaaggcttcttacgccttcctgcccctgccgccccttcacatcacctctgacctcctgccttcacttccccggggttccaggaaaggtcacatgacgccgctcttcactctcgggcctctccatgccgtcctctccctctccctccactcggctggatgcaggtggagaagaaacacagccaccccggctgctgtcgcctggcagccatcattacacacctctggcagtctctcgaaacgcccacccctcctgtccaactggcgtcctccatactcaccctcagctgacagccttgcttccttcttacctcctttctcggaagagatcttcctcctccacccacacctgcgccgggctctgcctcacagcactgccgcaggtggtggggcccactgaggacctcccctccctcacctgctggatcccaagctaccccagctccccagagccgccgcttcacagtatcaccctttctcctgctgagttacctccatgcacgtacaagcatgtggttataccatctatctttaaaaacccacaggactctcgccagctactctcccattcttcccgttttagcaacacaaaactcctcaagcaagtctccccacccactatttcagtctctcctgcactcaagcccacccacgctgtcatcaccatcccccgcagcctgtccgctgctaactccagggggccgttctctgacctcctgttggaggccttcctgcacctttgacacggctgacaccccttgtcctggaagcacattccgcttgtggctgccaagcggcccctgctatcctagttctcctctcacctgtgtggccgcctctcctcagtctccatcgctggttcattcttagcatcggggtgccccgagccccgactcttgggtggcttcttttttgtacccaccctcactcccgcgacgctctcagtcattctctaactttaggtgcacgttacgtgtgggtgactctcggagcccgtcgctggcttggactcctaaactccaggcggccggcagcttctctccttggatgtctaaagcactttacaagctgagctcctggtcctccccgtccccaccacaaaacgcccccgccgccctgccctgtccccagctttctccattacggcaaatgccaactccacatttccactgctcaggctaaagcctgaggtcatggttaacccctcccttcaccccagcacacccgtgtctagactgtcattgagtctggttgtttctactttgaaatccgttcagagtccggccacttctcaccacgccccctgctacgtccctgggccgagccacccccacctgtcacctggtgaaactcaacagccttctaaatgccttccctgttctggccatgcctcctgccatcaatcctcaacacagaggatgtgtgaaaatagaagtcagatcaggccgttcctcagctctaaattcctccatggcttccaacctcacgcagagaaaaatccaagatttttctctaccctcccccaagcacacagtggaggctgtcagatacgagaagagcattgaacgagatggttagggcttcctggaagaagtgacttttaacctgaatttgaagatataaacaggagatagccagacgggtggaccatcagtcaggactaagcaagaaaacagagatcacactgaggatttgcaatgcagggagttggtgactcagggatgaaggagcacagtttctcccacccctgggtgcaggcctccctcccccagctccaggcagagggcccacttgagatcagcacgtgcaaaggccctggtgcaggaggaagcctggtgtggtggaggagctagagggcaggcagggcagcaggggcattggcagtgacaggagggtagtgggagaggggatgagaggcacggccagaggccaggctgtgacagcttcatcagccttggcaagaatttggactccatcccaagaagggtggaaagcggaggaggggcactcccacagctccaacccacctggcctccaaggccttctgacctgcacccgcagccccacgctgtcttcaagaggccgggaaccttgggtcccacatcttcacctccttactcaatatctccactctctgtggcctctgaaatccagagcagcctgttctaacctcctcacccccacccggaccagaccctggcctcaagggcatgctgtggccttcatgccctgacccagtgtgggctcggcctgactcccacctctcaccagttccctcacccgtccccaggcttcccaccctagccgagggccctgtcgcactgtctgtggtgttcacttcccaggtggtctctctagctccagccgctgcccctcatcaccctccctgccgtctccagagtcttggttcccaggcactcccatgagacgacttagaccatcagtgagtcttctcagccagcagggtggagatcaaactcaggggcacggcctttagcaagctggcactgtttttcttgctcttcctgtcccaccatagggccagttgctgctcccagacggactggcccttcaggcccgggcaccttagcttccactatttcttcctgactggattcttctcggtctccaggcagaatggctctccctggctgtaggaccttatgtttgggggcccaactgtgatttgtggcctcactgccagccctgtgtgtgactcacggtgaggcctcagcagctgttccctgcacccccatctaaaacagctccctgcacccccatttctcactggcaagatgaagcctcagacctggcaatctcgctccacccctatttaaacaaggcagaacctctgatctggaatgttcccactgcagcctctcccagagccttgggaaggagttggctaatacaatgctgggtggcagggctgtgccagcagtgcagtgatttttaaaatatgtgttagagccctgggtttttcctataaatgagatggtcggccatcatcctaaatgtcactccctcactattaggccacagtgatgttcctaaaagagtcaacagtaaagacctgtttgtaggtatctaggagccggcagcagaccctggggacacaggaccaaacgtagggaggtttcaactctggatctccatcgattctgagcacctcggtgaccggggtgggcttcaggcttcctgagctggggctacaggagtgcaaaggggttttatgatgagtccatgtattaaatgaaataagggcccacagaaaagagaaggctgggaccgcaggtgtccaagaagcaaggcacagaggcaagcaggttccttcccacacgcagctgaggtccactcaaaaggtgatcctgaagaaattatgctagaatcagcagagtgggcctcggctgagtgtggaatccagcccactacttgctggctgtgtgaccctggaccaggcacctaccctcctatgcttccgttttctctgctgcagaagaggctgccaatgatgccttcccttagggagtgagccaggccgtaattcaaggctaggcagcacctggcagctggcatgctggcagcagacctcctgacacacgtgcccttggtttggcagatgctggcaagggttgtggtgacagcggacacgtgaaccacgacagctggaagggaacagtggaggggagggcactatgctgagtcacatttagacctcactaaaaccgaagtggttcctgttaacttgctttggtctatgtggtggatttagggcttccaaaaatcctcttaaggctttttatatcctcctcactatttatagtctaaactcccccaaatccccaacccagacaaaatcattcctgctatgttttctttcgatgccaagctcaccagcagcagagaacatagctgcatgacatggggcccgataggctgctcatgcctgtgcccctccctccaggagtgagacttgggaaatcctttaccctctgcaggttctgtgtttatcctttgcagggtcacctgccacaatgtccaactcctgccacccacaggaactccagcaatgctactgattcccaccatccaatattgtgatttttcaaaggttgaaaatttgataagcaaacaacacatatgtggcccaaataattttgcatctgggtcttttcatctggactgaggccaatgcccttattcttcttccttctccttcggagccctttctccctccatcctgtaaaagtaatctttcattagaaatcagcaaagtggaacagtatactccctcctgagcatgtaccagtcacaggtcacaggtgatcaccactgtcaagaagaaagtctaattcagtcctcacctttgatagacgggaagtctggaaccttcttagtcacggcctctcaggcagaagataacagaagacttgccacagtgcatggcagggccacaagacagcaggaggggaagtgacactcaagtcctgtctcctggaataggcaggggatggtccaagtgaagtgggattgctcaggcaggaggagaagaggcagaggggcactgtggctagggaagaggctccagccctgaccacctgggttctcatcccagctcggccacctcccagctgcctgacctcagatgagtccattgacctctctgggcctcagttttcccagctgagcataaaatgggcatatttgtgtccaccttaaatgaattagtgtacagtgcctggacctgggcctggcactcagacagcattatgtgagagctgttctcatcaggccagaggtttagcaatacctcattgctacttgtaaacatgcctggttctggaagtgtctgtgtgggtgtgtctgagttaacacagacatgccccaggctggccaaccccacaggccggacttgtatctcccccagcagagacccccaggccagcctctcctctccctccacagcccagacctagaaggactgcacagcctggggacctcagctccttcccctacgtgcctggtgaaaggagggaaacaggcagtgaagaaagaaggagcagaggaggagacaaaaactcacctctcctgaaccctctgtaaggcttttgcatgcattcgtgtctgagctcctaaagtccgtgtcctgttttacaaacaagaaagccccgatcctccgagggagccagggctttgcctgaggtcttgtcaggtgaacagttagggttctggaatgggtggctgtgaaggcacaaggcaaaggcagagggaggagcctgggcagccacccggccccatctcttcctgccacgccgtgagggcatcctcagataaggacccaggcacaagaaccttgacgggaggggagaaggacaccccggctggcccatccccacgggtcggtagaaacaggagacaggcccgaggactccctggtgaccagggaccatctgtggcatccccctccaggactgtgccccggggagaaccgctcactggggatcagcaggctgcactgttgccccctggaggatgcagaaggagagagacacggtgcccggactcggcagccccatgatcccaagctgggaaccccccgggcaggcttcagactcctttactgtctgcctgtcacccccaggcccctcctgccagggggagctcaagggagtgagtccccctggtggcggggaagcccgtcctttgggatggaaaagcccgaggccgccccagctccctggccaccatcgtgcaaaggcagcaaggcggacagtcaaaggacgtgcatcctgcaggggcttgatccttttgatgcctactgatgaggggcaagtcactgtctatgaagggtctacaatgtccccaaattctgcccctaatgtcgctttagaagtcaagcctatccctgctagtggcatttaggagctgaattatatcttcttttaaaaaagaaaaaaaaaggcttctctccagagaagtattcagatgcccatgagctctgccatccaatatgaatattcccttaaaaatgaaaattatggcgcacttaaaaaggagcatgttatgtcagcaccggggataagacaatttattactgtctacaaaaggaaggctctaatgccgtggtagaggctggctcagcgggctgtaaattatgagccattctctggctggtggaaataaatcctcttgtcactcactgtgctctccccttgacaggccagcaggccgccgggagcaggcagagtcaggaattccatgtccgtgacctgagagccgcaccactccacctcctgggcctcactccgccctatacacgcgcacacttaatgacatctctgatcatgtcttcaggacgcataccctctttgacttgaaaaagtaacaactgtttgtggccttctcacaggccgaaaagaacaagcggggtccagtggagaaaggtgaggcatgggaaggcctggcccgagcactgtgacttcagcgaggcaccctccacccctctcagctttcctggtctgaaagtagaatttcgccagagggtgagccgacaggtagagctgtttccacctgcgtgtgctgcctgtgagctggggaactgcccacactgggaggggttgggaagcgtaggagggcacctgtcgcagacgttgaggaggggctgcctttcccctccaggggctgacctcccaggtgattcccagagccagaccacaattccagaattcagtgaaaacagcgccaaatcctattccctcccgatcccaccctgatccctgcctctggtaaaccggtaagtcttgttttccccaccaccacctcccactcaccaccttcctaaagcgatctgtgccatcagcccctactgtgagtacagccctctaagccactcagagggacttcctttggaagctcactgtcggagacatcctgcatgcatccaggtagagacatcatgaacaaagaatacgggccgggcacggtggctcatgcctgtaatcacagcactttgggaggctgagacgggcagatcatgaggtcaggagatcgagaccatcctggctaacacagtgaaaccccgtctctactaaaaatacaaaaaaattagtcgggcgtggtggcgggcgcctgtagtcccagctactcgggaggctgaggcaggagaatggcgtgaacctgggaggcggagttcccagtgagactcacccagttctcagtgagctgagatcgcgccactgcactccagcctgggtgacagagcaagactccgtctcaaaaaaaaaaaaaaaagtatgtatacttgctaggcagtaagtatgattaaatgtgtctgctgtgtaagaacttgggattaaatgtttccaaagaatggttgaggaatcagctggtatgattgccaaataaatactagatgcccagttaaatttgaatttcagataaacaatgaaaacacttttggtttaagcgtacctcacacaaaagttgggatacacttgcactcataaaattattttttatttatctgaaattcaaatttacctgagtgtctgtcctgtattattatttgctaaatctggcaactctgggtgggcaggagggtcaaatgctcaagctgggactggctagggaaatgcatccttaatattttaaaaagaagtggcaggcacaggttttggttgaaaaaatacagaacattttctcttggggcctggaatcatggcaacttaaaccattaaaagtatcctactgatctcaaatacagcccattaggcctccaggaagattaaaacaacaaaataaataaaagtgacaaaagagacagaggggagagagatcaagaactaaatggaacatctgatattcatggaagctgtgatagttccgaaactgcacattcgagaagttttgccagctggtatttcaggaagggtttgggggaatgggggaagagcccttctgctggcccatctctcttctcgtcccagcctcaatccgctccaagacaggaagagcaaaggcgagaaggagccacgccccaggaccgatgagggctagcaggaatatcacatcacccacaccattagttaggtatgcctggtcttccccgctcagctttcttccctcctcccgtggtcaaccccagacacctcagcaaaatggacagccatccaagccagaggcaccccctccaagcaattctcattcattctacttcatcattttctttagcatcttatttgtccttgaattttctattttacctttcctccactttctagttattttccccctcccccaaaaatgttttctggtggtcagtaagacacttgctctctctggaagaacagtgaaatccctgatgagacccagtgtgaattcacagtgtcgtcatgtctgtcctgtgagattaggcacccatgaaccttcccagctttgtgtggatcgagcaggtaagaacagaacaaccatttgctgctcccagtgcccacggtgagatacacttcagaggtgacaaatggatcgtgcggcagctcagaccccaggcgggaggccacggggacacccaccactcttggcaccgagggctccgcacggtggagaagatgtcgacaaccctgtcttctaggttcaaacatcatgtcatggaggtaaagggagaaggcgtgaggttaagggcctgcgaatctggcttatccaagaacctattaactgtagttcaatatttaccagcccttctgaagacatgtagaagaatgacaatgttcagactatcagtgtcaagattgtaaggagtctgcctgagtcatgggttaaatggtgcccatgaatattttattgaactgtttcctaattgtttacaagctggacatttttgtcagccatacacagcagtgttgtgtgctacccagaagttctgactcatcaacactttgtcgggttagcagagagcaggctgcacttgccatctcgaacccagagttctttctgtgctgtattattttgagatttggtccagagaaaaatgatggatcaaggcagaaaagcaggtaacgggctgtccccagatgcgcacattaaaaggcaaagagctatcgaaatgtcacaaactttcgttacagcccatcattggagagcttttccagccgagagcatccaccttgacatcctcccctccccagctccatcaggcacgaagaggctcctgctgacagacattagggacacgaagcaaactgacacagtggattaatcctggtgtctggggagcagttaggacgtgtcatgtcaataggtgtctgggcaccttttagaccaggccttaatggcccagcctggccctaatcgtccctcacatgccacggttctgctctttcatctttgctgtgtgtgtcccatgaagtctcattttaaacaaggcagcaaggcacagtgaccaccgcagaaatccacttccctcgaggccttgccacagatgccagcagcgccaccagcccccatccccaaaggaaaacacaaccaaacagtcattaaaacgaagaaaaccacgaccatggtaaatttgtcagtgttggcggagaagataatgatactgaaaatagcctgaaactctttgtcagatggcttgcatttttggtcacaggagaacgttttctatgtgacacgtgtaagtgacctgtgggaccttgtcatcagtgaggtcagagcactcactgatgctgaaatttggggggttccccaggctgccctcatcgttcttgcaacatggctgccagggtagtcggtgtgaaggatggggtaggctcaccctggatgtgaaggatggggtaggctcactcggagtgtgaaggatggggtaggctcaccctgggtgtgaaggcatggggtaggctcaccctgggtgtgaaggatggggtaggctcaccctggatgtgaaggatggggtaggctcaccctgggtgtgaaggatggggtaggctcaccctgggtgtgaaggcgtggggtaggctcaccctgggtgtgaaggatggggtaggctcaccctgggtgtttgcacctgcgtccttgctgcttccaggtccctgggacatggcctgtggtctgcactgcttgggtggtccgtggaacgttttgctcacaatgttcataagaagtaatacaaaatagtatccttctcccgcaagggtagggccgggagaactgggagaacaagaggctattggcacctgccaggtggaaagcaggtggacaactcaacagagggtctgtctgttggcacccagcggtgtcgaactggttatgtaaaagagaaagaaaaaggatactaagtctcttgaatgaaactgggccccatcacacgactctctcataagcccagcacagctcaccagggcctctcttgaccagaggcttctgcagaattccatcagaatggaggctcacacctgccagttggctctatggctaaaggtcataataatagaacatctcttatacctgatattttttagatcttctgaatcacattttacaaaaacaacttagcaattttgattcaaaattcagatgctttatttttcttgtaattttcctgcacacacacacacatacacagccatcaaactaatacttcacacacacacacgcacactgccatcacactaatacaacacacacacacacacgcacactgccatcaaactaatacttcatatccactgtaagcttatctttaattttggggctgaattttggggctggaagtactaatgaggaagggactgttcccaccctctggcaaggccaccattctggaacctgatgacaaatgcatgacagatgctgaatatcctcctgtcttgattgcctaaagacttgcttttcactatcagcatgttttcatatctggttttcagaacataaatgtattcacaattcaacattttagtttattcatttaaagcattaaaaatgtttctcagagtatgcatggtcgagaagggcatattattaaagcaaaaatcatccactccattcccttgtcctacccatagtcccagagaccaccacctttcagcgtttctgcattttgtgttcctagtggctagcatcctcagtctacatggcatcctgacatctctatgtctatattcaactcaggctctgttgacgccttgccatgaaacacaaggctttagctgacttacactacatcttcccctaaattttcacagttacattgttatttttagttttctgttgtttgcctttccaacttgcaatctcttatctatcacttcttgttctattgttttcagataatagatcagtttctcttagccataccttaacttttatactgtcagagttgatcattttatatactgtcttataaacataaggttttcatgttttgtccaccagttgattctaaaaatatattaaaaaaataaacactgtgtacataattatgactttgtaaatattgttccttcaaagtcaatcagtatgttaggattttatttatttttctctaggtccagtatcattaaccataagtgacatgaaaggttaattattaaattcatgtcacatctttatttcctttatatttagacacagacataaatctcctaaatagctttttgtttttcttgggattttaagttgcactacttgtgtttttgtcagatcctcagaattaccaaacctcttaatcatactgtttcttgaagctttttgctggactatattttgcagtaatagaaaggaaagggtgctttggaggcaaattctctgagtacttgtaaaactaaaactcctgctcacgtgcttaacgattttctacgtatggaattctgggttttaaatcatatttcccagaattttttttcttcttagtattcaatgttcctgacaagatgtctgaggtcagtattatttttggtcttttgagaatgacttttcttgtttcctggaagcttttaggaatttctctttatgttcaacgttctaaaatatcttgagtctgtgtcagggcataagtcttttgttctttattctacttggaacttggagcatcttttagtctagagataattatctttcttcatttctggaaaactttgttctatcatgtctctattcttttaattttaataaagtgtacatttatataatttaaaaaattaaacagttctataaatctgcaagtgatattagcagttctcctcccactctctggaagccatgactttcaatgcttttagttttgttgtatttgcctccaaatttctaaatagcaggtttaaattcctgtttattaatatttttagttttaaatatagtatgcttacttcaggcaatggacaataagggtttagctttctactctactcccacacccttaaatatatttcttttccatcccattcctctaatagagtggcacaattatagggcaaatcatatttagcatttattttattaggcccatggaaatacgatttgaggctgtagctatatgcattctaatttcctttattttctgatatggttttcgttttcactggagtcaacctttatcccatttgtttggtttcactatgtacctatcacaaatccatctccaaattcctcaacagaaaaaagtctccttcctgagaaaaaaaaaaaagcaggaacaatttttaaaagttgagacattgcattctgaaaacgcccagtagtctttattctagcccaagagcacgttactactttggctgaggatatagaattctaatttggaaatcattttcaataagaatgttgaaggccttgctctattatttagtgttcaccattgccgtagagatgcctaacgcagaactaattctagacctttgtatgcgacttgttctttctttcaaagagcattagtaccttctctttgttcccaatgtttcgaaacttcgtgtgaatgtgctttgtgtggctttgttttcattcattgtgctgagcacttggtgaacctctcagcctagaaattgatgtctttgggatccaggaactttttcttgaattgtttctttggtgaattgctcccttccattttttttctctgtgtttgaaagccctgttatttaagatgtatttcctgtttagtctaattttcttgctttttagcttatattttccatttctttgttgtaatcatttttattacttggaaatttcctcaagtttctatgtttctactaaatttttcttttctgcttttggattttaaaattccaaaatcatttttgttttctaaatgtccctttctacaacaatactccccttttcagcctcactgatgtatactaatatgttactctccacatttaactccccacaaaactttgctaagttttgacatattatatatatgtatatttatatattcccataaaaccatccctataatcagtgtaagcatattcatcatcccccaaagttttcttatgtgttttcataatccctctcacatcttcttccccaccccatcccccaccatcctatcctcaaataaccactgatttgctttctttcattgcagattagtttgcattttctagactttatataaatggaatcatatactatgtactctttattatttgacttctttcactgtgcctaataagtttgaaattatccatgctctacatatcaacatttcattcctttttattcctacatgatatttcactgtatattgtgtataccacgatttgtttaatccattcacttgttgattggcatttgagttgtttccagttttagactattacacataaagctgccatgaacatttgttcacaagagcttgtgtggacatatgttttcatttctcttgggtaaataccaagagtacaacggttatagcctatgataggtgtgtgtttgactttttaagaaattgcctatgttaattatctaatgctacataagcaattatccccaaaactccccagcttaaaataacacacatgcattatctcagaatttctgtggttcaggaatccaggcatagtttagcttagtaccgttaaggcattaggcagccctgaggtttgatctgaagactcaactgagcagagatctactttcaaagtcactcatgtggttgttggcaggattgagttccttgagggttgctgggctgagagccctagttctttctgtctgttggctggagacatccctcagttcctttccatgtaggcctctccaatacggtgacttgcttcgtgaaagctaggaggagagagtctgttaacaagacagaagtcacagtcttttgtaacctagacatggaagtgccatcccttcaatgttgttgtattacattggttaggagaaagttactcacggagaggggttacacaaagccatgaatactaggcactggggtcattgggagtcaagtcagaagacacctcccacactgccaacagttccccaaagtggttgcatcatttacactcccgccagaagctttccagatttccagttgctcttatcctcactgacattttgagtcatcagactatttaattttaatcattctaaaaagtgcatagtggtatctaatagggattttagcttgcatttccctaatgacgaatgatattgaacatatttttatgtgcttattttttttttctgtaacctccgcctcctggattcaagcaattctcatgcctcagtccccctgagtagctgagactacaggcacgcaccaccacacctggctaatttttatatttttagtagtagagatggggttttgccatgttggccaggctggctcaaactcctgggctcaagtgatctgcccacctctgcttcccaaagtgttgggattacaggcgtgagccatagcgcctggcctgaatattttctttggtggtctgtttaaagcctttgcccattaaaaaaaaaaaaaaaaaatatatatatatatatatatatatatacacatatatatatttatatatatatacacatatatatgtgtgtgtgtgtgtatatatatatatatataggtgggctgggcacagtggctcaggcctgtaatcccagcactttggaaggtcaagatgggaggatcgtttgggcccaggagttggagacccagactgagcaacagagtgagaccccatctctactaaaaataaaaaattagccaggtgtcatggtgcatgcctgtggtcccagctactccaggggctgaggtgggaggatcccttgagcctgagagattgaggctgcaatgagctgagattgcactactgcatcccagcctgagtgacaaagcaagacccagtctcaaataaataaataaataaataaataaataaataagtaaacaaataaataaaatgggtgggttgattattatcacattttgaaactgctttatatattctggatccaagcctttatcagatatgaatttgcaaatactttctccaagtctgtgccttgtatattctttcaacaacatcttttgaagaaaagttaagaacttttcttcaaaaaaaaaaaaaaaaccagaaaagtttaaaagtttaacattaacgcagtgcaaactatcaggttttttcttgtctgaattgtgctttcaatgccacagctgagaaatctttgcctgactcaagctcacaaaaattttctctgttttcttcatctagaagatttgcggttttatatttagatctatgatccaatatgaaccaacaatcaaggttcattattttttcacgtgtgtgtatccactgtttctatgaagtttgttgaatttttccctttgaataaccttggcacctttgtcaaaaatcagttgcccttataggcatgaatttatgtctggactctactctctgccattaatctgcttgtttgtcttcacgccaggaaccaaattgcttaattactggagctgtatagtaagttttaaaattgggtagggaaagtcctcacatttgttcttttcttccaaaatatgtttggctatactaggtcctttgcacttccgtataaatttcagaaatagcttatcaatttctacaaaacactctgctgggattttgattattttgatgctaaatgtatacatcagcttggggagaagtatcatcgtaataatattgagtcttctgattcatgaacatggcatgtctctccattgatttagatcttctttaatttctttctgcaatgttttgttgtttctagtggaaaggtcttatgcacctttggttagattttcccctaagtattttgtatttttcatgctattgtaaatggtattatttttaaaaatttcaatttttaattattaattgctaatgtatagaaacgcatttgagtttctgctgtgtgctaatcttatatcttacaaacttgttgtacttacttcttagttctagtagtttattttgtaggttctctcaggattttctacatagacgatcatgtctgcaaatgaagacagtttttcttctttatttccatttggatacaacttttcttcctttttcccatctatctttttcttgctttatttaatggtctagaactttcaggacaaggctgaataaaagaagcacagaagcttctattcacacagaagaagacaccctagtgtgcttctaatcttagaagaaaagcattcaagtttttttttcattcaaaagatcatttttattagaggtacaaagtcgtaatcataaaagaaatcttgtgagggagtggtgactttatttgatacaacacaatgtactgaaacatggttgctgcttttccttttttaaaaaaatagacttattttttaggaagtttttggttcacagacaaaattgagcagaaaatatagagactacccatatacctgcccccacaccacacacagtctcctccattatcaacagcccccaccatggtggtacatttgtcacaatccatgaacctgcattgacacatcattatcaccgaaagtccatagtttacattaggattcacccctgtacattctgtgggcttagacatgtgtatgatgacgtgtatctatcattataaaatcatacagagtagcttcaccatcctaaaaatcctcttttctcatattcgtccctctctccccgaactgctggcaaccactgatctttttgacggtctccatagttttgctttttccagaatgtcatatatttagaatcatacagtatgcagcttttccagatcgtcttctttcacttggtaacatgcatccaagtttccttcggtcaggtgtggtggcttgcatctgtcatcccagctactcaggaggttgaggcaggagagtcacatgagaccaggagtttgagaccaggccaggcaacatagcaagaccccatttctaaataaataaataaataaataaataaataaataagattagctgggcatggcggcccgtgtctgtagttgcaactactcaggaggccgaggtgggaggactgcttgagcttaggaattcaaggctgcaaaaagccatgattgcaccactgcactccagtggggtgacagagtgagacgctgtcaaaaaaaaaaaaaaaaaaaaaagaggttctgatagcttggtaactcatttctttttagtgctgaataatattccattgtataatgtaccacagtttatttgtccattcacctaccgagggacgtcttggttgcttctaacttgggaattatgaataaagccgctatgaacttgtgcacaggtttttatatcagcataagtattttcagctcatttgagtacctgcccagaagtgaaattgctgaattatgtggtaagaatgtggttagtttgtaagaaactgccaaattaccttccaaaatggctgtaccgttttgcatttccaccagcagtgagcgaggtcctcttgctctgcatcctcggcagtgtttggtggcgtcagtgccctggatctgcgccactcttctaggtgtgcagtgctatcttcttgtggtttcgaacagtctgttttcaccatgaagtatgatgttctagtttgctgagagtttttatcaggaattaaagtcggattttgttaaatacttttcctacatctatggagatggtcaagtgatttttcttttgtagtttgctaatatgattaattctttttctttttctttctttttttttttttttgagacagggtctcactctgtctcccagactggagtgcagcgctgtgatcatggctcactgcagccttgacctcccaggttcaagcaatcatttcacctcagcctcctgagtagctgggactacaggcacaagcctccacacccagtcaattttttttttttttaatttttggtagagacgaggtgtcgctatgttgccaaggctggtctcaaactcctaggctcaagtgatcctaccacctcagcctcccaaagtgctggaattacaggcttgagccactgtccctggccacatcaattgattttcaaatgttaaaccaatcttgcatttctgggttaaaccctacttggtaatgaagtattttcactctatttcttgttagattcagcttgttaagtttcattaagaaattttgcatctatgctcatgacaggtatttgcttgtctttttctgattttggtaacagggtaatcctggctccatagaatgagttggtattctgtcctctttgatttcctgaaagagtttgtgtggagctggtattatttattccctaaaatgtatggtagaattcactaggaaagtcatgtagagctggagttttctttcaggaaaggtttttacttgcaaattttattttttaatagatataggcctattcagatttttttattgtgataagatattcttaacacaaaattaccatttaagtgtataattcagtgacattaagtacattcacaatgttcattaccactattcccagaacttaaaaaaattattccaaacagaaattctgtattcattaaacaatatctccctcctcccagcccctagtgacctctgttcctctgtataaatttgtctattctaggtacctcatataattggaaccataccatatttgtccttttgtgtctggcttacttagcataaagttttcaaggtttatccacgttgcggcatgtatccaaactttattcctttttatggatcttgatttctttttgggtgagctttgatagcttgtgtcattcaagaaatctgtctaagttgctgaatttattggcataatgttatctataatattttcttatcttccttttcatatctgtagagtctgtaatgatgtcacatctcattcttgttgatagtttgtatcttctctcttttttctgattttcctgtcaagaagcttatcaattttaatgattttatcaaatagtaaagttggtttccttgatttttatattgtatttctgttttctattttatttatttatactcttaccttgtttcctttcttctgctttaagtttaatagtttaatttgctcctattttttcttatgttagaaactgaagttgcatatataaaacctttctttttttctaatatgagcctgtaggactatatattttcctctgcatactgctttagctgcatcccacgcattttggtaggctgaattttcattttgatttagttctctttcgatttagttctcttttgatttctttctgatccatgaattatttttaaacgtattacttaaattccaaatatttggggggatattcagatacttttgcaatactaacctttaatttacttccactgtggtcagagaacacttttttaatttcaagttttaattgacagattatagttgtatatatttatgggagaaaaagtggtgttattatcttttaatacaatgtgaaaagattaaattaagctagttaacatatccatcaactcaaatatttgatgtttttgtgataaaaacattagaaatgtactttcttagtgatattaaaatgtacaggacttaattatgggctatgtttcctatgctgtacaattgtttctatacacacaaatcaaatgtatttttcctgtctaactgaggctttgtaccttttgactattatcttcctattgcccccataccccaggctctgataaccaccatcctactaccttctatagttcaattgttttaaattccacatataagtaagcacatgtgacatttgtctttctgtgtttggcttacttagcataatgttttctgattctatccctgttatctcaaatgacagaatttcttcctttttaaaggttgaatagcattccattgtgtgtttctaccacatttttaaaaatccattcacctcctgatggacacttaagttcattccataacttggctattgtgaatagtgctgcaatgagcataggagggcaaacatgtcttcaacatactgatttcaaatctttcaggtaaatacccagacataggattgctaaatcatatgttaattctatttttagttttttgaggcacctctgaactgttttacctaattactgtataacttacattcccaccaacatgtacaagggttcccttttctccatgtccctgccaacacttttttgtctttttttttgagatggagtcttgctctgtcacctaggctggagtgcagtggcgtgatcttggctcactgtaacctctgcctcctggattcaagtgattctcctgcctcagcctcccatgtagctgggactacaggcatgtgccaccatgtccggctaattttttgtatttttagtggaggcggggtttcactgtgttagccgggatggtctcgatctcctgaccttgtgatccacctgccttgacctcccaaagtgctgggattgcaggtatgagccatcatgcccagccttttttgtctttttgataatagccattctaacaggtatgaggtaatagctcataaaggtgtatacctaatttattaagagtttttatcatgaaattacactgtgtttttctgaatgctttttctgcatctagtgagatgatcatatgatttttgtcctttattttgttaatatggtgtataacatttattgatttgcataagttgaaccatccttgcattccagaaataaattctacttgattgtggtaaatgaaccttttaatgtgttatttaattctgtttgctgcaactttgttgaggatttttgcaactatgttcactgaggatattggcctgtaattttcttttcttgtgatgtccttctctggtttggtatcaaagtaatggtgcccccataaaaagaatttgtaagtattctttcttcttaattttttggactagaaatcaataccaaaatagattttggaaatttcacaggtacatgaaaattggacaacatggtcctgaacaactaatgggtcaatgaagaacttaaaagggaaatttagaaatatcttaagcaaatgaaaatggaaacacaatataccaaaacttatgcgatgcagcatatgcagttctaagaggaaagtttttagcaataaatgcctacaccaaaaaagaaaaaatgtttgcaaattaaaaacttcatgttacacttcaagcaaatagaaaaagagcaaactaagcccaagattagaagaaagaaataatagagattagagcagaagtacataaaatagagactagaaaaccaaaaccaaagatcaacgaaatagttgttttttctcaaaaaaagataaacaattgacaaacctttagccagactaatcaagagaaaaagagaaaaactcaaatgaataaaatcagaaataaaagaagagacatcataactgacaccacagaaatacaaaagatcatgagactattatgaataattatatgccaaaaagtcacatacgctagaagaaatttataaatggataaattcctagacatgtacaacctaccaagactgaatcacaaagaaatagaaaatctgaacagactgatagtgagagaggagattaaagcagtaataaaaagtctctcaacaaagaaaagtccaggacctaatagcatcactgctgaattctaccaaacatttaataaagtactaaccaagcctgtaatcccagcactttgggatgccaaggtgggtggatcacctgaggtcaggagttcgagaccagcctggccaacatgggaaaccctgtctctactaaaaataccaaaattggctgggcgtggtggtacacacctgtagtcccagtactcaggaggctgaggcagaagaatcgcttgaacccagaaggcagaggttgcagtgagctgagattgtgccattgcactccaggcttggtgacagagcaaaactctgtctcaaaaaaaaaaaaaaaaaaaaagaaaagaagaaaaggactaacaccaattctccacaaactattccagataacatactttatttgatttaaatccttatacatttatagacggttttttttttctgctgagaatatagtctatcttagtaaatgctccatatgcactgcaaaagaacgtattcttatgttgttaggtaggatgttctataaatatcaattagatcatgttggttgaaagtattttgtaagtcttctgtatcttcactgatttttctatttatttgttctacagattattgagaataaaatgttgaaatctctaactacaatttggacttgctcatttctccttatagttctattcactcttgtttcatgtattttgaaactctgctatgatgtgcataaatgtttaggtttgtttcatatgttcttggtaaattgcctcttttatctttatgaaatttcccgatttacctctgctaatatcatttgctctgaaatttcatacctgttagcacctgctgctttctttgaatgagtgctcaaatagtatatatttttaaatctattttatgccttttctcaactcttattttaaacctgtttgtatctttgtattttaatgggtttattgtagcagatcccgggaggtctacctatttcttcttcagattttcagtcaatcttcctcttttgagcctcactcaaccccttcggtttcagttaactaacgcttccaacttttagggctcttccgtttttggattttcctcagagccagtgagagctccagctttcctggccctgttaacagtcaccactcatccgtctgcctcccagcttccaggtggatggtttcagactgtcctcccattctcattgtcgttacaagtttatcctctcattgccattttgctgaagtttttaaagggagcagtaaattgggcgttgtctttgccatgttaagccagaaggtagatttctttataaaaatctctgttttgtctttgataatagctttctctccattttctgcctctgaaactgttagttgggtgttgccccctcttggagtaatcctttgggtctcttatgttttctctcctatttgtatctctttgtataaatgttcccttgattacctttctttcctatggggtcagctattctgtttaatattcttggtctttttctatcggatggctcacttttcccgtgtgcctggtggtcctttgtcctttgttcatatgtgaggatgaaggatcacactcacggtagctggcatgctgtgtgtcttccatgggcctcaccgttgaggtaataaaacatttgaatgggagctcatgtgtggtgttggcgcttgcacaccagtagactttgtaggattttaatggtcttgggagcatcctttgatattagaataggagtgcaccaacccctccactagaaccttggatttccgtggtgtgtgtccttagagagagccttctagcttgttgctttgtttgcctgggggtgaagatctgattgtcagtctctctgtgaagtagggaggggtttagggaagggactgcctggcacaagtgttttgttgacaaccttttattagaaccttctgtgtgatcccttcccttactgccagctctagcctgcagcctctccgagctctgtggggagaattggccactgctgtgcccccgctgctcgtgtctctgacctggcaccctgtccttggctctgccacatctgtaacccacaccgtctgcgttccacctccctgtgcccgtgccttgattgcatgtaaccccttcttcacctctccttcctgttttgggaggttatttcattctgtacttctttagtgggatttggaaggaaaaagaaaaatccatgtgtaaaatccaccatcttaaaccagaactctttttacccctagttttacaagcccttaagctcctgcagaatcaacccgtagttgtttttttcttaacctagagagacatctaagtaggagtcaacaggctttccaagttcttgagtcagccagtgccatgggtctgtgatgcacagactctatgtccactagtttatggcagtaatatagtcacctgggatggatctaaggccaaatttgctgtagcgagatctgtgactccaaaggattacaaatgctgaattattgcagtgtggacccaataagcaacctgaagctgcatcatggaattaaactgagttagagcctgagtatattgctccttgggtgattctatcctgcaaataatacattatccaaggtctggtgctggagacagattgctgcaatacgcatccaagggacctgttgctgcctgagagcagctccatcccatcatcccagtgctgctgttttattgatgccagagagtccccacaggtgatgcattacacaccgaggaggtggcccccagaggaaatgagggatctgcaagagaactctgtaataattattgcagagaagacagctaccatgctacatagaaaaggtctttttttttccccatgtcaactaggagagaatatagatactgacttttcttctcccaagttatttcttctgctttcgtaaaataagttcagatataaccaaagtaattcttcagatccaccctgcaattaaacaaaacaacttccttattttctgagtatctctaaacctccacagattcaaggacagataagcattaaagtgtcacaacctcctgaacatggtgctttcaaatttcctgtttcacaacgactgagaggtaatttgaagtgcaaaaatgtgagtgagaatatcaactccacaccttcagccattccgtcttcagctatttacagatacgttttaaaagcataccatttaaatatgaccagcaacttcctgttaaactttggatgtagcaaccaacgagaaatatggccctcggtggtaagagaggaaaaaatagtttctgtatacaaagccctaacataataaacaagcagaagcacttcctgataaatagcgccaagcaaacattcacatccttgcctctgctatattcaaaatgtttttactagaccaagtgcaaagtattattatcattaatattaagtttatccttcttgcaactgagccaggctccagttctacaggaaggtctggtaggaaccaagggtatggccgtttatcgtggcagatactttggttttaattcccttcatataaatgttgtaaaggcatggatggatagaaacattactgcatttggtgaaacccacgcccaacggccccaggcctgcagcaaccaccccacagaatgatcaacacggaaactccagagcagtaaacaggccaatttcagatccagcgacaatcccagcaggcggccaggggaagaaaagcaaggacgacagcaaagacagacgggtgcccacaggttccctgtagctaccgccacggagtgggaaccccagccagggcacagacagaggcagggcccctgtgaaaaggggcaaggactcaacttgcagggaagcactgccttgtgctacctttgttcactaacgtgaaatgctactctgagtgttccttatttttaaatcaaaaatttaaaaaccacacacacacacagaaacctttccatctattgacatattacatacagcatcatatgagtacagttcgacgaattttgacaaaccgagcccacccctgtaaatcgcacccagaccaagacagaagacatcagcagctcccaggaggcgtccctgtgccccactgccatcaacacctgcccccacgcccaccctccagggcaaccaccatctgaacatccttgtttacacgtcttcccggactggaattggaatcccagaaatcaagtggagtaaatgaagtgcaactttgtgccagtgtgtttgagttgcggctgctgggcctgcaggtgacaaggcgctgcttccccagagacctctttcagcattcccgtggtattaggagaaggcactgcagcagagcagagagaggagcaaggcagggctggggaaactgctcacatggagagatgtgggaggcagtgtctccacgagatgtcagggccctggaagaaaggagaccctgttggaggggccaggcaggacgaggggacactaaataccagtggcagccatagaatgatgtgtgtgaagtgccaccagccacagggctcagccatgcagctgggtggggtgggggtgtgtgagagggtcctgcttagatagcagcatcaccacccctaggagctgggcttggatctgatgagagtctgtttcctcccctagatgatgagccgttcccagggctggccactgaggatctgggtcacacaggccactgtcctccccacatgaagtttgcagtcaagttagaaagatgacaggtaatgaggtccacaccacacagctttggtgtggcacgtgtcaacacattcgccgacagaaccagtgcatgaatgaaagcttgagggcacagagcacctctcctgtcttgcctgaggtgtccccaggagcaagcctgacagccagctgggccaccctgtgagaccggggcccgctggagcctttccatgaggaagactgagccgagcgcctgcactaggaggagccacggtaccgccaggctcctgggcccgctgggggagtgggctgccaagcacccagtgagctgcggctgaaacaatgatgacattttgtcatctctgtcaacacaacaagaacttgggaggcaggcagtcccccgccatgcacagtgcccagtactgtcaccagagcctctcctttatccttctcctctgtcccatcagctgctggtggctcctccctccctggcagtcacaacacagccacctcgttctgtgcatcatggcctcaaactgctcctccctgctcatcagggagggaacagccaatgttccctgtgtctcattggccataaggtcacctgccctgcagggtgctgagacagggactctggtcacaggtggctgttggaaccctccctcctcagagcttcgcaggtcaaagggatgcgattagactctgtcaacacctctaagagctccactgtgcgcaacagagaacgagattccgtctcaaaagaaaaaaaaatcaatctatccaccatcataactttagtcaatatgcttattccgtcacctcttcatttgtcatccttcaacagtatctactgattctgcactattaaaaaatgagaatttccctcatttaccctcccccacctcctctcagtcacgattgttagttttcacattcgttagattcgcacctgtcaatatagacttgggcatttactgcttttccatccagctgagactgctgaatcttcagcacaccgtggaggcctctgaagccctgtcctgtcctccgtctcccctcccctcttccccttctcttcctccatcccgtgggtttttcttttgcagcaccaaggatggcatcatattctgtttgatgagcataattaagttttctgttctttgttaagttttatctgtgttgaaaacaagtcaacggcattcgcgtttttacaactttgtaagtaccattcatagcagccaagtggcttccttctctgtggttggtggctttcccggggccacaggagagaatgacttcagcgtcaaggctgaatgcattctgtctctcataaactttcttcttgctcaaaaccataacgtggccgggcgcggtggctcacgcctgtaatcccagcactttgggaggccgaggcgggcggatcatgaggtcagaagatggagaccatcctggctaacacggtgaaaccccgtctctactaaaaacacaaaaaattagccgggcgtggtggcaggtgcctgtagttccagctactcaggaggctgaggcaggagaattgcttgaacctgggaggtggaggttgcagtgagccaagatcatgccactgcactccagcctgggtgacagagcgagactccgtctcaaaacagaaaaccataacatatttttagttttttcatgattagactgtggctttcacagacaactttttgatatcccccccatgtttgatttacctttcatttttctcatggacgaagaataactgcctcttgattgcgcttctctgtcttgcaatctgtgctgtttatttatctgtggacatagcttctaacttgtcactccatactcccatttgtaactgccagggctggaagcctatgaactatattcccagcttctcctgatgcaagtttccggccaatgagaggcactggaggctggaaggctggatcatgggagaaagcatgtccccttctccagctccgggagcagctggcagctgagagtgactgcaatctgcagattggtggtgggtgtcacaatagtggcggagctgttgatgtttaggctccgtagcagcggccagagggtaactcctggtttctggatgaggggcaatcgtgctcatgagctctcgtagcttcactttccatttcattctccagttctatagggggtcagtgacctcctgtagctgctgctctctgagtgctatggaatgaatgtttgcgtccttccagatttttatgtcaaagccctgccccccaatgcaactgtatttggagacaaggcccttaaaggtaattaaagttaaatgaggctggatgtggtggctcatgcctgtaatcctagcactttatgaggccgaggcagaaggatcacctgaggtcaggggtctgagaccagcctggccaacatggcgaaaccccgtttctactaaaaatactaaaattagccagtcatgctggcacatgcttgtaatcccagctactcgggaggctaaggcaggagaatcgcttgaatccaggaggccgaggttgcagtgagccaagatcacgccactgcactgcagcctgggtgacagagtgagactccgtctcaaaaaaaaaaaaaaaaaaaaaaattaaatgaggtttaaggatggggcccagtctggtagtttgttcaatttcttttcaaaagagcattgtttttgtttttgtttttgttttttggcatgaggttgtaatcgctgtgtgcctggggtcgggaggctgactgacaaggcagcttcctccacagacttccagcaacagtcctgccctggctgcgctcctctcccccaggcctccaggccaccagcttgcagcctgtgctcctctggggagggatcccccgctcccccactcccagcctcgccctgacagtgatccgagttgcggattttggctttctcctccatcctcacccgtccaattgccctccagctcacagaatcattttctcaaaattttcaactgctaatgaccctgtcaccaggccacctggcagggaagcccacttgtcccctaccaataggcccatggtgtcttggaggctttcctggtctcctgggacaagacagctgcccggcttgtagccaggactgtgcctgtagcccacctgctgtaaggtcacgcctgcaggccctgagttttaccggcaagatctaagtcagttctctaccaacaccctaaggcaggtactactactttctccgtttagaactggggagagtgagatgcagagagcccctcccccgaccctaggcagagcccgagactcgccgcaggctcatgcactgtgccacctgccctcctgaggccacgctcttctcacgggaggtggccctgtggcctcacctgggccggatgggaattgcaaacttgaaaccactacgtctttttccctgtttttattttaaaaaggatattaaacgaacatatcttttaaaaattaaagtgaattgaagttcattttcattttatcctgagaggttcacagtagctcttgaaataaatgaaagtgactttaaacgggctttgttttgaggtgatctcagcagctctgaggatacgcacagcagtcttggagtctcacaaaactcggctggaaatctctggccccagagggaggaagatgcttctctatttctacctgaggccttccttaggctcctggtcaggaagggagaagagaccccgggcaaggggtgagaagtgggggtgggggagtcttgccccttcctctggacgacagagcccattactagagggaatttcaatggtgtttccaaccccaggtctcacccaggaaggaggaatctaaacaaactcagctgccagtggctcccccatagcgacagtttgaggccggattcactgaagttttcacagatgagtctaggtaaagttgtgggggtttttgctgttgttttgttttgttttgtttctttgagacagggtctcagtctgtcgcccaggctggagtgcagttgagtgatcttggctcactgcagactccaactcctggattcaagtgattctcctgcctcagccacccaaggtgtgagccaccatgcccagctaatttttgtatttttagtagagacagggttttgccatgttgcccaggctggccttgaactcctgagcacaagcgatccgcccacctcagcctcacaaagtgctgggattacaggcatgagccaccgtgcccagccaaagttgtggttttaagcaggatgttccaaagtccagtggttatgaccaaacgccacacagagacagaagcctcccgcacagccccaactcccagcagccatggtgttccaggtcctccaaagtcagcttctcctccaggaggccactgagctccccagctgcggggctgaggccacacagccctgtgcggttcatctgccatccgggcccttcttcctcttctgagcttcacagttagcccagggaagaaaacaggcgtgtcttccacaaaccctgaagggaatgggaagtgccaacagtgagaaggacttagatgtaaaggatttacacacggtcacggcatttccacaaccctctgggcacctgagtacacgtgtgcagacacacccccagatgggggcgaggggtggggtgccccagctattcacacctaaccatgagcgtgtgaggcagcaacacttaaaggccacttgctttccgcagcatctcgatggagcaggagcctgcctggggcatctccaggcagcttggctgagcacccaggactgagtgcaaccctcagcgtttacattttttagtactattcactaagagagagagagacagagagacagtgatagagacagggaaggacagagacaaagagagcaatgggtgaagaaagagcaagcaagcagggatgtcggacatttcacacaacgcagtcaccagggaggcaagaacacttacagaacagtttgagccaaagagtcactcagggacaggaacagcaatttcttaaatatttaaagcagacaccctgtgagcggctgtggaggcggctctttgttaatatttaacacgagctgggcagttgccgggaaaacagctgtttacaggagagattaaccaatattcatcattgctcaaagctgtggggaggcttcaggggacaggcagctgccggtatttctagaatacagcagctcaaggccacagggctggggaggctcacggtgtccccagggtgcatgaaaactgtaaacaggcagttcggggtcacctaccctgctccagaatcacggtttgcaggaaacccagccctgcagctgggcctgggtggtggctgctggccggccagccagcacctcgctggacagctgcgtcccacagtcccaggctgggctgtccttcaggcccatccacagtcccaggcagactcctcgtgcactccctgcatgaagtcgggggcaggtgctcgaaagtagaggggttcccactgatggaaagtgtcaccagcctgcctgcgaatcccccagctcacacttgggcttgcagggacaccagccaggccgtcttgcagagaagacaagctgcctattttcaggggctatgagtcttgttcatgacagttttctcctctatgtgccaaacattcaagagcctggccattttcacacagccccatagcctgggtgaatcaggcctcactcccctgtacttccttccaaacattctatcactcccaacaccctccacccaggcctcatggaactacacacagatcacgcttgggcccaactggatgcggaatcccagctcaggaccaaggaatgctgctgctgtctccacaatgccctagacctgcaaccctgggcgcttcctggcataccactgcccactctgcccacaccacagctgactgactcctaatggctcttcaaacagttgtttgcacacctgaccatttattataaaggaagaagcgccgaacagcacgtgctgctctgaggaatctgtacaagaattggggctctgcgtattaatctttgctaaaatgaatttagtttgggtatttaggtttcacagcataaatatatttttctctactctgagaccaattggcacaggctgtctaaggcattagaagaacagtccttaatctttctgtgttcacagcatagttctgaataccagaaatctagaggaatgcttgaagaggtttttaaaaaattaaacaacattaaaggagtcagcaatgatttccatctcagcaaaacaggggccctcagggtccagaaacatccatggccattgagcagtcacttggtcattcttgtggatgctttttttgagatggagtcttgctctgccacccaggctggagtgcagtggcgtgatctcggctcactgcaacccctgcctcccaggttcaagtgagtctcccgcttcagcctcccaagtagctgggattacaggcattagccaccacgcctggttaatttttgtatgtttagtggagatggggtttcactatgttggcgaggctggtcacgaactcctgacctcaagtgatccacccgcctcggcctcccgaagtgctgggattacgggcgtgagccaccacgcctggccttctggatgctttttattttgtggttatgcagcatcaggacagccttttaacatttgagaagtgaaccgtcttagtgggaggcaaaaccctgcttccctctacagaagcctaaaaggccaagaacgtgcactccctgacaccggtggggggtagcagggctgtgcagccacatgcccaggaggcacggagacttcagggtccgtccccccattcccaggtggcagagcagtgccccagtgtcctgggtgcgaagagcagtggctagtgcatgctcagcaccagcagtgtcctagccacatgtcttggggctatagctgtggccacttggcacctccaggttcctgacccttccccacagtgactcagcagggagttgtctgtgagccacttgatacccttttacaatattccctttctgatgattaaccagaagtgctttgcaggcgggaagcctggtgcgcacagtcagggtctgccctgtgctgctgcttgaggactgtctcctgccctgacggtgctcttcaaagctgccgcgggcctgcttgatgtaatgctcacttctgacctctttgcccatgcaaggcacaccctgccctgccgtccctcccacccccttcctccttggcattctgatggactcagtggtccccaaaattgcacacatcaattaaaccagcagcacactcatggagggcgggtggcgccctgggtgctgctgtgtgccagctgtcaatcaccgtgggctggaatgtggattacaagcctggaaggggtatcgcgcactcagggtttagccacagtatacaaacggcttttccacctttcctgtcctgaaggccacagcagggcctgctctgctccctgcggcagtggtcctcatgcttggccaggtgactaggcatactcgcagttactgcagggccactgtgtccccggctgagcctcgtgccacagagaattggtcagagaagaaggcggcttagagagggtccggttggcctgcaagcctgagcccctgcccaggtggagattaaatccttgttacctgatggtattgacgcttaaaattaaaactgagttcagttactgaaaatagagaaagggccacttctatgctcctgagatcggaagtgaggtttatccccccggggatctgaaggatcatccactgggcttccctaaagcggcattgtgtcatttctcccggctaggagaggtctccccattctcaattcccgtcacttattctcactcaacagaacctctcagagcacctaccgtgtgcatgagcccagtgtcgatgggccacgggccagccagcctgggacgcgtgtccagggcagctgggatttggactctactccacgaggccacacaggggaaggggaagcccagacggctgtcagggcattcttgggagccgggggtttggaagggctgttgggcgtgctggggcaccggctaggctgtggggtggtgactctcctgcagccttggggggctaccctgagatcatctgtcaccccactgcttgctgctcactcctgatcccgcattctggctgtgggcagagagcactgcctgccacatgctgcgacccgtggccccttcgccagtttaattttcttttgtgcccgttcccccctcagcgttctagtattttaatgtgtgtccttttatttgcttgtgtcccagtataagacacactattctattttggtttctaaaattatttctttactagattgaacctttttaattttatttttattgtggtaaaatatatgtaacataaaatttaccattttaaatattttcatatgtacagttcagtggcattaagtatattcacactgttgtacaaccgtcactgctatccaccttcagagctttttcatcttctcagtctgaaactttgttgccattaaacactaactcctcatcccacctctgctcaacccctgaaagccatcttccttcctttctttttctttccttctttctttctctttctctttctttctttctttttctttcgccctccctcccttcctcccttccttccttccttccttcccttcccttcccttcccttcccttccttccttcctttctctttctttctttccttttttttgagacggagtttcgctcttgttgcccaggctggagtgcaatggtgcggtctcagctcactgcaacctccacctcctagcttcaagcaattctcctgcctcagcctcccaagtagctgggattacaggcacccacccccaggcccagctaatttttgtattctttttagtagagacggggtttcaccatgttggtcaggctggtctcgaactcctgacctcaggtgatcccccggccttggcctcccgaagtgctgggattacaggggtgagccaccgtgcccggcccccaccattctactttctgtcccaataattttgacaactccaggcacctcacatacgtggaatcacagagtatttgtccttttgtgcctggcttatttcactcagcataaggtcctcaaggtctgtccctgttgtagcacctgtcagaatctccttccttttcgaggctgagtcatcttcccttgcctgcgtagaccacgttttgcttatccacttattccttgtcactcagtactgtttggtactcttgacctacataaggactatttcactcttggcctcgatgggtttctatgttcactcagcaccagaacctcatagtagtttcctgcctctgtgcacatctgggccgttgcttctaatggggacctggcgtcccgggggtcctctgcacctgacttcccctcttacccgtgacacaggcccccagcctgggacgctcctgccgcaagcctcagtgtgcaggtctcgtttatcattatctgtgtttccgcattttatgtttcccacccttcttgcttccatttggctctgttacggttcctctgtctgctttccattattaatactgccccttagctgagaatacctatgacacttagtatagattccgatgggtgactgtggctcagtgtgttttctccctgggagagagaagtgccccggggcctgcatttgccttgatcttaggtgcatgtcctcctggggacaggtaatggggaaggtgctgaagctcaggcccggggtgtctgtggcccccatgaagggggttatgagatgggagatgagccctgagaccatgaggttgcttctgttgccagcactttccctaactcacagttgtaggtggccctgagaagaggtgggtttttcaggttgcagagcccaccagccctggggagcagagggggcagccaggaggggtgcccgaggaaggctgataggaatgtacccagcctctacccatgcacgcctgggactggaccctcaccaacacaaggcggctgggctgggattgctgctatcccagaggaatggaataaagtggggtggacacaggagcaggacttccaagctctccccaccactgctccctgccctggccctggggctgctcccacccacacccctcacgggtcccagtggcctcaggcttccccggggctctgtggtttcatgctccctctccccaaggtgtctccagggtcgagccgggcaggggtgcagcccatgctctcactgaagcccgtggctcttccggtacctccacggagtctgacccgatttcaagcccttggtggatgctgacgggacccctgtggactacctgtattttctcttcatccaaatgttggtggaaggaaggaaagaaggaaggaagcaaggactccccattgagcccacctttagcactcctgggagggccttccctacactgggcctcttcatctcctcattcccggctctgtcctcttctgaaaactaatttcctccatcagttcccacctacctggccaggcaaaggacagctggacctgggtaaagtcccctaacatgagtctgcttaaatggagagcaaatttcacagtcaatagtgaaaaaaaaacacaaaacacagggtttgactggaacctacgtaaaaaatgaagcacatttgtgtaaattatttatatattatatatcaatatattgtgaaaaattgtatttaaataaattacttgatatgcaaccctgagccaatttttagaatgaaagaggaaaggaagctattattaattagtttttttggcataattgtatatgcgcttacaaaattaatagcaaatagttaacaccacttactgtgtgccaggcaccatggatgtgtatctacactcatctaatgctcacagcactcaccgagacagatcccatttctatctccatttcacaggtgacaaagctgaagcacagagagcttctgtgcattaccaggtcacgcagccagtgttaggagggctggggtctgaacgcgtacccccctgggctctgctgtgtcctttaagtttctgacttcggcatccgatcatgaatagggtcatctcacaaaaccctgaaggcctcgtggcttttccccaggccctctctgacgctgtcttggaagctgctcccttcgaaagtgcgcactgggccaggcgtcatctttctcacttctctcctctttggctgtaactgacctgcctcctggacttgcttttcgtgtgtgaccccagcagctctgcccaccctgcgctttgcttttcaatggattcacccaggttacactgtgttcttccatgcatgagatccaggagtcatctactacagatcagctctgatgctgagtgacgggcagggcgagaggctggagatgctggagcgggactgactgtataggtcgtttacttcctcactgagccggctttgtgtccgctctgatcagggccccggggaggtagcagtagacaagacagccacagccccccgtttccatggagaggacattctgttaccttcgaacagagggacacacacacacagataagaagggaaacaaagcaggtaaagagtataggaagtgcccggggtgggctgaggggttgcaatttacatagttgggccagagaagacatctgcaagatggagaaatccgagtaaacattgaagaaacccaggaagggggaccccgagggaacagccaggccctggagtcggggtgaggggaggaagagccgaagctgggagcagaggagccgaaggcgagggcactggggtgacagggccggatctcgcagccttgccgcagcctcaacactggctttgtctcgtatgggacagggagctggcggagggtagggccttcaaacagcaaagggacatgtggcttgtacgtgaaagagccaccctttccgcgtgttgaggcaagactgcaggggcacatgtgcatgcagggaggtgaggccaggcgcttgcgatgttccaggcgggaggtggtgaccacagggcccagggtggtggcaatcatgggggcaatagtggccccatggagggcgcacttccgtgtcctaaagtaatggtgtggaaggaggggagtcaagaagacgcaaatgcatggtgcgtgcgacggaactgccattctccggggtgggcgagacaaggtggagcaggggccagagacccgagaggcccaggtgtgcaggacaggccagtgggaaacgcgtgtagggttgtttgcacagatggtctttcaggccaggagaattctcggctcatgggtagagggagtgttgattatatgggaagtggctcccatggagtccccggtggtcaatggggagaggaggagggagagaccagcagccagtggagcccaaggcaggcagagacaaggatgaggaccagaccggtgctgggtggggcagcctgggggcgagtgctggccttggcagagccgctgggaggtgtgggggtgaaagccaggctgctttttacagagaaaggaagaagaggacttggagacagcaggatagacagcctatcatggaattttccggaaagggaaagagagagatagggcagtaactggggggattggtagggagtgactcaagggaggatttcttgtttgatgtttgtcttttaagacatgaaaagagagaaataaccatgtgtttctagccgatggccgtggcccaggggaaggtcaggagttgctgggcctgtggaggggtgtcctccagaagcaggatctggggccaggaggagccgctggtcttgtggggcggggggcgggggtggacggcgcaacccagacacagaaggaagggcagagcctcggggcccacaggcagcactgggggtgtggggacttctcccatggcctctgctttcccagggcagagaggggaaggctcatcagcagagagagaggaggaggcaggaggggacacggcccgaaccccaagcagcttgctcactctgtgggatgtgttgccaccgccatgctctcttttcacaagaaggtgtcccaggtggaccctagaccaggcgtggttggtggaagtcaccggaggggcctcacggtgaccctggagaagggatggcctggagtccacagcctcccctggcactggaaggtcccatggaacagcctcctgctaggtgggcccaaggccagcccagagctgtgggagcagcgtggggacagacccggggaaggtggcagagaaagaaccccagtcgggtggtgggtggtccccagctcagcgctgtcctggggccagtgattcggcctccgggccccagcttcattgtctgggtcttcctggcagggcagtggcgaggagttctacgagctaacgggagtggaatgcctgccctttctcatctccctgacgtgaatcagtttctccaagttcttcacctaacagagcagaaatggtgactcgcggccacacccggggctcttagtcttggaggcctgtccccgccccatctgctgctgcccacagggaaccctcctagagccgtcacggggcataaggcccagggggcctcgcgagctgatctttcctgtgcggagccaaggatgcagcagagggtgtgctcacggcgaggtgtccctctccggaggcagctcttcagggtttggcagaggagaggagcgcagtgaccacccagcactgccctaaggtttgcaggcacccgggagggacaatggctccatggcgggcggaggccgagaagcacttggcaagctagctggtcccatctctggatcctaagacattcccttctgctgttattcccagctgaggaaggccgccgggatcagtcgatcacttgtgttcctaaaatgtgctgcctgcagatgccgttctgacaaatctgcaggggccacagtgaagctctgcaggcttgccttctgcctctggggatggcactctcatcccatcctggagttactgcccgggctcccctctcatgctggccccacctgtgccccaaacacagcactccttacacggccctctcccttgccatctgatggctggatgatcaggagggagcttctgagggctgcctttccatgccatttaatggggaaggaaggggctttctctccactttttcttgcttcccatttagtgtgttctttccatttacacaatgtgttctccaatcttggatagcttctgttcttatttaaactttttaaaaagggattcatactcaacatacaaatgaggaatgcagctgaaactgggagacgtgaggagaagcttttttttttcaagtcagtgcaaatatttttggaatttaattttccttagaaaaaaatgccttgcagacagagcgtctgcatcctgtgtttgagcaccagtggtctctggtgtctttatttgtaaactcaacatgatgatatatgacctcacaaaccctgacttcccccctagcaaaattagaacagtggctcctctcttcctccagccagtacttcccctctccttccccctctcttcctcatgcctctaccctttcctccctttcatcttcttgtttggttgtgggcaaatatgatgacacccttataggaaagacttagaactaacagacaaggaaagtctataaagcaagcctgtgccacttaattgcaaagcacatttcagcccaggcattctgaagggacacagacagaggagaaatgctatccactcagagaaagcagagatacaggagagcagtatgaaaggcaggccaccatgccaccatgtatgttcagcctctgggacatagtcttcttactggacagatggttaaaatggtggcagataaataaatctcctttccaagtcattcaggccaaccccaggaggatcaagccatatatatgccttgtggagggaccatcttcccttgtgaccagtgctgtctggccagcagctgtccccattactgtccccaggaaaccccaggttgggggtgaaggcagccaacagttttcacgaggtgggttgtggtgatagggcccttgggcagagccatggtctaccatcttttgattttccctcatggatgttgtaaaacccttagagttccaaccacaagttattggttaaacgatgatatttccatacgtgtgtgaaccatacagctattcaaagtgagtactggcatggttaaccattaataatgcgtttgggaaaaacacaggctagaaaacacatctttagtgataaaagtcagagagtgtgcaagcgtggggaaaagggtgggtattgaccagcaaggggcatagggaaccctccagatgccagaaatgttctctgtcttgatgggtggggggatacaaaggattatagacttatcaaatcattgagctgtatactcaagatttgagccctgcattgtgtgaatgttatacctcaataaaagggaagctgtaagtgtagcatgaaaatattatgaaattttaacatggcagattgtgttttccaaaaatggccatagcagtatttctggtcctgaatgcatttccagaactctgccactctctgtccgaaggcggagtgtctcttccctccccttgagcctggcaggtctctgcaactttcagctaaaatgaggtggtaaaggagacgcccattactcctgaagttaggtcagaaaagctgcttttgcctggctctctctatctcttgggacacttgccctcggaacccagccaccatgttgtgaggaagccctggccgcttgaagaggccaacagcaccaactggccaccaacacccagcactggcctgaacgaggcttcagatgatactgaccctcctagtgtctctgctgagaccccagacgttactgggcagagaagaaccatccccattgcacacaaccaagttcctctcataggataatagatggtggttttatgccactctgttttggggatagtttgttacacagctattgtaactggaagtgtgtgcacatgtacgtgcatgcttatgcccacacacaggaaaatttctgaatatctggacagaggaattggagttgctgttcatttgttttcgcctattctctaatgtttcaccaataagctggtactattcatgtaataaaaataaaactgaaacaacgtgaataaacttctcaaatggaaacaggaccgcggcggggattcaagcatactgtgccaggtcagcctgtgccctgctgccctccgggcgctgggacaagtccatggaagtgttgagaaggacggagtgagctctggccgagaggacgctgctgcaaccctgcttccagctggagtggcttctgcacctgtgtttgttgaacagcaagcagccttcgtggaaggggttcgggtgcgtgtgtctgtgtctgcagaggtggaagggggcccctggtaggccaataatgcattcctggcaaaactttttctctccagattccaaaaatcaaattaattaaggggtagcctcgaacgctacctctaagaacagtattaaaatattcatataaacgcccacatcttgagttttaggaatgcaaatcaccgggtgatgattcaaagagacttcaacacaaaatacagtgtgttccacatgcccctggccatgaaataataacagtcaggtccagggcctgccttgcagtatgtggagaagcaacgggccctggccactgattcctgaagccagggtggtgtcttgtacggacacttcattatccctgtccctgcctcccacttcctaaagctccctctagcatcccaccctctgcagtgttcaaaggtcgaatagccgctgaaagcttttgaaccgaggaagcctctgcttaggatccacactttagtaggaacagaggaacctgaagcctccttgtctttccatcctcctttgccctccatcatttacccaggttggaatttccaaacaacctgaaccaatcaaggtgggtttgcttcttgacctaagcacttggtgtgaggcagggaacctgggagaatcaccatactttggtttccaagtacctgggttcttttgtttttgtttttgttttgtagagatgagggtctcactatgttgcccaggctggtcttgaactgtcctcaagtgatcctcctgccttggcccccccaaatgctgggattagacatgagccaccatgcctggcctatttaaaaagtgggtgtccacccggggttccccaggtagattgcaggcaatgatgtgggggtgctggggacagcccatcagcaagtccacctccagccagatgctaggagtgatgttcaccagggggccccagaggataacagtgcagagtgcccagggtcatggctctccaactaggaggacgagcgacgccacagaggaggtctggagccagccccggggatctggtctggagacaggtggcatcacattccatttgctgggactggtctgggagtggagcacaggtctctgaggtccgtcagggatcagggatcccacggagaagcaggggagctggagctctctggaggcccagcgccagtgcaggggctgagaatgcaggtatgggcagccaaagtctggggaggtgccactccctgggcaggaactagaatgaacccaaactggcctgggctgctgggggtgtgggaggtacgtggaggggaggagggttccaggaacagctacaggagtcagctgaggacacttttccccacgcccaccatgcaccctgcataccacagaaatctggtgcctacaacaagcagagctcccagggcagcccagggtctctgtggacagacaggaagagatccaggctactctttgggggtgaggagggcatggcccttggcacagagagaccaccaggaccctgggagcctggaggctgggagcagggttgggggtctctgagataagaccatccagatgctcctggcccctcctggaggggagaccaggtgagattttccatggcagtgcagtcacctgtgggatttggtgtcctctctggtgggcgtggcccaagaccccaaggctcctggtggggctggcgtctcattcctggagcctctcctccctgtgaggcacagatcagggtctcggggaagtcaggatgggcctcctgtcccctcttccacctgactcagcactgggactctgatgaggggttgaggcctgaggaacttcccacggttggggactccctgggctcagtgagctctgagatggtttctccagggcgcgagcatcctagcctcacgtaatcccctcctgaaagcacctcagtttcccctttgattgggtctatctgggtggcagaggagagagcctggcagggcaccaggaggcagggcctggcgcggagacagtggtggtccctgcaagtgcaccgaggccccgagaccgcaatcctctcccagcactgcctgttgtcgtcagcttcacctgaatggtttattgaaagctgtctctgccatctctccatgccagccttagctcaggcaccacctccccagggaggccctatctggcctcccaggtgcagtctcttccccagcaccccagtgttctgaaatcccctggtccacctgtttgctcgtccatcacccatcttccctcttggatgtcagcttgatgaagatgaggacttgtgggccggggccaccgcctgcctgtcccagctcagtgcccacacagcctggtagggctcacaccatctttgttggaggcagtgagccagtgggtgacccaggctctgaggtgggtgcaggtgatgtggcaatgaataaaacacagccactgatgtcctaaagggctcaggtgggtgtgcccattacccagttaccttcaacagatggcagatctgtgggcgaggagtttctggctggagttctcaggtactaggcaggggtgtgacggggtcgcacatggactctgggtaaggtttggatggacagaataaaggaaagagcccttactttgggatgtagggtggaaatggcacagaggcaggagagcacgggccttacctgggccagcgcagggtaggctggggcccgcccacccaggttcctctaagcctccaggcctccagagctgttttctctgcaccctcaagctcccttccatcctactcctcctcccaggccccctcgctgtcctcctgcccctcctcctgccggacactaggtcttcacgggaatccccaggacccactttccccagaactgggggaaccctcgaaaagcccccacagcccacactcctaggtttgtgaggggagctcagctctgcagctgtcagcccctgggtcccggccacggtgtctgtcctcacacacagctgagggacttcattttgccctttccccggcctgaggctgagggacttcccctgaccccccacccaaccccagcactgctctccccgctgaccccccacccaaccccagcactgctctccccatcgtcccctgccatctccagcacctaaaaccaccgtcctggggtggggagatccacttgggcagactcttgtttggtggttgctgtctgcagccatgagggaggagggggcgcaggagcctaggtcggggggtttctaggggctgtagtccccactggccttgggcatgcgctgcctgtggtccctcagggtgcaattttccctgtaatgaggcctgcccccgggaatatctacatctggcatgtgtctgggagtgggtggtattcagagggagtggcgctggtgtcagtgcggactccttgggcactgccttcctcccaaagcctcacacacagcggtgggaccggggtccttgcctggcacaggaggcctcacttgagtttgcagccagaccaaggggcaagtgtctgccaggcccactgagctggttctggagggactctgcctacaggagtgaagggcatggggggcaaccccatccttcctccttccgcttcccttgctctcctgccttcggtacctttaccaaaccaggtggtatgttccttatgttatcctaggaagtcaaacacaagcaatggctagcatctaccagacacatacggtgtgccaggcccttttgctaacactgacgctctccccgcaggtagaacctgctaccctcgtccttctacagctgagggggtggaggcacaggtggggcgggtgaacggctcagccagcaggtgggacagatgggatctgagccaggcaggccggctgcggagcccccgcaccaaaccaagaccccagactgcctagggcttagtgcgtggtatttcttattttactctaagggaaatcacctagaggtcatggcaaaccaccttttattgtatggggtcctgagcgggctcctgtccccgagggcctcagcagctgagccaatgtagtccctgttccacagcaatggaggattacaacaatgacctggaacccgaaagacccaggcttcggaaaagctcacgttcatgccgctggactgatgagaacagggaaggcttcactttagaaagcgttgttcacagcactgcttgcagccagcaggacttcccaaggacgttctcagtcagcacagaactggcactgcccaggagccccctgccccgcgcgcgcagggtctccccagttctgtgcccacaccacctgctccagctgcactcgtgctcccaataggaacaggtggcccagagccctccgctgcctggcaggatggtgggggagctttatttcccaccccagtctcccgggtctgatgccctccagcccaccccgcctcccacccatccgtgtgacctcagcctgtggctcctggcctctctgcttctcaccacgccgtggccactgtggtcagaggccagtcccccagtgtcacgggcctccctgcccacgaagaccgtctggacggccagttctgagcggccatatgtgtgggtggaaaggagtctgaaggccaagccagtctccaaataacaatatggaaaaaatgttaaagaggcgagcgctaacctgggatcgctgcaagtcttgttcgttaaaataaggaggaaggaaaattggcatgggaataaggaacattacagggtatttcctgcaaggaatatgggacatacttggaaatttcttgaggcataataagtttactgtcccttttcttaaaaaaaaaacattgctgtggctcacctgtccctccttccccaccaaaaacagttatttatgggtgtaaaatattccctgtttcaagcaacttaagagaacaaatactgctgtgagagactcccccagcagtgaaagatttggcacacagtcaggatctgaggtttggctatttgcttttagccattaattgctgtagaaagcctttgaaaaaaccctgtatctgggagtctcctgctataaaagaccatttagaaccagtgggaagctggtctttaagttcttgtcgacggagactccagtctccaagcaggaactcccaattacacatttacttgataaagatataggcgctacctgggggggtaattaaatgtgaaaatccctctttgaacctatcattgtgggatgcccaaatttggccctagagctgctgcctttgtgagcccaaagagaatcgctgtgggattgaggagaacagaacggtttctttctccccctccttcattaagaatgctttgacctactctcttatagtaaaaattattaattaaacgcccaaacgcagccgctttggcacagggaactatttagaaggcaaacaccgaaattaagcccagacacaaacgcattctactgcagaagatgctactgatgcaccttttgtgtgagacagtgaggaagccggggtttctgagactgtgtgtgccaggcatgttgcttggcataagacgtagtcaggtttaagacaatcctctcgcaaaagcagcactccttttgcccgcggtggtgatggtcctggagatggaaggaagagtggaaatggggatgcctgtccactctgagcctggttcgtttctcttctccacaggatttggggtgttgattctgtttcttctcttatcactgcatttattagagtccttgaccctccagaacctgtcacccacctcgtgtcaggacccagcctttgtggtcaggattgcagcaccctgagcccacctcgagacccacaggcttaactgtgaagtggctcccatcggtaggggacctgatgttggagtccttaataaggagtgagccctgaagtctggagacatttcaattgcccaggtcactgggtgaacctgtaaccaagaggctgctggccaaaaactcatcaacagcttgtgttttccaatttccatctatcatatccgtagggcaatgttcaacgcataaggtccaagtgaaggtttgcactaaaaacattctgttgagtaaacacaaatggccattaaacacacgaaataaagccccacctcactagggaccagggaaaggtaacaattaaagcttcacccattctgaagctagcaagtggaaaagatacaaagataaattgtcgttggcatagacggtgacacccagtgttggtgagatgtggagaaacgggttctcttgcccacaactaagagcaagcatggatgccatctttccagagggcattttggcactgttttcaaaagcattaaaaacatgtgagccaatgtgtgcttccaacaatgttggactagcttatttcagatcaaccctcctatcaagaacaactagaaaagctgtagacaaatgtataaatcacctgcttgaagtcgtgggagtagccccagggcagtgagcacttgaaaggtccaggtcctggagagaagaggaacacaggaggataagctggaagttcggtgcctatttctctctcaaggcagttgccggttctctctcagctgcagctgagaggttgagaagctaagcaacaagcagtgatggaggggctgaaaaagtgggtgaactgctgacaatctcataaggaaaaagtgggtgaactgctgacaatctcacaagacaagggaacaaacattggcatggagggtatgcaaaagaggagtcaaaggtagataccccaggccttcatttcaggggcccaaagagctacctagagtgaccaaccaccctggtttgtctgtgactgtcctggttttagcacagaaggtcctctgtcccaggaatcccctcagtccaaggcaatccagggttcttggtaactgctgtggtttgagtgtcccctccaaaactcatgctggagttgaattgccactgtgagggcattaagaggcggggtcaggtgggacctttaaaaggtgattaggtcatgggtctgtgcccttatgaatggattaatggactatggcttgtcataggagtgggttagttattttgagagtgggtctgttataaaagccagtttggctctctcttgtgcaccccacttgccctgtgtaccccgcttaccctgtgatgccttctgtcatggtacaagacagaaaaaaaggtcctcagcagatgcagctccttgaccttagaatttccagcctccagaactgtaagaaatagatttatttttattataaattacccactctgtgtattctattataggaacagagaacagatgaagatggtcaccctaaataaaccctggaattcatgctgacacccaggttcaaatcctctcaggccctaattaagttaggtgatctgccattgatgatgaccagaagcaaaagttaatattctctggggaaagataacacccagggtcttgagtcttttctgcagttttcaaacacaatagctaacattccatcaaaactaaccaggtatgaaaaatgataaggttggagcaagaggaaaaaaataaacaatacaaaaaatcctctggagattctgatattggtgttacgaggcttttaaaaactaaaataactgagattagtatattccagaaattagataggtattttcagcagcatcctggaagcaataaatggaaactttagaacttaaaaatatgatactaaacttatgggaatagttaagtttaactacagattagacatagctgaagaaaataagtaattgtgaagatagttagaaaaatatatctagactgaagcacaaggagaaaaaaatgaaaaatacagaaaagaatttaagagaaaatatgtaattagagtccaagaaagagagaggagagagattagaagtaatatttgaagacaaaatggctgagagatgacaaaaatgatggaaaacagaaaactacagatttcagaagagctataaagcacaaacagtacagattaaaaaaacacacctagacgcatagcagtaaaactcctggaaaccaaaaagaaaactccaaaagcagccatagaaaaaaaaccatatttccttcaaagaaaacaatgaaagctaatggacaacggaaccatatgttcaaagcactgaaagtaaattgctgccaacatataattatatacacagcaagaatatccttcaaaagtgagggtgatgtgaagacattttcagacaagtgaaaactagaattattcaccagagcacctgcactggagaaactagcaaaagagttccttaggcagaaggaaaatgatcctagatgaaagcacagagatgcagggaagaatgaagagaaatacaaagatttaatatgcaggtaaatctaaatcaagaccgatcatacaaaacaacaataataatgttttgggaatactatatggcattttgtaacgatgaaagatcaattcaccaggaagacagtaattctaaattagcctcaaaattgtaaagaaaaaaattgacaaaactaaaatgaaaaatagacaaatccaccattatcctgggagatttttaacacaactctcttagtaactgaaaaaacaagtagacaaaaaaaagtcagcaagcatacagaaaattcaaacaacacatttaacaaacttaatagatatatgcagaactctgcaccacaaactgcagaatgtgccttctttttaatttgcacacggagcattggctaaatttgaccatattcggggaaatgatacaaacctcaatacatttctaatgactgaaatcatgcagactgcgttctttcaccacattaaaattaagctggcaatcaaaactaggaatccccaaatgtttttaacttaagttatatgttgctaaataaccccgggtcaaaaagaaactcaaataaaaattcaaaaatattttgagaccgggagcggtggctcacgcctgtcatcccagcactttgggaggccgaggcaggcggatcacgaggtcaggagattgagaccatcctggctaacacggtgaaaccccgtctctactaaaaatacaaaaaattagctgggcgtggtggtgggcgcccgcagtcccagctactcgggaggctgaggcaggagaatggcgtgaacccaggaggtggaggttgcagtgagccgagatcgtgtcactgcactccagcccgggtgacaaagcaagactccgtctaaaaaaaaaaaaaatttttttctttgaactgaatgataaatatgtgatataaaaccttgagatgaagctaagctatactgaaatggatatgtgagagaagtaaagaggataaaatttaatgagccaggataaatacaagtgattccacttatatgaggtacgtagagtggtcaagttaacagagacggaaagtagaatggtgattttcgggggcttatgggggcaaaggagttagtatttcgtgggtacagagttgcagttttgcaagataaaaagagttctggagatggatggtagtgatggctgcataacactatgaatctacttactgttactgaaccttacacttcaaaatggttaagatgatatattttatgtgtatctgacaattaacattttttaaattaatgagctgagcatccatctcaaggaattgggaaaataacaaattaaacctaaagaaaataaaaggaaaggggtaaagaatataatagcagaaattaatgaaatagaaaacaaatttgcaaatagaggtgttcaataaagttaacgtttctttttgaaatgagcaatacagtcggtagtaagttgggtttcctgggcagcagattctgagatgaagagcacagtgctgaaaggttacgagggactgttcttggaatccaaggaaagcgaagggaagggaagagaagagaaagggaagaaaccaggattgggtaaaggaagaggttgagctgtaactcagcctcacaggatgcctcagccagctactcagggaggacggaagctgacaccacccttgagagtcatcccaagccggggccagaggcagatcttcatgtcccatagtgagcagtcatcccgtaggctgccctggaaagggcgcatgacactgggagtcaccagcactctcggcagctggggcaatgagcacttcatttctgaagggggattctggtagctcttcaccttacgagcagggtgagaagaaaggagccgcagattgccaatatcaggaaagcagtgggggacagtgaaaggtcttacagaccactgaaaagaaagcgagaggattttgtcgacatattcagtcctatctgcttgaaaatttagatgaacaaatcctctcacccaagcaactttttaaaatgaacacgagaaaagaaaatctgaataattttatatctattaaatgtataattagaaaaccttcctgtaaggaaaactccaggcccagatgacttcagtgcattcttctgaatatttcaggtagaaataatgctaatctgatgaaagctcttccagagaacagaaagcaaggaaacgccacccgcttgtcatgaggcaagcataactttgataccaaaatctgataaggtcattacgaaaaagtaaaatggcaggtcaatcattctcacaaacattctcacaaacataaatatctgaaacaaaatattagttaagcaaacccaagatagataaaaaggtattccaggaatatgaagttggtttaatgtgcagaaagcaatggaattcaccacactaacagaataaagaaggaagtcctgtagtaattatatcactggatgaaaaaaagggtttggtaaaatccaacacctgttcatagtggaaactacagaagctgtgaatggaaggggattccttaatcacagaggcacgaaaggaaaataaatctccccaaaatcactaagccaaaggcaaaagtcgagccgggaactgcctttcattctagtcctaaataagacagctacaaagattaataaaaagctacctacctccctcaccatttgcccgcaaggaaattccttgtggacaacggacaggcagaactcaagtcatccctctgctcacgtgagacaaatgcatatcctattgcttccccttccctatggtttcactgagccaggctaagacataagtgactattcctgtacagtgtatgttgagtgaaaggctaatcagaaactcaaaagaatgcaaccatttgtctcttatctacctatgacctggaagccctctccctgcttcgagttgtcctgcctttccagaacgaaccaatgtacaccttacatataatgactgatgtctcatgtctccctaaaatgtgtaaaaccaagctgtgccccgaccaccttgagcatgtgttatcaggacctcctgagctgggtcacaggtgtgtccttaaccttggcaaaataaactttctaaattgattgagacctttctcagacaccttttcggctacaaagggtatctacacaaaaacccctacaacaagcatcatacttaaccatgaaatagtgaatgtttctcccttgagatcagaaaacacaattcagactagaaagagaagaatccacagatggctcctggcttcaagggagagagattcttctggactttggaagggcacctgggcacgtgagtggtggagggaagtcctctagcctcagaagagggtgcagaggatttttgaaaggtggtcaggtggtgtcatcacagcagagacgaagggaatgagctctgggcagattttgaccactctctccttacccagcaaggctggccttttggagtagggagcgcctgaatcccaggatgttgttggagctcggggcctgggacagaagaggttctcagcagcgtgccttgtgtaaatggtgactctgaaatagcatagctgtccaggctgagtgggggccataagggcctgagctccaggcaaggctctgtggttgaactcagtgccgggcagtattgccacttaggtgcgtctgcagggccaggcaggtggtggcagaccaataccctacagcagctctgggtggcctcacagagcagccccacgcggggcctgagcagctcctagggcactcccacaagcccctgtggcttttgctggaacctgaggtaggcagcaggcacccagagtgatctgcatcgcatacccatgtgggtagtaccagtgggggcaaggcaactcagaggcaagtcaagcattatgcatctttaattagaatcaagagagatcggatttcgtgctgctaaattctgccagcgggggtaactgtaaaaccccatggctgcccatgagccctctgaaaccaggagaggacggaggctagcgcgggagcaatctctgccatgggacttggggtcccctttatcccctcagaggaacagcctgagtgcagccgctccatcctcagggtgtcggggacattggggccctccagctcccaaacatttgcgccatggtgaggtgacggtttgcagacagggctgcttctgcaggagcttaaactccaggagaacagggagtggtctgaatgcctgggcaccccagcacccagcagtgactgagctgtggctggaaggagagggggtggatgccgagaatcaaggacgggtgcagttcttagtcctctcctctaagttcttcagactgtgggcccgtgaacttgtgagccaaggagagtcctcgaggggacactttccttctgcctggcaccccactgtggcattttggcctccagaggagtaagagagaacggtctttctcccaggggttctcctgcccagggtttagaaaaatcaatacaattgattaaagaaagatggtggcacagggatgcttcatcttccctccttcctgacccggggacccacagcagaagctgagaagaggaagcctcccggcccctccctcaacaccagcctccccggcgggacccttgctctccagcacacgcccaggggttctggtttccactgcagcctctcttactatcccattttgtagcccgtggggatgcgccttttcataaagtttcccttacatctaaagcattacaagatcatggtagaagacatcttaaacgtggagaagccgcaagcaagctaaagaataaattcttcataatgctttttttgctatttctccttccagagatttttcctctgtgtgtgtgtgtgtgtgagtatacatagaaaatccctatgctttgctttttttttttttagaaaaatgaacttattccctacatgcggttgtatattttgcgtctttcattcaatagcatgaaaattccacattattcaatattctcaacacttttggctgcacagtattttatatttggaattattacaaccaggctagtaccctgttgttggacatttacactgaaaactattctgagaattcttttgcccttgaccctcaattattctgttctttcctatgatagttctaaaaattgtcttcttgtgaacactctgattagttcactgttttgattgtaccgtgcacccacctccacttcccaggttcaagcgattctcgtgcctcagcctcccaagtagctggaattacaggtgtgtgccaccacatccagctaatttttgtattttttgtagatttttgccatgttggccaggctggtcttgaacctctgacttcatgtgatcctcctgcctcggcctcccaaagtgctgggattacaggtataagccatttgctcagccaacagcacagatttatgattttacagtgcaacaggccgaaagacatgggtctcggtggaataaagtcaaggccttggcaggctgtgctgtctctggcggtcccggaggagaatccacgcccttgtcttttccatttctagaggcggccctcattccttggctcctggccccttcatccaccttccaagtctccctgtgcctctcgtccacagtcccatcctcttctgaccacaactgggaatggatctccaattttaaggattgcgtgattggattgtttttgcctgaaaaaatccaggatcaccaccccatctcaagctcctgaacttcaactgcgtctgcaaagcccactttgccccatggcatgacttagttactgtctctgggaataaggttgggggcagcatctttagggggccatgattccacttcccacaatgctaataactcccatttttcgagcagctgctattactgtcagtgttgaactgggcactttacagggattatctcattttaccccagccccaaatccacaaggcagatactatggttatcctcacgtggcagatgaagaaagtgaggcagagagcagtagtttagaagccaaggctagtccgcatgagtaacacaactcagcaaaaactatgagccttcttggtttgtttatttaacgacaacattgaaaccttaatatagacctggaattttctgaggaattgctgtttataaatgctgagccggccaagtctgtttttactcctcagtgtttgctaagtgtcacgaaatcctcaggtggaggctgtggggctgggcccacgtagctgcctcccaccgctgaggcaggggctcgagccgcgatttgccaaggatgacacatttctcatggaaccggacgtggttctgcgtgacttgcaggtcccagtggcacttgtggaagctgttaggttgcgtacttgggccctcgtaaaaaactttttcataaaaaaattttcaaaaaaatatttaaagaagtcctgagcgactccactcccaccttgctggcgtgaggcagtcatattcggccagagaggaggctgcttctatggaatggcatgaagcacattgccgtggccacagcacagcagagcctggaaccccgccccgggaagggactgctttctgtcctcagatgtcaagtcgccatccagcagggcaaggcaggaaacacagtagggtcaggtccttcaggggcctctgaggcaggtggactttcttttccccagaggagccacagcgaggtcccgttggcgtctctgagaggagggttgtcacatttaagcggaatgaaaacaggactcccagttaaattttttttttttttttgagacagagttttcgctcctgttgcccaggctggagtgcagtggcatgatcttggctcactgtagcctccgcttcctgggttccagtgattctcctgcctcggcctcccgagtagccgggattacaggcgcctgccaccacgcctggctaattttttttgtatttttagtagagacggggtttcgtcatgttggccaggctggttttgaactcctgacctcatgtgattcacccgcctcggcctcccaaagtgctgggattacaggcatgagccaccgcgcccagctaaatttgatgtggattgtatttcagagaaacaatgaataattttttagtgtatgtttccaaaaatgcatggcttcatatttacacaaaaaattatttgttgtttgtctgaaatttaaatttaaccaggcatcctgtattttatctggcagccctacacagcggggaagacacacacttctaattcaggcccccagttcagtgaatccaagccttgtggtttagcctccctgactcagggaaaacagttccatgccctctgtgtctcacaacattcttttgcctcttccctctttgctgccaatctaaatttgttaaggcctaactcacacctcgccttgcctcctcctccaggaagtctctcctgattgcacttcacccttttagttgaaggctgagggaggcctctggtgtttccagaactgtgcaccgtcccaggcttacttacagtctggtgaaagaggcagatgtaaacagaaatattcagagaatgtgaaaatgcattaaaagatgtagcaggatatttgggtgggaaatgaaatgattttatttatttatttatttattgagacacagtttcactcttgtcgcccaggctggtgcgctatggcgagatctcggctcactgcagcctctgcctcctgggttcaaatgattctcctgcctcagcctccgcagtagctgagattacaggctcctgccactatgcccagctaattttttgtatttttagtagagatggggtttcgccacgttggccaggctggtctcgaactcctggcctcaggcgatttgcctgcctcggcctcccaaagtgctaggattacaagtctgagcccccaagcccagctggaaatgattatttgaaaacacctgtccacttccacctttgatgtggagtgtcatccttcctttctgtgagtcagatctctacctgtttttcagggacagtaggaggaagagagaaggaacaagggattcctcagagcttctgctgtaccccccactcctctagatgctgtccctactttggctgagcatccattggtgagaatttagatacacgagggtaggtgcagtgagtcctgggggtgaaatttctctgtttaaacaagccagggaccttgcaggtgtggggaggctgcagagcggtgaggaaacttgaggagggcaaagacgatcggcagagtcacaggcttggtggccaagcaaggttcgaagcggcagagccaccagggccttggggcgtagaggggtctgggttccgggtcccaggtacgttcgtccacagcatcacccctcctctgctcacagcttcagcaaagcctgctccggagcgccggtctcctgtgcgtgaggtacctgcaataaagaaggctggatcgcactgccagggccacgtagagcaggtcctgccactgacagcaggaatcactgaatccagactaagaactggagcccttgtaagaaatcaggcaccgacaggcgtcttgagggaagagtggagacatccttgtcagcagtcctggaggaaacgtgttagtttttatccctggtcctaacttccccaggtttggaaactgaacaagactaaaattccttggggtttaaatatttgacttgacacggcttttttttttttttcctggctaggaagtatttacatttgaaagagagaattcagtctgatagcccaactactagtcatctaagaggttgccagaaaccagtgtcctagcaaatatgttgactggacaagcccaggacttacttgagaggacagagctggaattctgaggacaaccaatgacgacattgttctctatgtgcccacaggaagggcccaagtgctagcctggtgatgggcctggccgaggaggacgtgcgatctggggtcattaagagctcctcattgatcctggaaatgcagtgtgtttttaagtggattggttttaccagtgagcattagaagtgtttgaggatgctgcacatgcctgatgaacgaccgtgcccacgccgtgaaggagcagggcagaaacttccgctcaacaggatctggtgctcagacgcaggcaggacggccgtgcgtacctgaagcagcctcttggtgggaatcccaccggcaccttagtgtgggtgtcactcacttggtgtgtgtgtcactcactttgaggcctctaggattctccagaaaggtaagtacccctgcctgtgtgtccagtttctgcttcttgatcagttcatgccccctaactccgtcatctgggtttggagtggatgcctcttggagaggtcactcctgttcttagccttctcctggattctgccagtctttgggctcgtgaatagaagccaagcctcacaactacatgagagaaagcattagtcctggctggataggagtggggctcctaccagattttaagtgacgaagtcccagctattggcaaattctctttgcccgcttatgcattaaaaagctgtatccactttcatggaggaaccggtggccagatgtcttcagctttaaaaatattcctcctcccacctgtaatcacagcacttcgggaggccgaggcgagtggatcacctgaggccaggagttcgagaccagcctggccaacatggtgaaacgccgtctctactaaaatacaaaaattagccaggcgtggtggtgcgtgcccgcagtcccagctactcgagaggctgaggcaggagaatcgcttgaacccgggaggcggaggtttcagtgaacagagatcacatcactgcgctccatcctgggtgacaagagcaaaactccatctcaaaaaaaaaaaattatatatattcctcctgctgaatgttgcaatgtcacaaaaagccaacttcagggactgtcctcttgtgaccaccaaagaccgatattcttaggagagtattttctgcctgaaccttggtccctctttcgtgggtgtattagggacgctggaaagacaaattcttgaatccgcgcagagccctgcaagctgggcaggaaatggttcggatttacttcaggttcactgtggttgttatttatgcactgcaaacctccaaaaaaagttgtctggcctcgttcaaccaaccaaccagctatttttgaaaaccgcagagcaatggatgattgtgttgcacaagcttctgtggacgcagcaacaggtgggagcaaaccagggcacactaccgtcagccattgtggaagcatttcccggagcatttggattttggctacagtccaaagtcaaggacaactggaatgaagtacctcccacacttacgaaagagcacggagccaccagccaccagaaacccactctcaggcttactaagaagtctaaactggttttgcaactcttaaccagtggtccagccaatcagctgtaaagaatgtatgaagaattaagagaaatggggcaagaaggggtcttgaggggagcagtaggttgtcatgcagtgggagtgccaagaggtgtccctcgaaccaggtcacgtgatgccaagagatacccttagaaatcagggtgccgccagaggggacatgactgtgtgcccaccctgtgcaattagctgaacggtccctggtgacaatgttcctgagagatatttggtgaatgtttggaagtagaaatgagcagaaagaatgatgcctgcttctctcctagaaacctctgaggatgggagactggttggagcagccgccaagtgccaaggagagctgccaggtgcagagggaaaaggaagttgtcagtcaaggtcccagcagaaattcaccctaaatggttaaaataaagagatttataaaaattgagtttactgagacaaaatctatacaaaattacactcattctgttaaggtgtcccattcaatgagttttgcagaatatttccagtcatgtggccactaccacaaacaagatccagaacatttacatcacccccaaaaaagctctagtagacacaccaaagatttctccagaatgtccacgccatacgctgccgccggcagtgcaggggagttttggttgccccgcgtcctcaccaacactcggaatggccaccatgtttattttagccattccagtgagtgtacgaccacctttcacaggtcttcacttgtattttcctgatggccaacaaagtttaactcttttgcatatatttatgagacacatgcaggaaggtattctgatgtgttctttcgggaggtgtctattcaagtcttcagttccttgtatgttgggttgtcttttccttattgatgtgtaggagttacataaatattttgaatccaagtcctttgtcagatgtatatattgccaatagatagtgctgatatcccactctacctgttgccttttgaagaatattcctgaaggcactgcttcaggtggggtgttgagggacccaggactagcattagcagggaaccactcccactgatggatgaaggggaaacaggatgaattgttgtcatgtgagcccagtgaggactggcggtggggaggtcgggcagcccagccagggctgtggatgtgggggccacactatggccagatgcagccctgtagcagagacagggggtgaggaaggcctcagactcctctttccctccaccctccactcccctgctggaacctccattggccaagcccagaagtcatccaggaagaaagttcaaagatgcagtccctgggagtcagcctcctgggacagagaaagacaaagatgggaaggcgtggatcaggagaagggtacaacggaggatccccagaaaagaggggctgcaagagattatccaaagcatatgtctccggggttaagaaactacacagggtgcatatccccgtggggcctctgaagaagccacaaaacgcggtcctcatgagagccagcatttgggtggctgccatgtgagaactacagctgcagaactagttaagttaaaagggaaaagatttcttgcttacttcctctaatcccccatccccctgtcctgcctataagggtgagaagagagagggaaagggagaactaggaaaagaacacgtgttgccccttccctacccctggcccagacaccagcccagcctgtgctgggggctgtgggagggggagtttgacatggatgtcaagttcaaattgactctttaatacataaaagtgagtcattctcacaagaagcagcctttttcttgactaaaaatgcctgcaaacaggtgagccggctatctgagatgtcatcaaggggcagggaaagctgataggagtggtcttacctgaagccaggatgtaaggaagatcaagccatttcctgtctgcttctcactgagttcagaccttcccacagccagttttaagtcataactcaaatccctctttcttctacaagcacaaggctacgtagctttcatgcattgtcttagtaaccctcatgaccactctacagttcagtactgttactatccctgctttacagatgaggaaattaaggcagacagaggttaagtgacttgtccaagtccacaccaacctgctgtcaagtccagcaaacctgattctagagcctaagctaaaggctctgtgcacactccccatgcctcacacagcagctgagagtgtagagttgtgacgttgtctatctggttaggaacctcagaggcagggctggttcccagagtccattcaggctggtgggcagctaagaagtgggggattgcagggcatcaaccaccgctgattgagggttggaggggaccccacatccccagctaagaagtgggggattgcagggcatcaaccacagctgattgagggttggaggagaccccacatccccagggggattggaggaagaccagggcctcctcatgcaacccacattatagcagcaaaacccctcctgcagttcatgttgccacctctggcttccaggtggagcagggactggtccagggaaccctcgcagatcccccctgtgggttgcacagtcacatccacagaagcccagtctggagagttctgcatgtggcttaccaggtatcagggacttccggggccaagactgggaagagttggggtgcagctcccagtggccggtgctcagggaagtcacgcagggaagtcctgggaggcctaggctgcctcatggagaagctgcatggatgtgcagggcacaggcgcacaaagttctggggcctgggagaaaagaggaaggaatcattaccacatgttcaggctgcagaggctccgtagcagaggaatagggagaagcaaccagtaacggaggtgggagccggaaaggtaccaggtgtaagctgggggacaagggagcaggcggacaacaaaggcaatatcttggggaggcaagaggcagaggaggtttgaattttgcccccgcctgtgatgggctgccgggtggactccgccgtcctggagctccatgcaggggccagcgctcatgtcctgagagtgcgggcggctcacagcacagaggacttgcactgtgcgatcgcacctcagcggtggccgtgcaagaatggcctcatctcttaggttagctcctgagagggcctcacttcctccacccacggaagccagagctcagctaaatcagcgaggttccttacccctgtgctgccgtccacccagagggccccgttttggacatgtatcatctgggtttgaatgcagcccagaacccagtcccaactcagcctcaccttcataggcaatcaggttgtctctgggaagcccaggcctcccagaacttccctgagcactggccgctgggtgctgcaccccaactcttcccagtcttggccccagaagtccctgataccggcaagccacacacagagccctccagaccagggcttgtcttggggtaagattgtgtacaccacagggaacccgccaatccataacacataacaggcccctgtcctgttcacaaagatgtgtaacttggtaaaacaccatgcagaagtaaaaatgcactattgcggtgatgtggccatgagtccagtagggaaatcattttccacgctcttcctctgtggacaccatctcctcgaatgtgactggggattggaagctacagcttctagagtccacaggtctttcttttttgctggcaaattcggacaacatctactctgctacaggcttcagcccatctcctatttgccagaattcacctcaagaaatcaagaacaaagcgtcatctctcacttcaaaacgttcttggaggcacgtggtttccgggccaatggcccacggagcaacaagcccgagtctgactgtgacggtatcaccgtggtgcagacctcacccatgagtctccatctgcgagaaagacacagggcggcggtgggaaacacaaagaggacaggaaagacctgcgccggaaagggatggaagagcaggctccgagcctgatgcacaggacaacggctgcatttcaacaaggaaggacacctcctgctccattctccactcctcctcctgcaggggcagggatcccacttccaccagcgcccaggtcctcctcgccaccctggtgtgatgccagcaccctctatggggggtcctcctatggtgccagtgacaggcccacctcctcctgagggtgatgccatgggacctgctcctggaatgaggccacccatgggatgtcacatgccagtgttacccaggcccccaggatgagcccgcccacccatcgcatggtggagcccacgcagcccagaataactaagccagacagattagaatagtggagagacctcgtcatatcagctttttgctatttgttcttctccaggagaccatggtgctgtgacgctgggtgtttccttagcagcataaggaagacctgctcccccttcctaccagagaatagttttggaggggagaagtgagaccaaaaaagtacagttttcatctgtattgtgaaatgtgaacataaaattgccaactctttcagttttttaaaaaaaaaaagtcttggaaaagcaaataaaaaccacaatgagataccacttcacatccaccaggatggctataattttaaaaacgaaaagtaagtgttgacaaggttgtggagaaattggaaccctcgtacatcgctggcagaaatgtgaaatggctcagccactgtggaaaatagtatggcggttcctcaaaaagttaaatatagagttcccatatgtcacagcaattccactgctaggaatgtactccaaagaattgaaaacagatactcacacatgtaccccatgctcatagcagcactaattccaacagccaacatgtggagtcaacccaaatgtctatcatgaatggttaagcaaatgtgatttatccatacagtggaatattactcagccttaaaaaggagtgaagcacttgtacatgctccagtatgcagggactgtggaaacatgatgccaagtgagagaagccaggcataaatggttacatactgcagtattccacttataggacatgctcaaaataggtaaatccatagagacaacaacttagtctttgcccaggatggagggaaaggggaatgggaagccacagcttaccaggtacagagtttccttttgggtgatgaaaatctgggcttagatagaggcgacggctgcaccatatcgtgcagttaccaaatgctactaattgttcacattaaaatggttaattttacgttctgtgaatttcaagctttcaagtactggggttgaatctggagacgcaaggtcacttggaatctctaagtgttattttcttagcctttcctctttttttttttttttttcttgagacggaatttcgctcttgttgccaaggctggagtgcaatggcacgatctcggctcactgcaacctccgcctcccgggctcaagagattctcctgcctcagcctcctgagtagctgggattacaggtgcacaccaccacgcccagctaatttttgtatttttagcagagatagggtttcaccgcgttggccaggctgatctcaaactcctgacctcaggtgatccacccgcctcggcctcccaaagtgctgggattacagacgtgagccaccgcgcccagccagcctttccttttgagatataaactggttgcgggattagagtcaatcattgctgtttttccaatgggttgttgtatatagataatctgggatattttattaaaaactcagggttataaaacttgcatagaaagattctataattattaggcctggaacaaaaaaagaggcttggtgtcccagtggaatgctgagtggccaaggggagcactaccagtggctacaaaaaggccatctggaggccaggatcagttctgtctgaccgtaggtgctgagggtatgggacggctggaaaggaggtttctctagaggacaccagtgtccagacaaggttctggaggatctgaaggagcacgctggtgcctttgctcctgtaggatgctgtggagaaggatccctgtatcttatgtataggttccatgatctctagaagcaccattgcaagcccattttacaaatagggaagacaggagtgaggggcttgcccagggccacttggctggatactcacccaggccaagcttgcccagccctgacaattcactgtcaccaccctttactcctgatgaccacagcccagaaggacagggattgtgtaacattctaagaaaatcatgctgccatgcaggaaggagacagacctagactcagccaatagcagctgaggggtaaagttgcttcaaaagaattcttggcttcttggtattatttggtttgcccagagactccacaccccacttttttttttttttttttttttttttttgagacagagtttcactctgtcaccaggctggagtgctgtggtgtgatctcagttcactgcaacctccaactccctggttcaagcgattctcctgcctcgacctcccaaagtgctgggattacaggcatgagccaccacgcccggtctccacacctcacttctaccctctgctactctcctgtttggaacgttggtttcttctgtttccaatggttatcatacggatggctatttgataagtcccagttccaacccatcactctcccaaggaggttggaactgggacttagacccctgtgggacctggattctaacatgtaaaactctagtgctcccggaagctgtgttactccaaggcagcagccaggcagagagaggcagaggaaacaaggaggtagagatgacgtcctcacctccccacagtgcccagtgcccagctctgcccctaaggcccagccccacactgcccacagattctgaggggtcctccaggatgctgctatgtcatgccccacagactggtaccctcacaacctacccagtgtcttcccgggaatctagaggatgggaagcctcagtctgcatttcccagactcccttgcagagaaggtttcacatgtgacctgggtcccaccaggcagagacacctgcagacttgggagttggaaatgagcaccccagggtggtggcaacactcagggagatcagactttcagcaagtagaatggcccaggtgcttggctgttctgagtagctggggtagagggtctatcatcccaaacctaagctatgggcagcagcagtggcagtggagttttcagaagagtcctgtgatctaggcatgtatttctcctggctctaaggtctaagcttgggtctttgacctgcccagaaattaacaaaccacatgacaggctgtaataaattcctttctcttaaataaactggagtggattctgtagtctgcgcctaagaatcctaatttatacacctgccaataataaattcatcttgttgataattcgacttgggtgtctgtcacttgcaagcaatgtagttgtaatacaatagccaagtaatcatccaaactggataaaaaaactttaaaatggataaaaaatgtctttatccgaataacagacgtctccatttgcaggcagctatgactgtaccctctacattgagacatcaagacataataaatttcattttatagcttggaaatgcatgaatataacaagttaactgacttgtggggaacactgaatagctggaatttcatctaataagagatttaaaattaaaatattttaaataaaaatgttcacccttattgggtcactggttccaatattctcacttcagtcctgaagacacagaggcctggggtgttgctcaaatgcacacagagtccataacaggattagaactattagaagccctacgctaagcttaatatctaggcaatgaaatactccgtacaacaaattcctgtgacacgagtttacctgtgtaacaaaccttcacccgtaccgccgaacctaaaatgaaagttacagaaaataaagtaagaaatgaaaaaaagtaaagaacgagaagccctatcactgaaccctacactggtctctccaccacagcacagtgcctccggaggcaaagatttcagagctcttgacttggccagaaaatgcagaggaggaaaaaaagtcagggcccatcacatattttgtacttgtgaccatgctcatggaattagaagtcagaacagtggagctgtgaatgatgcatcgggctgagttctcacttgtaattcctcttctgtggggagctggcaattcagagggggagagcgtgagttcacggtctgttccacccctcacccgttgccagcaatccccacactggaggagctggacctgggttcctcatgcagtcctccacgtggactggggactaatgcgtctaacagaagtttccgccaaaagaggttttgcttcttcccccaaagcatgtgctccaatacaggttttattttatttaaacaaagcatgcgaagagtctgtagcaattgtgttagatagagatgctcctaatggctgggaagggtgctgctgagatggacaggctgactggaatcatggatttgccttcccgtggtgctctgtgaagtcgtgcagacgcagaggagagaagtgtgttgctgggcacccgccagggtgttggaatgaagctcttgagtttctccatcaacctagctggcagtgactgttaccaacagtcaagagaagcccagacaacagagtgcccgcggggacccacatgcaggggtctccttgggctgcctcaccatcaggggttggatgtcagggcatggccatgatgtgaaaatttaagagcttttagtacttacaagctctggggggtacatgacacacctggaggccacacacacccacacacagaaggaggtcagcgagtgcaggcagagagagatcagggacccatgggccaatgtctttatggggttcagggcgctacccaaataggcttcccaagggagctttagttggtgggttagcaggcaggcacagttccagaaggttacaccgtgacccagaagtgatcactttaagtccaggggcaagtgtctgaatcctttaaaggaagaggggaccccagcctgtcaagagggagaaatgcctctgttttatctctggccacacactggagccattccaatgaggtatagtattgaaaaccgtatcaaggtgactgagccctgcttctggtatagaaaagttaaatttatatttttttaaaattttaaattaatttttttttaattttagaggcgcgatctcactctgttgcacaggctggagctcagtggtgcaacccttgctcaccgcagccctgaactcctgggctcaagtgagtctcctgcctcaggctcccgagtaactgggactacagggtgccccaccgcacccagctgtttttttgtagagacggggcggtgggggggtgggtgtctcgctttgggctggtcttgaactcctggtctcaagggatcctcctgccttggcctcccaaagtgctgggattacaggtgtgagccaccatgcctggcttaaacttgtattttaaaaatagatgccaaggctaaaattataagcagtcactacacagggccttacaggaccctgagtataaacaaagtcagcaaccagcttagaaagtgggtccattctttgcacaaacgctcctgaaggtcctctcggaagaggggcaaagggttcgctggagtagaagagaggggaaacaatcacttttgtcctgggcaaatcactgaaaaacaagaagagctgctccttatcggatgtgtcttctggagatagatggcatcgcatagagtcaaccaaacgggaaatgaatcagtgcttgaaataacagtgactgcaaaagatttttcttaattcccttcagactcaagaacagtaacaatgtcagtgtccgggagatgcaagtcctctgtcacatactgaggaatcacatctcattcaacagcctgttacaggggtctgggaattggatgtgggatctcacgccttattgtgatccttaaccacctatttatctttgccagaaagacctagggttgcagaaatgaagagctttgctttgaatgtcctttctcaaatggatgctggtagcgctgtaggaccatttttcaaaaatgaaaatctgggaagtcatactgcctcatttgagcttcttcccctcctgggagggggtcctttcccagttggattggaccatctgcagccagcaggctgggaacgtgcttatgtgtccagaccagggcaggagggctggggcatggaggggagccaccaaagggaaaagccactacacaggccaccaggaaagtgtcccgatgatctctggcaatgattaatgtagtttctaagggcagggcgggcctgaggtgcgatccaggaggaggagcgtacaatcacagatttgttgcaggaagaacaaaagaagaaaaggcagaacaaaaagggcagaaaagcaactatgagaggcagagaagatctgccgtgggggaaaggagccttgatgtccatgagctcactaccgggaggccagcacggaggcctcaggacagaaaggctggcaaagtacgctccttgaatcgggtagttactgagcaaacttagaacctacagagagaagcctcggcaagataggggaaggctgtcacctgggctgggagcgggcagggtggaagggccactcctggctcccaggttgctcagcgttcacacatctaccccggccgcatcagcctccctgctggccgcatggttaggaggaccacagttgaagtgaggtagaacaatttccacctcataagtctgtgctcaaactatcaaccaaacgtaagggtataataaagatatttgcaaatattcatgtccccaacgttctctgtcatgcatcctttctcacaaggcaactggaggatatggcttatcaaaagtaaagagcgatataagccgaagagcattgaaaacatatgtccacataaaaagttccacaaattttgtaacagcatcatgcgtaatagccccaaagaagaaacaacccaaatgtctatccactgataaatgggtaaataaaatgtagtacatcgacacaatggaacaaagtagtggtacatgctacaacataaagaaccctgaaaacattacgctgagtgaaagaagccagccacaaacggaaagtgactgctaatgggtgcaggatttctttctgggagaagtaaaatgttttggtactacatggtggcacaactctgtgaatataatgaaactactgaattatacactttgaagaggtgaattttataatatgtaacttatgcttcaattaaatgagttttctatttcaattttagttaaaaataaatatgtaaattgagaaagtcaaattttggagggtcttcaacataagagacaggcaaagggaatgcccaggataataggaacatcccaggacagctgtgcagcagtcttggaaagtaacacttcaagattagaacagaagatcgaggattctgagaaagatgtctccaattcaaaaatgagttggtgttgatgagtttgaaaatattcaaaataattttataatacaatcagtttggtgacaaattagtgattagtacatagaaaactaaacagaaggaaaatgagaaaaactattaaatctagaaaagacaaaaagctaaacaagaaagaaattataactagagtacactatatgactcagctgtgattaatagctgcacagtcataatgtaaacacaaatacatacagaactaaaaactgagatacaatattggcaagagaggaagtctatgggtgtttgtgcacaggaggtaaaatgcattatcagtagataatatctaaaatcaaaaagtcaaaaatatcagtatagtcaaatatagtacatagaaatatggatataaaagccagaaaataaaaagcagctaaagcagttaaaagcattcatctcagaggggtaaatattagaagtttcatggatgaggcaggaaaagactgtttttattattcacctaagtaaactacttgatttttaaaaatacgtagatgatattattagaaatttgaattttatttcgtgtcatgtaagagaatgtgtactgtctactgaaagaatcgaaggttctctcattctcatattttctctctacctctctttaaccaagttcatgcacagtaagttctcgatgtcgtggataggttcttggaaactgtgacttcaagtgaaagaaaaacaagtttcccaaaggctggttgatatatacaagagttaggcctctatgtatatttctggccacaaaaacattacaaacttctaaacaaagaccaaaattcttccactataaaacactgaaataactgtgagctatacatccatttaagatagattaataaaaacaggcaaggtaattatttacccaattattccagatcagggtggtgggtgaccggagcctgttctgacagctcaaggccaaggtggaaaccagtcccggacgggacaccatcccatcgcagggtgcactcacacgcgcccacgctcactcgcactgggaccatttagacaagatgatcacctcacatgcacgactttggggtgtgggcgggaggaaaccagagcacctgggaaacccatgcagacctggggagaacgtgcaaactccacacagacggggtccccaccctggctgggaagccacgtttttgcccatcaatattataaggaaacaacattgaacaaaacgttattcgaggacctgctgtatgatacttttcaaaaaatgatacaagaaaatttcctaaagttaaagaagataattatttaggttgaaatggactactatatccctcaattttacatagctggttattatcacacatatctttaaagcccagttcagcaaaactaaattaaaaggcctaatggcgtgtttttttttttttctcttgaagggtctgccaacattttcacactaaagcagtttaactgtaagcaacacagagaaaacgcacacctctgacccttaaggttgtgcgcacgactgaggtttctccttctagggcaccagatggcacggatgcattgtgggggttgatttcaatgtgtgtggttcaatcttcggcaccatttctccaaattacccagtggccaagcttttagcatatgaacagaaaaacactagcaagccaggcgcagtggctcacacctgtaatcccagcactttgggaggctgaggcaggcggatcacctgaggtcaggagttcaagaccagcctggccaacatggggaacccccttctcaacaaaaacgcaaaaattagccaggcatgatggcgggtgccagtaatcccagctactcaggaggctgaggcaggaggatcgcttgaacccgggaggtggaggttgcagtgaactgagatcatgccattgcactccagcctgggcgacagggtgagacgccgtctcaaaatgaaaaaaaaaaaaagaaaaacactagcaatgagacttggtgtgctaatcatggatagttaagacttgtggatgtcaaagttctgctctgcaaagttttttttttatgttctgcatagtttgaaaatttatgttctgcatagtttgaaaacagtaaagtttatccactgggcaaatgccatactcatttcctgttaagagtacagagggtagattggaagaatagtgatacactttctaatgcattggttctggctctccattatctatgtatgtatgtatctatctatgtatgtatctgtcatctatctatctgcctacctgtctgtctttctctatatatatatcctcactcccaaggaaaccaaagatatatctgttgatcacatcattgtttaaagaagcaaaactaaaggaaaatgcttgtaaacattttgaattgctttgcatagttttgagataattggtgtcagaattttgactttctatatttgaaagaatgaaataaaaattttaaaaaaattaaaaagcagaaacggcctactaccgaacagccattcctccctcctcctttggaacagaacctgattgctttaggtcttcatgttcctggtgcagccccagccccagagcctggacctgtgttggtctacatccaccatgatcattctaatcagaagcctaggaagaggcatgtggcccagttctggctgattagatattagaaaagtctcccaggagagggtctgtgatggatttcttggttctcgaaataagacacaaggaaaagatagttccctcttctgctctggacactgcatggccagaatgtgtttcctgaactcaccacagccctccgcagctagctgacatgctgaagttggcagacagagacaatagggaaaagatgagacttgatggcaaggccctgggactgctttactttgggaattcttattatatgaaccaataagcctccatatgatttaagttgccatgaattggctgtttgattacttgcagctgaaagcatcctgaatgacagagatccacatctaaactcacaggatgaattttcagaatagccaggataaatctgaaaaaaaagaagaaaatcctaaaaagtgtccagaggggaaaaagacggatggtcctcaaaggaatgagaatgagataagccggaggctgagaacatcactagattcttgaataccatggagcagagctttcagagactgaaggaaaatggcttcaacataatggtccagcccaagtgaccttccagtgtgaggactcaccacagaagtttttggatatgagggaatttaaaaagttaactgctcatgcatttttttgggaggaagtaactaaagagcatactccagcaaagtaaggaaatgaaccaagaaaagggacaagaaagactctagaaaacaatagttttgaaccccaaagagccaccagaagacccaggactgcatttgaatagcaagcctggatattaaccattccactggagtgggaggtcagaaggctctggaaggaaggacctgtgagaaatgggctccttagagaacagcgtgcttgagacactgcaggaacctgaagtcacgacaaaggcaagcaacgtaagagggagaaatgaaaagcaaagggatgcagagtcgtgtatgatgcacctggtccaaattagtccaggatttggataggattcaagaataagaatgaaacagaccctgagcaattagaattttaggaagcaggaagctaggaggcatttgttgggtaaggtgaaagtttcttctatccaaaagaaaaacaagctgaacgtacaagatataatccagatttgcagcaaaccaaaatgtatcttgattttgagcaattgacagtgtgaaacaatcaattggaaatattttcctttcatgactcaaggacactgtcagttgaaccacacagaagggtatgtcattccagagcgtggcttgactcagcagtgaatagaatttgcagtgaaatcatgtcaacgttatattgcttgtctcttggcttttacctttgagaatcaacctacaaataaattccatatcaatattcatacattgataaatgttatccatcttaacaacatagaaatgtgttgacagaaactgggaagcagaactgggatgagtagaggcaataatgtcctcattccaccgagcaagaagcaagagacagagaccgcagttgctacagcaagaatgagcagagataagatgtttatgtcatttaaatatctcctgatttcagtggtaatgcttacaaagttccaccagtaaatatcatgtttcctgtggcttgtttgtttgtttgtttctttcaggcagagtctcactctgtcacccaggctggagcacagtggtgctctctgggctcactgcaacctctacctcctggttcaagcaattctcctgcctctgcctcctgagtagctcaagcaattctcctgcctcagcttcccgagtagctgggactacaggtgcctgccaccatggctggctaatttttgtattttttgtagagatggggtttctccatgttggccaggttggtctcgaattcctagcctcaagtgatctgcccgcctcggcctcccaaagtgttgggattacaggtatgagccactgcacccagcccctctggcttgatttttaaaaattttttttatctctgggacattttagttctacagaaaaaattaagcaaaaagagagagttctcacccctcgctaatttccccaatttttaacatcctgcattaatgaaggtttttttttttttttttgtttgtttgtttgtttgttttttacaaagggtgagccaatattgacactgtggattgtttctttaggttgagaaagtttccatacattattaggtttttgagtattttgatcagcctgggtgttaggtttttaaacttaagaaatgtatcaagatgaatatatttccccttaatatgctagcgaagtatgttaatagttttcaatgttgaataataacagtaaaaaataggattaatcagtagtgttcggatgttttggaggaaaaaataacttagatatatacctcacacaccacacccaaaagcaaattccaggtagactaaagatctacatgtaaaaatccaaaccatgaatgagtcagaggaaaatatagaagaatgtttttacaatcttgggatgggaaggccttactaaccaagataaaaggaaaagacgaggagattttattacataaaaatgtaaaatatgtttcctgcaccccatcccaccccccaagctgccactaacaaaaaggaaaaagataaaaagatcagtggggccaggcgcagtggctcacgcctgtaatgccagcactttgggaggccaaatcgggcagatcacaaggtcaggagattgagactatcctggctaacacagtgaaaccccatgtctactaaaaatataaaaaattagctgggcgcggtggcaggcgcctgtagttacagctactcaggaggctgaggcaggagaatggcgtgaacctggaggcggagctggcagtgagccgagatcgcaccactgtactccagcctgggggacagagcgagactccatctcaaaaaaaccaaaacaaaacaaaacaaaaatcagtggtagcctggggttgggggaggaagggatgaacaggtagagcacagaggattttgaggacagtgagactattctgtatgatactataatgatggatacatgtcgacattatgtgtttgtccaaacccatagaatgtacaatactggccaggcatagtggctcatgcctgtaatcccaacactttgggaggctgaggtggctggatcacttgaggtcaggagtttgagaccagcctggtcaacatgggaaaaccccatctctactaaaaattcaaaaattagcggggcattgtggcgcacgcctgtaatcccactactcgggaggctgaggcaggagaaccacttgaacccaggaggtggaggttgcaatgagctgagatcgtgtcattgcactccagcctaagggacagagcgagtgacactgtctcaaaaaaagagaatgtacaacaccaaggtgaactccagggtaaatgatggactcgggctgataatgctgcctcagtgcaggttcatcaattgttacaaacggaccactctgctggtggatgttggtaataggggaggctgtgcctgtagtgggagagggtgtatgagaaatctctgcaccttctgctcaattttgctgtaaacctaaaaccgctctaaaaaatagtttatttttaaaaagctaaaggacaggctgagataaaatattcaccatacatagtagacttaggattagcatgcataatatataaagaggctctgcatattggcaaaacaagaaacaacttattagaaaatggatgaaggatagaaacaggcaattcaccaaagaattccaactgcttgtaaatacgtgaaaagatgctcaatatcaaaatgtaagcaaaacactgagagacctatcagaatgctaaaaattaaatgggtggtatgtctagaaggcaacagaaaagggtgaatagtcagggagagtccacctcagaaaaccagggatgctgagggcttgccttgctgctccttgaggtcagtgctggctgtgaagggtgaggagcaggtctgtgtggttctgagtcttcccagcaaggaagacaggcgttaagctccaggtggtgggatcacagctgagcccaccatggcagctgagggtgacctagcattggtcacggatggatgacgtccatccatcagggtggatgacaaaggttggttaggacaatgggccccagcccttcccagcagcctcctctcacagcctggtccttctccctctctgcccccaccccatggcccttgccatcccttctggaggcagggaaccccacactccagctgtgtcccggctctctgcatccctggcccaccccatccccaacctccaccagagcagcatcagatggaggaaaagaaaaggggcaagaggaaagagggatgggaaaggaactccaatatcatttctttcctccgcattttgtcctgctaaagacagttttttaaaaaaataattaaatctgccgatataagttcattgggaaaaaaattaaggacaaatggaaaatgatggaccagtttaataatctgtggttaatcatattagcccagcaagtaacacaaccttgatttcattttatttggaggcttttggggttggaaatatgggtggttaggcttatccctagccccaaagctaactttttttttttttttttttttttgagagggagtctagctctgtcgcccaggctggagtgcagtggcagatcttgactcactgcaaaacgctctgcctcctgagttcaagagattctcctgcctcagccttttgagtagccagcattacaggtgcccgccaccgtgcttggctagtttttgcattttcagtagtgactgggtttcaccatattagccaggctggtctcgaactcctgacctcagatgatccacctgcctcttcctcccaaagtgctgggattacaggtgtgagccaccatgcctggcccagagctaatttttaatccagcaatgaggagggacaggtaaggatcaccccagggacagaggacgccatttgccagggacatcacttgcctccattctctggctcctacctctagctgcatcttcggggggcccggacccactctcctcactccctgcccctcttcaggtccttccatgagccctttctcttgccctgaacatgtcctgtttggtgataaataatctcccttccatccttaatcttttctcctgtcttcttctacctgttggtctaaaccagcctgatgtctccccagggtctccgtgctgggcagccttcttaaatggatatgttgcctccccgagtcccaggggcagaagcggggtccacatgtcttggagctgtgtgcagaacattgtttcacagtcacctctccaggctgtcctccatggacgtctacactatccattggtccgccctctccccgtcagcatcactgaggcacctctagacccagtccagttcttcctcacacagcacccttcagagtcccaagtcccctgggatgtgtctccccctcaagtccggtgacttctcctgcactattctcacgtggccccgtgatgctcagagctcactgcagtcccagaaaccaccctcagaggtgtatgtagaaacagggtaactgaaggcttgggtgtgcacaaagtcacctgggctggaggcacaggccctcagtgtggctttggaactggtcctcacactgcagaactggagctgcatctctgacatgacccagaagtggggagggggcggaggatcagcggcgggctccccatgcacagcctctctgcggaggaggctcaactgcctctcatgcccaggacgctggtccctcagtcgtgatccacaccagccacacagacgccctctgcctgcctcccacaggcatgacactgttgcctccaccgctgcagaaaaccaagtgccttcgccaccatctctgtggtcagagcagaatgaaagcaatcggagcaagacctcagcctcacctccctgtccaggtgacatgcatctggctgtcaggcccttactgacagcccagaggcaagtggttctgagaaacgtgggcttgaactttccagccccccagaggatatccccaaggatgctggagtggaggggcggtggtccaacatctgccacactcaccgcagtgcccacccctgccaggactcactcctttgaacccataaataactttgatcatatctcccaggaacgtgtatatatgtatatgtgtgtggggtacatatgtgtgtgcatgtgtgtccccttgtgtagagggtctgtgtgactgtgccaggggggagagagagacacacacacgcagtgatagagagagacagagagagagagaaagacaaagagcccacaaaggggctgtgcgtggggagccagcagctgaccccctgcccccctccccacttcttgatcatggttttaacctccttgaaggcaggagatagggatggactcacttccctgcacagagcaggaggctcagttccgtttgctgaatggcgcggctggaagtgctctgggggaaggaaatcaaagaatataaggaaacacaaagtggggaagggaactgactttcacagacagctgcatggcagttcatttagatggggtcaggttttggccatcaaaaaaagctaggaaaaaccttcctttcagagctctttgaccttcggaatcagagaaaagggattgtcagacgttgctgttttgagttatttctggtttcccacttaattctcacaggtctcaaggttgagcaactcattttataggagagaaaacggaggctgggccagaaggactgtcctgggattgtcgtggcaggtgtgggctgaatggaatggctaagcctcttccaacactgttcaaacacccctctgtggaggaagaactgggagtcgggggccagtgctgctgtcccggggaactccgaacatacaccccagatttgtattcaagactcatttgtcactcatgactcatttccaagtgatggaattccaactcacaatagcttataagtttaggggcaggtgggggacttattgctttgagtcatggggacttccaggaaagcacagcgcttcaggcatagctggacccagggggtgggcagcctgttgcccagcagctccaatgaaggcaatgactggcccagcttcgatggtctctccccatcccaaggagggtcaaattatctgactggctggatctgagtcacgtctcaaactctgtcaccagaggtggggtcagtgccaactaaaaggaaggagggttagcctcctaaagacagctggccagacaaaagacataccggcaaggccacaccacgcactcactaacttgagccccaacttggcctgacccccgcaaaggagagagggattctttctgagaccaaaaaccctttcccaggtggagcactcctctctagcagccatttctctccttaaccggaacatcacactcggcacgtctgcaagggcatattaaagtataaaagccacagaaacaaaattgaaaataaaatttatgaccctttttcgagccaatatcctaaagctgaccaagatagccaaccagatgtggtcccgtaaattgcgggagaagtgtaacgggcacttctatgaaagcacacacatagagggggactctgctcatttcctaggtccccggggaatggatgaagaatgtctcaaagatctcgcttcagacagagagaagaggtgcacttgccaacaatcagctcatctcttccttatttctgctaaactcgtcaaagctcgtctgtttcagctcctcgggccacctcagcaggactgttattgctacagaaaagttctgatacggcctgagaacttctgtttctctggcttagagatgtaggtggaggggcaaatatctgagtccgattctggtcaaggatgtgccattctttttcttcccttttaagtcttttatttgcatctattttatgctgaacttcttcccacgccgtaaatgtttgtttcttcagattcttctgggatacattttcttctgtgcaacctccttttctggcttgggaacaaattttctttttttcttcagcaaggatcacctcatgggagttcatgtatgggttaatcccaccgtgagttctgtaaatatggtggtgccaatatcttgggtactttgttcacctagacatgttcgttgaccagagaatttacatctaaacccttaagttcagcattactctctgcatttttaagcaggtgtggcaaaaattccatactcttttggatccttggtatctaatatcttgggtactttgttcacctagagatgttcattgaccagagaatttatatctaaacccttaagttcagcattactctctgcatttttaagcaactgtggcaaaaattccacactcttttggagccactgaccctgcatccagccctactgttggcctgggcacacctctcaactccaccatcataagacagaatgacacacattgcttcggttaagatacacctttcagacacttggtggctttccagatacacacacctgtcatggtctaggagtgttcttaaagtgaacacaaagatttaaaactcttgatgtgcatgattttgtgggggttttctgcgtcaagtgaacagtaaaccactttcacaggtcaccagagaccgcttataggcagagctcccattctctttagatgtaaccttctcctctggttggatggaacaggggccatggtaaaagttgcccacaagacccagaaatgcgtgcgtgagtgcatgcgcgcgcgcgcgcgcacacacacacacacacacacacacacacacccatggagagcctctccaacagagcagagggaagacaggacagactcttcacatggaaggctcagaacattccacagggcagtggccaactttccactatagcaggcctgtttcatgtccagctaacacctcttctctatcgtttcttgctaagagaatagtgtctgacgacaatgtgctcaggaacgaggagtgaattatgagtccctccaccagtgagttgaggggtaagggtagaggtgagcatgtgaccagttctggccaatgaaacacaaggataagtcttctaggaaattatggattcattttttaccctgattagagaggggcaagggggaaaatgttccatttttgctgtctccttttctccagctttgtgtgcatggcgtcaggcagtgctgcttcaagctgctgcaactatcagaccagagaatcccaaaaaagccaacttagaacgaaggatccactgtgaaactgcccacctctctgcttcctgataggttagataatagtacttgcatcatatgagatagtgttatattctgttacttgctgctcagaggtaccaacagctatactcatggttgcttctctgacttgagacagaactgggataagacgtcacaccagtgcccatcctacttacttggaattccactttagaaggctttccacacctgtttggagcattcaccatgtaactgatacatgccttgggctcacatctccacttccatccagacatgttagggataattcttgtggcagtcaccatggccttgtgtctaacactatttagcacaactacataattttgcatttcttttgctttttttaaaaattaaactttttattttgagctaatcataggttcttctgcagctgtaagaaataatatagaaagatacaatgaacgctttacccagtttcccccagtggtagcatcttgcaaaactatagtacaatatcacaaccaggaaattgatattgataaagtcaagatacagaacatttccatctgcacaggagtcctccatgttttacttttacagccacatatacttccctccagcccccacccccgccacactcagtccttaaaccctggcaattgctaattcattatatgttctccattcccataattttatcatttcaaggctgttacatagatagactcatacagtaggtaaccttttgggtttttttcagtcagcataatattcatcctggatattcatcctagtttttacatgtatcagcagttcactcctttttatttctgagtagtattgcatagtatgactgtaccacaatttgtctaaccattcactcactgaagaacacctgggtagtttccagttgaggctgttatgaataatgaaggtatgaacattcatgtacaaattattgtgtaaacataagtcttgatttctccaggataaatacccagaaacacagttgctgggttgtacggtagttgcacacttattttcttaagaaactgacaaactgttttccagagtgactataccagtttatactttcaccatctatgtataagtaatccagtttccctgcatccctagcaacatttggcattgtctcttttattttagccattctgataggtgtgcaatgatacctcattttggtttcaatttgcatttccctgatggctaatgatgttgaacatctttttatatgcttatttgccacctgtatatcttctttggtgaaatgtctgttcatgtcttttgcccattttctaattagggctttttttcttttttatttctctttcttttttttttttttaactgttgagcttcagaagttctttgtatataataaatactagtcccttgtcacttatgtggttagcaatattttctcctggcctgtagcagcttttcaactcttaacagggccttttgtaaggcaaaaggttttatcttttttttttttctttaagttctgggatacatgtgctgaacgtgcaggtttgttacataggtatacatgtgtcatggtgatttgctgcacctatcaacccgtcatctaggttttaagccccatgtgcactaggtatttgtcctagtgctctccctccccttgtccccgacccccaacgggccccagtgtgtgatcttgccctccctgtgtccaggtgttctaattgttcaactcccacttatgagtgagaacatgtggtgtttggtttcctgttcatgtattagtttgctgaggatgatggtttccagcatcatccatgtccctgcaaaggatattaactctttcttttttatggctgcatagtattccatggtgtatatgtgccacatttaggttttatctttttattaagtttaatttatcaatttttcctttatggttcgtgtctttgatgttaagttgaagaactctttgccagactctatatcctgagccaggcatggtagatagagcctgcagtcctgactgttcagaaggttgaggcaggaggattgcttgattgaggctgcagcaagccatgatcataccaccacactccagcctgggtgacagagtgagactttgcctcaaaaaaaaaaaaaaaagttttgcatccccaagatgttttcctatgatattttttctaaaagttttagttctacatttataactatcattcattccaacttattttcttgtataaatgagaggtctaactcaagattccatgtttttttaatgggtgcctactttatccagcaccatttatcaaaaaggctatcctccctccattgaatttttttttagagacaggttctcactctgtcatagctcactgcagcctcaaactcctgggctcaagcagtcctccagcctcagcctcccaagttgctgagattatagccatgggccactgagcccagccctctattgaattcttttgcatctttatccaaaatcagttgggcatatttgtgttggtctatttctggatttctctatttgattccatcaaactatgtgtgtatctctccatcaataccgtagagttttgttactgtatgttttaaagttgagtagaccaattcctccaattcattcatccttaaaattgtttcaactcttctagttccttcgcctttccttataaattttagaatatttatatctatgtatatatttattttttcaaaaaccttgctgagattttgatagaaattacatttagccaataaataatttggagagcataggcatctttactacattgagtcttccaatccatgaacttagtatgtcccttgatttaattagagcttctctgaattctatcatgagtattttgtagtttttagcatacaagtcctgtaagcattttatgacatttatgcctatttctttgtcttttttttagtgatcataaatagcactgtattttaagtttcagcatccacatgtattaatagtataaagaaataaaattgatttttgtatgttgttcatctttctatgtccttgataaatgcacttattagttctattttttttgtatatttcttgggattttctgtatagacaatcatatatgcaaataggaacatttttagctcctttttgatttgtatacattttatttccttttattaccttattgtaatggctaggacttccctactatgttgaataaaagtaagagtggatattttcaccttattcccaaacttagaggggaactattcagtgttattattattattcaactaagcattaagtataattttagctgtaaggggttttttttggtacatggtctttctccaatagagaaagttccttctattcttagttttctgtaagttttttttttaatcatgaaaaggtgttgatttttgtcaaatgctttttctgtaccagttgatacgattatgtgattttttttcttcagcctgttaatatggtggattacattaaataacttttgaatattgaaccaacctagcatccttggagtaagtccaacttgctcatgatttagattttttttctatattgataaattctatttgctaagagtttgttaagaatttttgtatctatattaaagcgggatgttaatctttagttttccctttttttaattgtctgtctggctttggtattagggtaatagcagctttatgaatcagtggagatgtgttccttccttttctatatttggaaagagatcatatagaattggttttaaatattatttaaatgtttggaaaacaatcttcagtgaaaccatgtgtgtctggagatttctttcttgggaatttttaatttaaaaattcaatttcctgacttttggttaccagtgcaacatctaaagagcttgaaagttgttattcccatctccacagcaaacaaaccaatgaaaacaccaaacaacctgaaaatcaacaattcttcttagatccatcagggaattgaagccacaggacaaactgccactttgaaaattacagtgacagatgggtattgaaatttatagctgaaatcaccttcctttccccgccagaaccttctaagaacacttaaagggtagctgactaagattgactgtagaccagcttgagagctaaactcctagaacctggcttagtgggccccacattctcatgagttttacttctaggagacataccagattctcaccagaaagattggagaaaatcccaaaatatttggtgattaaacaaattataaataatacatgggccaaacaagcctgaagagaaatattaaaatattttggactaaatgaaaataaaaacacaacttatcaaaattcacaggatgaagcaaaagtagttcttgggggaaatttatggtattaaatgcattatcagaaaaaagaaagatctaaaatcaataatctaaacttttaccatggggaattagtaaaagaagagcaaattaaatttaaagtaaaaataataaaagaaataataattagagcagaaattagtgaaattgcaaacaggaaaaaatagagaaaatcgacaaaatcaaagctgatttttttcaagatcaataaaattgataagactctaaccagggtaaccacaaaaaacacatcagcaatgaataataggaatgaataatatcagaaatgaaagagggatcatcactacagagcccatggacactaaaaggataataaaggaatattatgaacaactctatttaacttagatagaatggaccaagtacatgaaagatataatctatcaaaactcacgcagccaggcacggtggttcacttctgtaatcccagcaattagggagggtgaggtgggcggatccactgaggtcaggagttcaagaccagcctggccaacatggtgaaactccatctttactaaaaatacaaaaattagccaggcgtggtggtgtgcacctgtaatcccagctactcgggaggctgaggcacaagaatctcttgaacctgggaggtggaggttgcagtgagctgagatcaagattgtgccattgcactccagccttggcaacagagtgagactccatctcaaaacaaacaaacaaacaaacaaacaaacaacaaaaacacgaaaaaccaaccaaacaaaaaaactctcacaaggagaaaagtctaaataggcctatatctgcttaaaaaatggaattagtaactaatgacttttcaaaactgaaagtaccaggtccaggtggtttaatagatgagttctgccaaatatttgaggaagaaaagatttctataatctcttccctaaaatagagggagaaggaatacttcctactcattctatgtggacaacattatcatcataaccaaaacaacaaaagacatcacaagaaagaaaaactacagatcaatatcttacatgaacatagatgcaaaatcctcaaaaaatattagcaaatagaatccaacaatgtagaaaaaagtacatatattacaacacaattaaaaatgctcagcaggcctggtgtggtggcttacacctgtaatcctagcactttgggaggctgaggcgggtggatcacctgaagtcaggagttcaagaccagcctgaccaatatgataaaaccccatctctactaaaaatacaaaaataagccaggtgtggtggcatgtgactgtagtcccagctacttgggaggctgagagaggagaactgcttgaacctggtaggtggaggttgcagtgagctgagattgcaccactgcactccagcctaggtgacagagtgagactctgtaaaacaacaaaaacaaaacaaaacaaaactcacaaatgaggaggaatagagagagatgaacttccccaacttgataaggaacatattcaaaaagactacagctaatatcatacttaatggtgagaaactagatgcttttcttctatgattagaaaaagacaaggatgtcttttttttacaactgctatttaccattgcactggaagtcctaagtaatgcatgcaataagactttaaaaacagaatgaagataaactgattgggaaaggaagaaataaaactctctttgttcacagatgatatgattgtttatatagaagacttccaagaataatcacaaccacaatattcctggaactaataaatgattacagcaagatacaaagttaatatacaaaattcaaaaaagtattgtcctacatttcatcaaagaataattggaatttgagattaaaaactcaccatttatattagcaccaaaaatgaaattcttaggtataaatttaacataatatgaataatatctatatgagaaaaactacaaagttttgatgaaagaaatcaaagaatagtaaataaatggagagatattccatgtccatggatagaaagacttgatattgttaagatgctagttcttcctaactaaactttatctatagatttaatgcaatcccaatgaaaatcccagcaagttattttgcagaaatagacaaaactgatcctgaagtttatttggaggccaggagcggtggttcatgcctgtaatcccagcactttgggaggctgaggtgggtggatcacctgaggtcaggagttttagaccagcctggccaacatagtgaaaccccgtctctaccaaaaatacaaaaaaattagccaggcatggtggtgagtgcctctaatcccagctactcaggaggctgaggcaggagaattgctagaacccaggaggcggaggctgcagtgagccaagatcacgccattgcactccagcctgggcaaaaagagttaacctccatctcaaaaataaataaataataaaggttatagggaaaggcaaaagatgtggaataggcaacacaatattgaagaaaaaaaaaagtcagagaattgacactatccaacttcaaaatttactaaaaaagtacagcagtcaagatggtatgatatggataaaataataggcaagcagatgaataaaacaaaatatataactcagaaataaattcaacggaaatagttggaaatacattcaactgatctttggcaaagaggatcaaaggtaattcaatggagaaagggcaatcttttcaacaaattatgctggaaaaaactggggacacacacaaaatgaatctagacagagatcttacactctgtctaacacgctgttttagcttaaacaaaagctaactcaaaatggacgagcaaaactatataatttttagaataaacatagtagaaaatctaggtgactgggtttggcagtgactttttagatataacaccaaaagcacaatccatgaaagaaaagatttataaaattgatttctttaaaatttgaaacttgtgttctgcaaatggcactgtgaagaacataaaaatacaagccacagacagtgaaagctgataaatgacatgcatccaaaataaacacacaaacaaaaaaaattaaaattcaacaataagagaacaaacaactcattcaaaaagtgggcaaaaactctgaacagacacctcaccaaagatggtatacaaacaacaaatacgcgtatgaaaacatgctcaacatcatatgtcattagggaattgcaaattcaaacaataatggggtaccagtaatcagtaatttggccagaatccaaaatactgacaacagcaaatactggcaaggatatggagcaatgggaactctcactcattgctggtggaaatacaaaaaggcacaaattcggaagacaatatggcagtttcttacaaagctaaacatagtcttactatacaatcccacaatcatgctctctagtatttacccaaatgaattaaacattttgtctatacaaaaacctgcccacagatgtttataccagctttattcatacttgccaaaatttggaaacagatgtccttcggtaggtgaatggataaactgtggtacatctacacaatgtaatattaacgcagcattaaaaagaagtgagctattaagccatgaaaagacatggaagagacaaaatgatgcatattaccaactgaaagaagccagtctgaaagggctacacactgtatgatttcaactgcatagcattctggaaaaggcagaacaatggagagagttgttaccagggggccaaaaaatatatatattgaataggtggagtacaaaatttttagagcagtaaaactgttttctatggtaacggaacggtgcatatatgtcattacacatttgtcaagatccatacatgtagaataccaacagtgaattttaatatgaaatatggacttttagtaataatgatgtctcagtgtaggttcattgattgtaacaaacctactattttgatgggtaaggggaggagacggtcacagcagaggaggctgtggatgtgttatgagacagtaaatatacgaactctctgtacttgctactcaattttgctatgaacataaacctgctctaaaaacttgtcgattaatttttttttaaaagtcagtttcttaatagttacagagctattcaaattatctaattaatattgggtgaatcgctatagctggtacatttcaaagaattggtctatttcatcttagttgtcaagtttgtgtgtgtaggattgtttgtaatattcttttatttttattttgatatctgcagtctgtactgatatctactctttgattggtattgattgattttctatagattggtattgattgatattggtaatttgtctcttcccttgttagtcttgttagagatgtgccaattttattgatctttatttcatctttttggattaattttattgattattcagttgtttatttgaaaaaaatctatttattgtttttttcaaagaaccaacttttggtttattcgatttttctctgtatttttctgtcctcacgtttatttatttctgctcttatctttattatttccttacttttacatgctttggctttattttgctttttttttctagcttttgaagtgagagcttagattattttaagacatttcctcatttctaaaggaagcattttgtgtttatatatttgcctgctagttatttagctgcatcccacaaattttaatatgtcgtattttcatttcattcagttcattgtttttgggttttgtttaaattttccctggtagcttcctctttgatccaaggattatttgaaagtatgttgttcaatttctgagtatttagacattttcacactatctttccgttattgatttctagtttgattccactgtgcttgaaaaaaacaccctgtattatttcaatcttttatttactaagtttttattttaataggccagaatatgatctatgtggctatatgttctgtgggcactagaacgatatgtattatgctgttgctgggtagagcgttctgcaaatgttagagatcctgtcagttgatggtgttgttgagttcttccatgtctttgctaattttttctctagttgttctatcaattgttgagaaaggggtattgaaatctccaaatataattgtgggtgtgtgtgtttctcccttagttctatcagtttttatttcacatatttttgcagctcttttgtttggtacatgcacatttaggattgccatgtcttcttgttggattaacccttttataactgtaatttccctgtctgtctttggtaattttattttctctaaagtctactttctttgctatcaacatagccacgcctggtgtcttttgttgatattgcatgcaatatctttttccactcttttactttcaacctacctgtatcattaatttgaagtgaatttctttttgagaacatgttattgagtcatgttttctcatacattctgccaatttgtttcctaatcaatcatcacatcatctacatttgacctaagtattgatatgttggggtttttatttttcatttcctgttacttctgttttactttctctgttttcttttatttcaaaaggctttgggggaacagatagtgtatgattacatgaataagttttgttttttttttttttttttgagacaaagtcttgctctgtccccaggctggagtgcagtggcgtgatctcggctcactgcaagctccgcctcccgggttcaagcgattctcctgcctcagcctcccgagtagctgggactacaggcgcccgccaccacgcccggctaatgttttgtatttttagtagagacggggtttcaccgtgttagccaggatggtctcgacctcctgacctcgtgatctgccctcctcggcctcccaaagtgctgcgattataggcgtgaaccaccacgccaggccatgaataagttctttaggggtgatctgtgatttctgagattttggtgcacccatcacctgagcagtgtacactgtacccaatgtgtagtcttttacccctcagcccctcccactctttcccccaaatccccaaattccactgtatcattcttatgtctttgtgtccccatagcttagctcccacttgtgagtgagaacatacaatatttggttttccattcctgagttacttcactcagaataatggcctgcccttccatccaggttgctgcaaatgctgagcatgtctatggctgagtggtattctatggcatatacataccacatcttctttatccacctgttgactgatggacatttgggctgattccagatttttgcaattacaaattgtgctgctataaacatacgtgtgcaagtgtctttttcgtataatgacttcttttcctctgggtagatacccaggagtgggattgctggatcaaacagtagatctacgttggttcttaaggaattgccacgctgttttccacagtggttgtactagtttatgttctgaccaacagtgtaaaaatgtccccttttcaccacatccacaccaacatctatcactttatgatttttgattatggccattcttgcaggagtaaggatgacattgcggttttgatttgcatttccctgataattagtcatgttgagcattttttcatatgtttgttggccattcgtatatcttcttttgaaaattgtctgttcatgtccttaacccacttttcgatgggactgttggtttttttcttgctgatttgtttgagttccttatagattctggatattagtcctttgtcaaatgtatggattgtgaagactttctcccactctgcgtgttgtctgtttactctgctgattatttctttcactgtgcagaagctttttagtttaattaagtcccatctatttatctttgtttttgttgtgtttgcttttgggttcttggtcatgaactctttgcctaagccaatgtctagaagggtttttctggtgtgatcttctagaatttttatggtttcaggtcttagatctaagtctttgacccatcttgagttgatttttgtataaggtgagagatgtggatccagttgcattcttttacatgtggcttgccaattatcccagcaccatttgttgaatgaggtgttctttccccactttatgtttttgtttgctttctcaaaaattagataactgtaagtatttggctttatttctgtgtgctctattcagttccactgatctatatgcctgtttttataccagtaccatgccattttggtgactatggccttatagtatagtttgaagtcaagtagtgtgatgcctccagatttattctttttgctaagtcttgctttggctatgcaggctcttttttttttttggttccatatgaattttaggattttttttttctagttctgtgaagaatgatggtggtattttgataggaattgcattgaatttataggttgctttttgcagtatggttattttcacaatattgattctacccacccatgagcatagaatgtgttttcatttgtttatgtcttccatgatttctttcagcagtgttttgtagttttccctgtagaggtctttcacttccttggttaagtatagtcccaagttttgttttgttttgttttgttttgcagctactgtaaaaggggttgagttcttaatttgactctcagcttggttgctgttggtgtatagcagggctactgatttgtgcaccttaattttgtatcctgaaactttgctgaattcatttaccacttctaggagctttttggatgagtctttagggttttctaggtatacaattatgtcatcagcaaatagtgacagtttgacttcctctttactgatttggatgccctttatttctttctcttgtctgattgctctggctaggatttccagtactatgttgaatagaagtggtgaaagtgggcatcctcgtcttgttccacttctcatggggaatgctttcaaatttcccccttcagtataatgttggctgtgggtttgtcatagatggcttttattaccttagggtatatcccttctatgccgattttgctgagggttttaaccaaaagggatgctggattttgtcaaatgctttttctgtgtctcttgagtgactatgtgcttattatttttaattctgtttatgtggtgtattacatttactgacttgtggatattaaaccatccctgtatccctcctgtaaaacccactttgtcatggtggactctttttcatatgctgttggattcagttaactagaattttgttgaggatttttgcatctatgttcatcaggggtatttgtctgtagttatttttttttgttatgtcttttcctgattttggtattagtgtgatattggcttcatagaatgtttttggaggattccctctttctctatctttggtatactctcaatagaattggtaccaattctttgaatatctgattgatagaattcaaccgtgaatctgtctggtcctggacttttttttttggcaactttttaatcaccatttcaatctcactgcttgttatttgtctgttcagagcttctgtttcttcctggtttaatctaggagggttgtatatttccaggaatttactcatcttctctaggttttctagtttacacacataaagatgtttatagtagccttgaatgatcttttgcatttctgtggggtcagttgtaatatctccccttatatttctaattgggcttatttggaatataagtcctcttctctcttcttttcttggttaatatcactaatggtctatcaattttatttatcttttcaaagaaccagatttttgtttcattttttttattgtgttgtttgtttcaatttcatttagttctgctctgatcttgattatttattttcttctgctgggtttgggtttggtttgttcttgtttctcttgctcctcgaagtgtgaccttagattgtttattcgtgctctttcatgctttttgatgtaggcatttaatgctatgaactttcgtcttagcactgcctttgctgtatcccaaatgttttgataggttgtgtcactattatcactcagttcaaagagcttttaaatttccatcttgatatcattgttgacccaatgatcattcaggagcaggttgtttaatttccatgtatttgcatgattttgagggtattaaaatataaggtactattctattcatcatgctatttgttgcctgaataccttgtttttttttttttcattgtgtcattgttttataggtcctgtgagatttatgctttaaggagattctattttggtgtattttgaggatttgtttcaagatttagagctccttttagcagttcttgtagtgcaggcttggtagtggtgaattctctcagcatttgtttgtctgaaaaagactgtatcttttcttcatttacaaagcttagttacatcagatacaaaattcttggctgataatttttttgtttaaggaggctaaagataggaccccaatcccttctagtttgtagggtttttgctgagaaatctgatagattttcctttatagattacctgatgcttttgcctcacagctcttaagattgttttcctttatcttgactttagagaacctgatgactatgtgcctaggccagtatcaccctaataccaaaatcaggaccagacataacaacaacaacaacaaaactacagaccaatatccctgatgaacatagatggaaaaatcctcaacaaaatactagttaactgaatccaacagcatatcgaaaagataatccaccatgatcaagagttgcaggatggtttaatctgatgatctttttgtgatgaatttcccaggcattttttgagcttcttctatttggatgtctagatctccagcaaggctggggaagttttcctctattccctcaaatatgttttccaaacttgtagatttcccttcttcctctggaacaccaattattcttaggtttggtcatttaacataacgccaaacttcttggagcccttgattatttttttaaattcttttgtctttgtctttgccagattgggttaatttgaaagccttgtgctctggctctgaagttctttcttctacttgttcagctcccttgttgagactttctagtgcattttgcagttctctaagtttgtcctttatttccagagttgtgattgttttttatttgtgctatttcactggacatttttccattcatattcagtatctttttttgatttctttaagttggacttcatctttctctggtgccaccttgattggcttaatggttgaccttctaaattctttttctggcaattcagagatttcatgttggtttggacccattgctggtaagctagtgtgatcttttgggggtgttgaagaaccttgttttgtcatagtataagaattgtttttctggttccttctcatttgggtggactatattgggagaagatctgggactcaagggccactgttcagattagtttgtcccatggggtgctcccttaatgtgctgctttccccttttccctagaaatgaggcttcctgagagccaaactgcagtgcttgttatttccttctgaatctagccacctggaagagctactgggctctggtctggtactggggagtgtctgcagagtcctgtgatgtgatccatcttcaggtctctcagtcacggataccagcacctgctctgatggaggtagcagaggagtgaagaagactctgtgagggtccttgtttgtatttttattaagtgcactggttttgtgatggttggcctcctgccaggaggcggtgctttcaagatcgcatcagctacagcagtacagggaggatcaggaggtgggtggggccatagagctcccaagatatattatgtcctctgtctttggagttcctctgctgtcccacagagccttcggctgcaatccatctccttcaaagggtctgtggattatctcagctctcctggaatgttcctgcagtagttcttcgagtcaaagttcacgatgtgggtctccacacactgctgtgtccatccaagtgggagctgcaagttagtcctgcctcctatctgccattttccctcccagatccccagtgtctctgctttcattttcctgctttctagtgagttaagcaaacattttttagacttatatttttatttacctatagtgtttttaagtgaatcttttttttcctctattttagtgaatatctgtatggttttttaagtggttgttttcggtattaaattatatatacataacttattattctactgatgtcaacattttgccaatttgaatgaagtatattaatcttaccttcccttacatctctctgtcctataccacttatagtataagtaactatttcttctatagcacatttaagacttcatcaatgatgttataatttttatttcaactctcaaacataatttagaaaactcaagatgtgaagaaaaatgtagtatatttaacctcgatctccactcattccattgttccttcttctttcctgatgttctaagatttcgtcttttatcactttctttgtttgagattttcctttagccactctcttatggtaggtctcctggcaacaaattttctcggttctcatttatttgataatgacttgattcccccctaattccttaagggtattttctctagatatagaattttgggttggggcctaagagatcaaaatagatgcccctttatcaactaagatggaccccaaggttaaggtgagttaccttcaggtcgagggtaaaaggctcagctggcatgggaactttctcaattcatgcaaccacaagaaaatcactcttgctaaactccctaacaataggagctatggggcaaattctcaggcccttcttaactctgatttacaatccagaccactacaactttgaatggacagaagactggccttacacacattatttcctgataagcaactgcagaccttaagcccatttcagcagcttatagagactgcatacaaatggtgtttgctccctatacttcacctttggatgtaaagagccaaattccaccctattttaatgctaaaagcctgccccaaagtgaacatgggatatatattacatatgtgtttacctattgcacatgtgcccaacttccctcattaatatgaacggcttttcccctaaatctgctgaatatgtttgactctattgtgtgatacaggctctgtaagacataaaacctaaccttcccttttcctcttcaaagagagagcaccttcagtccacaccagagactgtctcttcccagtttacaaattggtatcgccaataaagctgtcctttctaccatgtatagccatcctgggtggtctttgcatgacagcgttggcagttcttttctttcggcacttgttaaatgttgtgccacttccttctagctagcctccatggtttctaatgagaagtgttcttttttagattgttttttttctctatagataagatgtttttctcttgctgctttcaagctttttttctttgtctttagtgttcacaagtttgattatgatgcatcttggcatggatttcctttaatttattcgttttggagctccctcagctttttgaatctgtattttgccaagtttctgtcttttgccaagtttgggttttttttttttttcagcagttatttcttcaagtgcttattaagctacacccctttccctttctttctgggattctgataacacaaatgttagatcttctattacacagtcctccaggtcactgaaacgatgcttacttttttgcagtcgactttgtccctgtggtttggatttgggtaatttccattgttctgtcttcaggttcaccggttttcttcttctggaccctccattctgctgttgaccccatccactgagctttttattcccaatgccctatttttaagttcttttttttcttccatttttttcttcatgtcttttctttcttgagattttccatttcttactgagactttttcagttttcactcatttcaaatgtgtttgtaattgctcattgaagcatttttatcatggctgcttgaaaaatctttgtcggataattctaacatctctgtcatctcagtgttagtgtctattgctttttttttcatttaagttgagattttccaggttcttcatataacaagtgattttcacctggaacccagacactttgagtattatgttatgagggcttgaatcttatttaaaccttctgttttagctggctttctctgacactactgcaaatgaagagaagtcactgccttgttattgtcaagcgcagattcccttctggcctccattgacactgagaagggaaaagactccttgttactgctgggcagtggtgggaattccagctgcctactagccctggctgggaggggcaggagtgtttcaccactgttctccacgtggcctctgctgacactgcaggtgggagggggtgcctcataactgcttagcatagatgaaagccccagcttcctgcacagccgtctctgacacctctgcctcacgggagctggagcaccttgctctgcagcctgatgagggtggaagtctaggctcacccattcagcatgggtggaaggtgccaaggtttttctgtagagtttggctggagcagcagtcatggactaaacgttttctgtccttctaggcttcccctttcctggtcctttgattaaagagagaaggcttttgttgtttttgttgttgttgttgtctgtagccattggtgtttccagtttgcctgcttcttcaagctccacgtctgagacatgtgatacaaaaggagagcccagggaactcatcatagtcattccctgggtcctgaggtccctggtccattgccttcttccctcaatcttttggagtcttcttatgctgcttttattaataataacccatgtttttcattgcacttagcaaaaggagtagggatagtatgtctatgccatcttcctggaccatttggattttcaggtgtgaattttcctgtatctacccaggattgggtacctaagttgatttatcacactacaaagaggctgctctttaaatatattgcagatctccacgaccacattatattgctttgcttctgaggagaaattgcagggcagaaactatccaaattttactttagagttaggatacagcaccatgacataaaacccatgaaaacataagacaacttactgagaatttcagggtactaaatcaactctttgtggtttgattcttacacaagtctcagaacaaattgctgtattaaatattattattatcattattattttggagatagaggtagaattacagtgatgctgatcatgtttcagaaccccccactttcatgggcctttccgaatccctagttcacatggttacacgttatacaatctacaagaataacggattttatttgtagttggttgtgactactttttgttgccattctgatatcctctctgtcatatgtcccctcttgttgggtaacttttgaagtgactatgtacagttggggcattcattaaggggaagggagcaggggatacatttaattcgggtttaatgagatgtgtttatgtgattcatactcatttccatctatagttaaattattggaagttatctggtataaaaatgtttcaaaatttccttactgcccactgtgttgacttgctgggcaatgtagcaagaaaatattgatgactaattggataacaaatattatcagttcaaagtttatttcaggctgggcgcggtggctcacacctgtaatcccagcactttgggaggctgaggcaggccgactgcctgagctcaggagttcgagaccaccctgggcaacatggtgaaaccccatctctactaaaatacaaaaaattagctgggcatggtggcgcgcatctgtaatcacagctacgtgggaggctgaggcgggagaatcacttgagcccgggaggcggaggttgcagtgagctgagatcacgccactgcactccagcccgggtgacagagtgagactgtctcaaaacaaaaaacaaaaaacaaaaaacaaaaacaaacaaacaaacaaaaaacatatatttcagattggccattgctcaagtgtcctgaaatctcacagctcagatatctcagaaactggataaagatttctctaaatttgaaataatacaaaactttacatgacattttgttaatgacaaggtatgaagctgaaaagttttctaaactatcaataaaaaaaaatcaaattttaggccaggcatggtgcctcacgcctggaatccaagcactttgggaggctgaggcaggtggatcacctgaggtcaggagttcgagaccagcctggctaacatggtaaaaccccatttctactaaaaatataaaaaattagccaggcatggtggcatacgcccataatctcagctacttgggaggctgaggcaggagaatcatttgaacccaggaggcggaggctgcagtgggccaagatcatgccattgcactccagcctgggcaacaagagtaaaactccatctcaaaatcaatcaatctatcaatcaatcaaattttaatgaatagtgttaaaggaaagcctcatttatcttttaattctctctatagaaaatgccattgcaaaatattgtcaaaagcataagaaagaagtgtcctagaggtatgttaaagtagaaaattaatttttaaaattttataagatatttgaggtttaaaatttataatttcttgtgatttattttctcattaaatattcacctttgtatatagttttgtttgtaaaactttatattcttttactttgtaggatctttcaacgatagaagcattgggccccacacagctggatctgctcatgtggaggcctttctttgggtccgtagacatccatggcactggccaggggcctggttggaaccaacagaagccaatcaatttggtttcagcaggaagggatttattgattagtttgagaaatctcacagttctgtcggggaggattgaaggactcagctctgggctgtgcctcgaaccacagaatggcaaagctggccttactgccctcaaggccaccctgcctccaccatgctgttcctgcatcctccacatggatgcccaccctgtgtggtgcgtcccggaccccattctgagccacagactcacatggtgtctgatgggcaggtgccaaatcaggctgggaaaagatgtcagtgtgaaaggcagggttgacaaagtggggggttgggaaaacgtctagaacacttgtaaaaagatgataggcctccctactgaccaatgtccactacacctactacataacaaggatcctctgagttccaagcacagacaggtaaggaaggcagagtcccgacttccagaatgcccaggagcatgggtcagacagagtggtacccagacaccccaaaggagagcgtaagggttccagccacaggcgccatactcagactgtgacttatgggaagggaggaccatggattggtgattttccagctgattgatcacgagagagtagagtcaagggttggcctctctggcaccagagcagaccatctccagcttagagttactgttgctgctgtggctactgcctcgggaattctcagtttctggtaaatgttacattccatcacatttgcaaaaaagaagagagatttaaaaacctaaaaatataatatataccaaacagcctcttcttccctcacccacataggcacagaatataaattaaggtgttctttcagagtttctaaatttgtatgtatctacaggatcaaaaaatgaaaggataactaaaattttatttcaaaaatacaatctcctagcagttgaaacataaaacatttgttaggaacgttccttctgtaatgcaggatggggagagaatgcataaaatagtaatgattatttcaaatataaagaccacgaagacagaaataggtagaaagatgctgctgacccaacttgatattgaaaccattttccctggtgctgggatatcatctgctttggaaaagggccaaagaaagtggcattacgttccataatatacatgacaggccctggatgcttatcatgtctgttgtttggaaattaaaagtctaggtgtttctgagacattctgatttttcaatcagtcacacccattggcccctaaggcacctgccagattccaggttcagatatttggtctggaaaatgtgatcactataacttagaggtaagcaagaagacaatggatttactgagttattactctacaccagaccccaagcattgcttttcatgaggcatctcactccctcctctttgccccactgggaggtggctacaatgacaacctggcttcccatttcagtgaagagacagacaccatcagaaagtgcttctgcaagccccctctaccccttctatgccggctcatcttcccacccatccttcccacctaaagccagccctctgcctatgcaccagacattggcttctgcctactcaaggatgtgtccagcagggcttgcttctctcgcctgcattgttcatttcccctttgcaggatcattcccatcagatgcatggatgaaacctagatgccccttcccccagtcctctccggctactgcttctcgttcccctttacagcataactgaggaacatgaaggagcattattctcccagtcctctcctccagcataaactgagcccacactagtcagcttccctcaccctcctcatcccatggaaatagctctagtcaaagtcactacatgcccctccactgccactcctaatgtcaactctcagtccttatctcacatgactcattggcaccatgggaaccagttggtctctgcctcctacttaaagcactttccccaggaggctcccaggaccatgtactcttccagctctcttccagacccacatccattcctcaggctccttagtcttttctcctcagctcccaggcctcttgatgtcattgcaccctggctcaagttggccattttctcccctcaattgcagtacccctgaggctttccatccaccatggcagtgagcttggaagtgtgttctccccaggcaagccttcagatgagactgcagcccccgccgacactttgattgcagccttgacaggtgagagaccttgagtcagaagcagcaagcaaagccatacccagattctcacccagaaaaactgagagataataaatgtttgtgtttttaaagttttagagtaatttgttgcatagcaatagataatacattcttctatgacctacgctttgccctgtttaagcttcgaagctttcccaattctagccttctggcatctagaggataaatctgtgccttcctcagtaggttcccagaatataagagaagtttgattttagaaagatgataatttcttctggctgagtgtggtgttttatgcctgtaatcccagcactttgggaggctgaggcagaataactgcttgagaccaggagttcaagaccagcgtgggcaacatagcaagatcctatctcaaaaaaaaaaaaaactaaaaaattaggcatggtagtgtccacctgtagtcccagctattcaggagacagagacatggggatcatatgagcctaacagttcaaagctgcagtgagctatgatcaagccactgcactccagcatgggcaatagagcaagacccagtctctataattttttttttttaaaagaaaggtgatcattttatataagcaattttctccatgtgttatgttattaaagatttaaactggactcagagttcagcagaggggaagaatcagtgtccactaatgtcctgttttctcttcctgcatgatttgcggcaactttgaaaactccctttttctttgtgtgccaaaaagtctggcttctcagcctcattcccaagcggccttctctgggttatggaaggaatccacttgcctctggaggagggctacgcaaagatgtccacctcctcacatatcttgtaggaccatggcatgaggcagagccctggccaagtactccacgaaccagatccagctgaagtaattattgcattccaagatccaaagtgtatccagccatgggaacaaaagcttcatcttatgttccagtgggactggctgcttgcagtgctctgcggagaaggatgtaaaggccaagttcacactctgtgggaaagaatgccatggtcagtgatcagctagtgatgtctgtcatgatcacagggatgggaagtggaggcaggctttccactgatgatgctccctccattccttacaaaatctttcccccttgtcctgaaggccttttgaataagctctgcatccagttgtgtctaggtacttttaaaaacagaaagggcacaatcggaaatggcagcccaaggcccacccaaccccaggttaggtcccattgatcttgtcaactgttcattcaagaaaagaaaggcggctgagcgtggtggctcatgcctgtaatcccagcgctttgggaggctgaggtgggcagaccacctgagatcaggagtttgagaccagcctggccaacatagggaaaccccgtctttactaaaaaaaaataaaataaaaaaatcagctgggtgtggtggtatagacctgtaatcccagctactcaggaagctgaggcatgagaattgcttgaacctgtgaggcagaggttgcagtgagccgagatggtgccactgtgttctagcctgggcaacagagtgagactccatctcaaaaaaaaaaaaaaaaaaaaaaaaaaggaaaagaaaggaaaggcaggccagacgagaggtccaggaagtcaggcaggaagctgcaggtttgtgttgggtgggaacatgggggtgatagtaacccggcatagggcagccacaggcagtgaagacagagggaacaacaaccccccatcgatggattgtactgggaagaaatgcagaaaactcacagcctcatcttccgctgaaacacaggcatcctcggaggtggttgatccagatccatttaaccatctgtggatggaggtagctgaccacggtgggtgacaggctcaccatagagctcgggactgcaaggtccaccctcaggtgcaaagagcactttaccttttcgggggccttaggctccctctacctccctactggaaataagtattaagcagtggtgggctgataaatgctcaacagctggccctctggagggaaagattgtgtgtgtgtgtgtgtgtgtgtgtgtgtgtgtgtgtgtgtgtgtgtggggtgtacatacacatataaatgaagagataatttattataaatgttactgatataaagaatgtacaacaaaacataatgatacaatatcctttattataagctgcatatagttggttgatcctcacagaatgcctttgttgagtttttccaaactcttgtatctacagcctatgtctgtttgcatatgatgactaagtgtgctttacacatgagggttggctattttcatttcgtttcattctcatgaggctgatattttcatttatgttaacaagtaaaagtgagacaatgaaggcgaatatcagaagttcacttattcatcaatgtcacaagtgacttccttgctgaatcaatcaggccacagtttttaagcactggaagaataaatcctcaatttttttgcttgtcacaatataggggtgcatcagtgtagtaggttaaataatggccctcaaataatatacgcagatctgaatctatgaagcctgcaaatgtatcttatgtggcaaaagggactttgcagatgtgattgagttgaggatcttgagaaggagacattatcctggattacatgggtgggtcccaaatgcaatcacaaatgtcctgataagagaggatagagggaaatctgacatagaagagaaggccatgagaagacagcgtggagagaattttgaagacgctaagccactgcctttgaaggcggaggaaggggccacgagccaaggaatgcagctctagaagctggaaaaggcaaggaaacagacccccctggagcctctggagggagcggccctcatggcaccctgattccatcctgctgaaactgatttgggacttctgacctccaaaactgtaagagaacaaatgtgccttgttgtaagcaccaggtttttggtaatttgttacagcagccacaggaaactcacacaggcagtttttaatctattgcatctcagctctgaatgcacctttcaatatgtgctttaggacaaagattggaaccttttaaccattttgaatttaaagtgaacaggatgtgaagctttctcagtagacggtgctggaaggactttcctgtaatttccaggaaggtcagccaagcggagactatcccgtggagtcggacggagcctcagagccagaacacaatgactctgtggccatgcctggcggtgactgtctacacagcagctggcctccgacctcactacgcagcctgccacttcctctgcaacctctccacccgccaagcaacctcagcacccagaaggccttctgccctgggggcactcagtttcccactgcagttcacgcctttggttactaatcacctgttccctgcctgccctccagagggtgcctattgtgtgtccaccaactccaaaccagctgtagctgtgtgctctgggctaaacttcattgctatccagtggctgaaccacaccctctccagctatgtctgaaccccaaacaacttcatttttactttgggagctccctcagccctaggatactgcatagagcttctttttatcttactctttttttttgagacagagtcttgctctgttgcccaggctggagtgcaggggtatgatctcggctcactgcaacctctgcctcctgggttcaagcgattctcctgcctcaccctcccgagtagctgggattacaggcacctgccaccaggcctggctaatttttgtatttttagtacagatggggtttcactgtgttggtcagcctggtctcgaactcctgacctcatgattcgcccacctcggcctcccaaagtgctaggattacaggcataagccaccgcgcccggcctatcttactgttttacaactgttaataattttaacttaaatttcccctgtttaacctgctgtgtgatttctgtctcccgattagagccagactgctacaaatggccccagacatgacccacttataagttgaatctgtactattaacaattttttattactttcttaagcctagaaaatcaacaaaacaataacacaagctctgatttgcagtgtttgccaacttccatggtgtaaatactcctatcatggccaatcccaagctttcaatgtgacgtcacagattgtgggcttgggaagagatgcccagtagctgtcactatatactcttcccacggcattgatataatagatgcaagtaaccctcaaagcatagaaaatagcaaaagtagtaaaactcattgggaaggggtgtttgttaacatatttgattataagttcatatgattaattgtgaataatgcctatatttacaactggctcacaaaatctgagcacatttaacgcttggttctattgaatgttacaagccagctccagcacagcactgggattaagggcccccagcaacaaaccagggggagctccgcattctttgggcaattgctggccccctctggcatcaagacaggtctccggttcagcctgtggcattgagatggggcggtggaggggggacagaggagagggtgcaggcaagagtttctctgttgcaggattcactcaggacctcccattgctcctgttttctgccctgacgttgatgccccttcatgtcctggcccgaggatggaggcagcagccttcccctggaccctttccggcacggtcagacctgccgtttgccatgcatctgagagtccttgaggtcatggcagccgctcttttgcccccacttgaggtcattgaaggagagtgagggaatggctgtaggtatggtggtcagcgagtcaggagtctagtcccgaccttactcctggctggtggaaagactgggggccagtcggtcacgctcccaggcctgaggccccacctgtgcggtgagggtgggcctgatgccactctgaggactgatgaccctgaggcttcttccagctccaggatgaagtcctgcctcacgtccaccttaatggcaggcacagtgatgccacctcccaggatctggcagctgcaggggcatcagcaggtgctgcggtcctgctgggatagcctatccctgggaactggccccagacgctgatctcaggacctgccatcagatagctcagccttcgccaagagaaaacaaaatgcaggcaggtcatctgatcttccttttccactttcccagggaccaactagcctttataataaaacccagaggagacagtcccttcccagagataaaacccttcccaagccgtccctgctactagggcaacgctgggcgctgcgcggctggcagggagccccaagagctctctgccaagggggctgggctggtggggccgaggtcccagaggctgcctgcccagagcctgtgctaatgagggaagagggctacactccgctttggagcacctctcaacagaggggacaccttggggtcgggggtcagcatgacggatgtcttcaaggttcagtgtgcagacaggaccaacctctcccacaagcaagatgctaagggaagaccccagaaacagcaagtgcaggacatgtgagtatgggggtgatgcagagagcctcacagtacccaaggacagggtcggaaagacctgaggtgagtggaccgccctggcctgggaggcagcctgtagactgtggggccagtgacggtcccctcctcccaggcgcagtcctccccttcctgcgtcaccctctgcacacccctctccattcctgctgtcatgctcgggccaacgtcccaggtctaactagtgaagcctttgcaagctccacgctgcactcttagagagatcctactcaaaagcagggctcagagtggactttcttagaagagactctcttttctctgactgcccttcaccagtgccctacccaaggctgcccccgccctgcccccacttgctcattttatcacctgcccctcctccccactgttcctccaggcctcaaccaaaggccctccttcgggtcatcctttcttccttaaaacagcgtctgatgtctgacctagttcaagaaagccgtggctcagtgtccgaggagccccgtctgcagtctgccctggccacgcctagctgcatctccctgtgcttaaacaaagtgtcgctaagtcgggaattcatgggcctgttagcagcggcttggcttccacatgtcccctttcatggtctcactagtgaaaggtagatgaaagagctgggcgtggtggctcacgcctgtaatcccagcgctttgggaggccgaggtgggtggatcacaaagtcaggagatcgagaccatcctggccaacatggtgaaaccctgtctctactaaaatacaaaagattagccgggcatggtggtgagcacctgtactcgggaggctgaggcaggggaattgcttgaacccgggaggcggaggttgcagtgagcagagattgcactactgcactccagcctggccaaagagcaagactccatctcaaaaaaaaaaaaaaaggtagatgagagaagaataaagcataaagctaaggtctaacttgctaggttattcaggagggagagaggacagaaattacaaataaatattgatatgtatacatacacccgtactgtagataggtgtatgtgtatatatgtgcaaatgactgtatattatgcatacacatgtgtgtatgtgtgtgtgcacatggtataaatgtgtgtatatgtacatatgtatttatacacacatgtatcaactcccataaatgcacaaggctcagcctgacctgtcatttaaccaaacaccagacagtgccttcccagaacattctaccctcaaggcagagtgcctccgtgacacgcaaggcagggggccagctgcaggcgccaggccaacaggatgaatgtctcaggttttcacgcccctggtggcagggcaggccactgtgggcctgctctcttctcatcttgctgtcactttagtgtccttgaggtgctgaggactctcagtttgtatgtccagcccaacagctcctgggctctagacccagagactcagcactgctcgatacgggtcccgggcccacaagtcccctctaccatcctcctcccactgtgcatccagaagcctgggtgctcccggacacccctgctccccacatgcccatctcccaccgtctgcttggttttcactcctaaacagtccttgggtgcagccacttgtcggcatcaccaccaccctgggtcatacccactctcgctctccagtgagtgcagccaggctgctgtttgcaggacttaactctcatcccaccagctgtggctgcccagctcctaaagcaacactagggccctgggtggggcctgcaaaggctgcgaacccaacgcagctccccctctcctagcccggagctggttcctcctctgtcctccaatgccccagcctcctctctgcgtgactgctatattaccacctgacccctgctccccggggcagggactttcttagaagagactctccagacagccaagcacaattggaagcagcacctgctcagatcttccaaactgaggcttggtgaggcctccattgggagcacttcattgacaaacgtttgaaattctgaagatgacctccgtgggtgctggggaggggacctggggcttggctgaggccctggccctggtgagtgaggccctccggctgggcacctctggatattggctgggagggcacccagggccggttgaggccgcagcttgcttttcggcctctccttgctgctccctccccacatggccttgggcaggtgactgctaatgtcggtgaccaggccaggctgccgccacccccaccccatttcccaagcctggctgctggtggcagggtctggtagaagtgctgtggcctccacgcaggcatccctctccatgggatctccatggaagagcgtgtgctggtgcctgggtgtcgggaccccataaaaaccacgggtgacccctgtgcaggggctggggctgctgggactgtggatggtccccctaagccccatgaggcacatttcccaggcatggcagcatggcggtacctctctggggctgtcccttgtgcatgcactcttactccagcagtctctggtccctctacctttctctagtggccctcgggctgagaaaccatgagagtgtgtccaaagcaggcagcggccttaaagaaatgccagcccacctcctccccacctagtgtccaaaagagctgcatgttggaagcaggggtctgtgcagccctcccctctcccctggtacaccctacttggggagcagatttgcctgggcaggtctgcacggggtctgctccctggcccagcagtcactggtgagacacccagccctggcatcctctgttcctaattcccatgaaggtgccttttgtggctgcacctacttgcataaggactgaggcatcggccaggaaaagacgtcaggcttggccagctccatctagcaagacactccaggtcaccggggaaagggcttttcactaaagcctccagggagactttggaacatgagcagcacagcttggagacgagccagcagagcacgtgacagcgaggaggcagccgtgcacgtcgtcacccaagccccaggccacagcatccacgggagagactttcctgcagcactgcgtgttgggggtagggaagagaacaaacttaatcctgggctgttacgggaagccctgacgagccccaggaatatcagggactgcaggaagggttccagtgtcactggggaacccggattcccacaaatgccttgcttcccacaacccggcctcctggtcccacatgcctcacctgttgttccagcctctgcacctgctcacatctctggggagtcacccgatggggctccccagtccccgcagcagcattttcctctgactctcagggccctgctctgccttctgtgctcagcagttgtttcggattgggagtcaggaggccattcccacacttgaaacaaggctgcaagaggaggctgagcagaaaccgcacaccccgagggcaaggcgacatgctcattgcccttgcgcccttcctccttccccaggagcaggacttctggccgctctgagtgcacgggtgacggctgccgtttatcagccttcaaatttgtgcccgaatcacctgcttccaactcctcaaatacagactggcttagctcagcctgattaagaccaaattaggaagggcagctgtgttccaccagagcccagggagccaggcagagggcaggaggatcaggccaccaaaggtcacctacacacaagcccgtaccggtgatgtcatcgtggatggaggagatgggctggcattttttaaggctggccccctgcctgggacacactctacatgtttctaagcctatgggccactggggagagctggaaggagccaggcacagccacagggaggtgccaccatgcttgggaaacacctcgtgggtctgggctgcaaatgaccatccacagtcccagccctggcaaaggggtagctcatggtccttatggggtcccgacacccaggcaccaggacacgctcttccacggatgcaggttagataagaaaccaccttcaggactctcctacacatctcttcacacctgtgcacaaaggaatcagcaaaagatcccctcccagcctgctgtgaccgcaaaattccatacccaagaccagggctgcttaaataatttgagctctgcaatggaaacctacaaagccactaaaagcagcagagaacgctggtgagcagctgtgagtggcagctgagattcattacagttccacagtcggactcgggaaaatgcttccgtgtgtgtagcaggctgtgatgcggtgtgtggtcccagctgaggcccccacactgacagcagtaagagccgagtatctcacatcctaaagatgccggtccgtgcccgagagcagatagtctatgagaccttaaccggggctgtcccagatgccactctgagcccttctggaagggtgagtttgatcagggagatggcgagggaggagtccttgtccaggagctttggggacagtttgacaggagcttttgggatgtcaaccttgctcctaccatggggaatgcagaagggggctcccccccccacctctcctcacatctgctccacctcagcccagatcagaggcagggaggagagccttgaggagccccggagttgggtgcactgactggaccccgccctgagtagaagagggaggctggcctggaggggctgcaggagaacagcagagttgctcagcaggacaaaggagacactgcggaaggggtctgagttcaggtcatcttgactggtttcctcagcacggcccatcatgaggcaaaaccctaaacgctgactcaaagtctgggaacggaatgggctgttttgtccttggctagagccctgccagctgtcccgttccctctaagtgctgcatgcactgtggacgtggcattccctctaagtactgcatgcactgtggatgtggcctgccctctaagtgccgcatgcactgtggacgtggcattccctctaagtgctgcatgcactgtggacatagtgttccctctgcctggtcctcctatgtgaaatccccttcccagccagccagcgcccccacctgcactcctggccccacccttgaggtcctttctggggtggctgagctcttctgcaagacctgtgtccgggcttccctccaccacagctcagaccctcccaggggcccatgtccatgtcggtagaatgcatgagggacgcccaagcccattcggtcccagatgcctccttcgaggcagggccgtgtgtgtgtcatcagcatcacacactcacacacactcacccgcaggcaaagcccctccctgagcccaggaaggctccaaaaggggcgtggtcacagcctcctgcgccttcaggggcgggaacccagaggaagagcagcccacgtgcggactccgcaggaatgaatggacacagttgggaggagaggggagtttcttggaagtaaattccccctgacattgagataactggttcagggtcccatccacagagtacgtgcctgttagcagggcaggaggccagagggcggggcctcgggaaagctgcccaagctcagcagggactccactgctcacagagcaagcagcccgacttgttcagcttggaatctgggctgggaccgctggggtcagcaaagaagatctaggagacatcccataaaatatcagactatcaggatccaatataatacgtgtgatattgagctcattgcacagaagctacaagtaaacattgggtttaggccactcagggaaaaatgacggagcctcatttccataaggagctggcctcatttgaaagctttccaccccacctctcgcctcacctcccccgcgctcctttcttgcttcataaactttcaccactgccatcgaccaaaaagcaaacagagacttggaaaccccgtgtacaacacgtacactgcgctctcgttgatcactattgggtaaactaaaatgtagcttaccacccaggggaggcgtgatgtgtgggtgtgtgtgtgcacgtgtgagtgtgactgcgggtgagtgtgtgagtgtgtgatgctgatcacacaggataaggcatagtcctttatcctgggtctgagaagatgcatggtttgtagaaacagacaaatctgtgaactgcaggatgaatggccctggctgctgtgagcccatcaccctctgatcacacatcataaagagaccttgaggaaggagtgagtttactgactgacatctcattaattcggccccggcaggaaacaatgaaatctaacttttctagacaccatgagatacccttagaatcacgcaagcttacaaatgagcattttgtgggaaacatttttatccttaactaaaacattcaaagcacagcttaattttccttcagactctgggtcctcgctgtggaagatggtcattccttggagctgcaatcaggatgactccagcagggtgcccacttggccccagagaaaatggctctagatcactgcatcttgcagccttgcatctactcgcaatggtcagtcgtaaccatgtgaatgaagcgattcacagaggcacacggggatcaattatagcaaaatggccgaggtgaacatcaccctaatccattaaactgctccagctcagctgacacataatcgatagcgtcgtaatccatctagttaaaagtttgcagaagcaaggagagagggctggagcgagatccacggaagcaggggtttgcttccgtctcttaaccctgagccgccacaggtctacgtcgtggggccaatgttattatatctgcaaactctggccgaacttacacactacagccctcctggagttactggctggctcggaccccatcatattccacgtgggatttgaggtggcagccacttgttgctgtgtgcctggagtccttacccgccaggcagccctctgagctccactggctgcagcgggcaaccagattttaaacagacggctgcatgtcaggggtgtttgcagctggcgggccacgcttatctgcggaaatgctggcatttgcactgttctgtttctgcggttgcctccaggacctggagagctgattcagttctccctggctgctgatactcctttagggatccagactaaaccaagagccaggagctgcaaagctgaggcccaagccctggctcttggtgactgtcaccctggagggcctggtaagctgtgcaaataaagacaggtcgttgctgttaataacagtaaaagtgcaaaaggtggcaaactttttgtatttgtaaattagagtggattataaatatcatatgaggagatctcgaattgtgtttttacacagattgtgtcatttgcaatcccatgaggtagctactgataatccctccattttacagatgaagaaactgaggccttggttggctacagaccacactgatgtatctgagagctctggggccttggctccccaccgctttgctgcctgtctccttgtgagccgcctctccccacctccttccacccccgacccgtgtctgttactcgcttgctcgcctcctggtgcaggagagagagggctggagttacgccgccccgccagccagcaccgtaacctgcaacttctctcctcagggttactgatcagaaaagattcttcagtgtctgatttcattatctacttacaaaatgttttcatgatgattacatcaaaaattagctgacttatttttcctccaagaatttcctttcttacataggccaacattagccgtccccctatccacgacacactgtggctgaccccaaaaggctgggccagttgggggtggcgtttggctgctagtagccaactgtggcttaaacaggaaagaattgttttttctctccggtgggaaagaaggcacagctggggtggaagctccctgtatccttggggacggtgtatctttcttgtctgcctttctgtcacaaacacatccttactccagcctgaaaggaggaggagagaagaaacaggcagaaaggacacaaactgcttccaaacgagtggtgtgtgtctggtcccatccaacaaaacaaaacaaaataaaaccagaaaccacaagaggcctcttttggtgatggatgttccggtggtcttgggttggtgggcttccacaagttccagcccgattcagccaagatctccagtcccaggcgtatcaagcaaaaggaagtgaagatgagagttgggggactgagaggaaaaggagcaaatgtggctgctgtggtgaccctgatattggtgattgcaggaagcagctgtgacccctggagccgagggagctcagaggaggggctggcgctgtacctctgaacccagcacgctaggccggcaggcagaggccttgctgtggccatgcccatcttctgcttccagagcagtggggctctccagggcacctgtttgtgtacccacagccaacagctctgggcagttagtgggaaattacagcaaccagtaaagtcagaagcactgaggctttagactcacacacgtgcagtatctccccagccgctagctaaagacattgaccttttttggtgatggatgttctggtggtctggggttggtgggcttcaacaagtgggggttttagcatgattcagccaagatctccaatcctgcagcctgggaccctgacttggtaaaacgaacacatctgacaccgcttgagtcgccatctataggaggtaagtgtgagtctgggttccaaatattttatcaagcctgtcagggaagcaagcgctgtctgtctgcaggaagatgtctgtggggagagggcagatctgagtccagtgagtctctcctgcagccagcctccaggtccaccctcccccaacagatgtcctctcgcaaatgaaaaacactcaagacgtggaaagcagacagatggcaggagggtccttagcccggactgatgacagccggctctgggccaggttctggacaggattgtgggcacacggtcccgacccaccactgcagttcttgtgggatggtcttggtccacatgcgagcccctctcaggccaaacacctgcttactccatattttcatgtaattctaattcatgtaaatgatgttatttcatcaaggacaattgaagttatggttggccactttgggtaacttattttttatttttttaaattttttttgagatggagactcactctgacccccagactggagcgcagtggtgtgatatcggctcgctgcaacctccgcctcccgggttcaagcaattctcctgcctcaggctccccagtagctgtgattataggtgcccaccatcatgcctggctaatttttgtatttttagtagagacggggtttcaccatgttggccaggcaggtctcgaactcctgacctcaggtgatctgcctgccttggcctcccaaaatgttgagattacaggtgtgagccaccacgtccagccactttgggtaacttttaacatagacaaaatagttattttgagaggcatcctaaaacaaatagaaaaaaaaaatcctgactatccaatggcctgcattctttagttggcataaggagacttctaaactcaattcagattctaaaattatctacctaagttattctactcaggtcagaaaaaatgtcagtgataaactgagacttgtgccgcgcatttatattctaggcttttctgacttcctctgaccaatcatttcccaggaggtgcgaagccttgctggataaaaggtaagcggcgtgaccctgaaaaggacacagggttaacacatcctcgaaaacacaaacacacaaacaacaaaatagaaactcttttgacaggaacacttggcaatagtgcgaacaaaagaataactggaaagtaatatcccacctaattacagaaaaaaagaactagtgagttctgagggattgtgaaggaagactccagccagcccctctcaccttcttttcccctgctcttcctccagctcttgaaagactctggaggttaattatagcaactggtattttctaaaaatggcctctgtgtggtttctagtttcattgctttttctgaatcttcctgccctcctgccccccccagtcagagcaggagttcacgtgtgctccccttggcttcgggtggatctttgtagctcactcaattaatgggctgtggtacgtgtaccgcagcttggcttctggagctgggttagaacagccgacacagcttccgcgtggccagccagcatgccggaagggagcccaaaccagaccctgcggggagaccacacggagaagcccctgtggagaggatccccaggcagatgactaaggagcctgtgggtgattccagcccccatcctcggagtctcccagctgcggccccaggcatcacagaacagagacaaaccattctgctgtgcctgtccaaatgtctgatgcacaatatctgtgaaaatgtgtgactgttttacaccactgagctttgaggtaatttgttacaccgccataaaaaatcagaacatcaagtaatgacacaaatgttccatcatgatgtgcatactctagaactaactagcacagataaacagataccccacaaaagaaaagtaatacatattacaaggtctattaaaatccatgggagatgctgtcctaattggttacagagagcttatataaatttaaaataaaacaatgcaagagtttccagaagatagagaaaaatgttaaccttctcgttatgtgttgattcattttattttcaaaggaaaaaagtttaactgtgactttcattaataactttggttactaggttacaaaaaaaagactattcacagcttttaaacatggctggaaatgctttaaaaatcattctataaatacagaagaatgtatttaaaagttcatataatgttcttgatagatggctttgtagacaaactagagtgagatggtgattttgaaacatctcgttttaaaacatctcattgctgcttccatgtgggatgtagaaagctgcaaagaataataaaaaaacctggctagtgtaccaacattataatttttcttgagtctatcaaagatctaagatggcaaggcaaccaaataagcagaattccaaagagggagcaggcactccagggagacacgagacacatggcgtttctcacctttgcctgagcacaggaaaaacatgtggcccccattaggtatgaagctatcagataaaatgttagtaaatcattaaagtccaagtgtggcctaggatgtaagtttggaataactgggaaactcagggagtcacactcactcacaaaatcactgagggctctcaagagacatattaggagtgggcaggaaacgggggctgctccttcagaggcacaggtatgtgggtgtgcaggacaagatcagctgctgttggaggacaggaacaaagccccacccacttcccctggatccttcctttctatgcagtaaacgccttaagacattgaggggaggggaccgcatcctcccacacacagggcacaggcaaaatccattgctcttatagaaagactagaagcaaaacttatatgcctctggaagaggggtaggaaaactctagccccaaggacacaggagaaaatcctttggtactgtgggaagggtagatgcaaaaatgtcctagttctgagataaaataaagaagctattccaggcccaggatcctataccagtaccaaccagaagtctgctacactgagggaggggagagcaggaatctcctgtccaagaccatcacagatacaaggcagaatttaattgccgtaggaaggaagagcagaattgctgagacagccccaccctaaggtttatatctgtctaagattgaggttgcagcaagacaacaaagaaaaccctatctcaccataagcctagcacagagtaacaagtaaagagagtctatccctgaagaggcgagagtatagatagagtccctctgtggcaaagacatgcaggaatagctaaaaggtaaagggagcattaggaacacagaagaaaaccacccaacaccccagtccccaatctagtacaagatattatagaaacatctcgtatttacagaaacttgaagccttagcagcactgaagatagcaatagcaacaaagtaaacccaaacccagctcagctcctaactagatcgacttcaccttgcacactagaagtcagacataataggcataataatttggagatgtgaatattatttacctcagtctgtactgttaacacacaatgtctggcattcgatcaaaaattataattttttaaaaagcaaaagataaaacaatctagagacaaagcaatcaacagaaatagacttgatgaccccaatagttggaaccattagacagagattttaaaataactataataaatatgttaatgcatctaatgtaaaaggggcaacaaacgcaaacagatagggaatttcaccagcgagaggaacactacaagacaaagtaaaatagaagtgctagaaattaaatatatgacatcacagataaagaattcttttgacaggcacatgagtagaatgaatacagctttgaaaaaaatcaacaaatttgaaaataggtcaataaaaattatccaaagagaaacacaaagaaaaaataatggcaaaagcaaagcagagtattcaagagctgtaggacatcatgagacgggctaacgtatatgttatcagtcacaggagaggagggaatgaagaagaagaaatattagaagagacaatagtcaaggattttccaaaagtaataacagacattaaaccacagatccaagactctcagagaaccctatgcagaattaataccaaaaataaaagaaaggaaaaagaaaacaccaacaccaccatcagcaaaaaatcccacttaactatacacatcatagtgaaactgtcaaaagtggaagatgaagagaaaagcttgaagatagcagagaaaaaagggaacattacatgcagaacagtaaagataagaattacaggacacttctgatcagaaactacacaagccaaaagacaatggagtgacatttttaaaatgctgaaagaaagggaaaaaatctctcaacccagaattctatattaaataaaaatatttttaaaaattagggtaaaataaaaacattttcaaacaaacaaaggctgagacaattcattctcgattcatttaaagaaatttcttcagatagtaagagtgtattatgatcaccttgaggaggatgggatcggccccctctcactggaatagtttaaatgtcaagaatgataaggccgtatgcaccgagaagatatggaaatgcttcttgctcatgccatgggactttctgaagagaaaaggtcaggtgcaagtcagtataaatggtgggagtgaggcagagttaatggatttggcttgtattgtgagtaggtggtgggactgaggaaaaggttcaagcacaaagggtggggcttgtgtggttcagacttcctgctgacaccaagggaagaaatatgcaggtccttgtaactggagaaggaatgaggtttgaaagctatcaaaggtcaaacataaaaaatggaatcttactctctattacatggaatgtgagagcagacaaaaattcgggtctacaccaggggtgtccaatcttttggcttccctgggccacattggagatagaattgtcttgggccacacataaaatatgctaaccctaaggatagctaatgagcttcaaaaaatcgcaaaaaatcccataatgttttaggaaagtttatgaatttgtgttgggccacattcaaagccatcctggccctcatgtggcccatgggccatggttggacaagcttggtttacacaaagaaatgaagagcatcagaaatggtaaaacatggaagtaagtataaaagattcctctcatttctattggagtaaccacattccatcttatatttcccactatttacaaccaaactctggatgaaatctctaaagcaaccatcagaagactgagaggcagagaaaagaaggtgacttggccagggattctgagacatgaggaacaaccaggtggtgagttccttgttatgatttccctcccgtatatcttcatttgagtaccggagaggcccacactcagaaataccaacaggcacaaaaaacaaaggctccaaggaaagcttactttctctaggcaaaagtattgataacgggcagccctgagagatagaacacattctacaccagatgaacagatggtataaaaaaaaaagtgatacaatcctccaaccccatgcaacaccgcagctgcagggactgagggcagagccctgtcaaccatccctgtcctaccctaatgatcagggaccctttcttctcccgacttggagtctatggtcagggagaccgtgttagtttgtcctcctgctgctaataaagacatccctgtgactgggtagtttataaaggaaagaggtttaactgactcacagcttagcatggctgaggaggcctcaggaaattacagtcatggcaaaaggggaagcacacatgtccttcttcacatggtggcatcaaggagaagtgccaagcaaaaaggggaaaagccccttacaaaaccatcagatctcatgagagctcactcactgtcatgagaacagcagcatagggtaaccgcccttatgattccattacctcccactgggtccctcccatgacatgtggagattatgggagctacaattcaagatgagatttgggtgtggacacagacaaaccatatcagagactgtagtggagacctgtttggccatttctgtcttgcattaaggagaaagaacccttcctcctctacaccaggactcagagcaaacttcagggtgaagccctttcaactattctgatcctacactaacatgggtagaagtggcacccctcccccaatacctatcactgtggagactgtagagtgaatcctttctaccatccctctgctgcactaagcaaatgtcagcaaagaggtgatgcttctctcccactccactggtgcatagactgtgaccatccccaccgtgcacgaagcaaacagcagcaaagaggcagcacctcctcccctcccaattagagcagggtaggtaggattacggaggagagaacctgtgtattaattcctgggcagacccccaagcagcctatgcctaataagaatcaacacattagaagattggagaactgagctgcagtgtcaaacactgctatcatttcacattggcctctgggcagcacataagctgggaagaccagggtagcaaactaaattggcatttgaatctcagcctatgaaagtgtaccggaacatgcatcctgaagctaaacaggttgactgcctgctgaaagaagatttaaatagaaaccagaacttcatgacacaacactcagaatgtcctagttacaatccacaattactcatcacactatgaccaaggacatctcaatttgaatgcaaaaaggcaaacaacagacagcaacaccaagataatacagatactataattgtctgacaagggttttaaggaaccagcataaaaatgctccaaaaagtaaatagtaacactgtgggagaaaaaaaaaaagaaaaaatagaaactctaaacaaaggaaaagaaaacttaccacgggaggagccaagatgtccgaataggaacagctctggtctacagctcccagcgtgagcgacgcagaagatgggtgatttctgcatttccatctgaggtaccgggttcatctcactagggagtgccagacagtgggcgcaggtcagtgggtgcgtgcaccgtgcgcgagccgaagcagggcgaggcattgcctcacttgggaagagcaaggggtcagggagttccctttccgagtcaaagaaaggggtgacggacggcacctggaaaatcgggtcactcccacccgaatattgcgcttttcagacccgcttaaaaaacggcgcaccacgagattatatcccgcacctggctcggagggtcctaccccacggagtcacactgattgctagcacagcagtctgagatcaaactgcaaggcggcagcgaggctgggggaggggcgcccgccattgcccaggcttccttaggtaaacaaagcagcctaaagctcgaactgggtggagcccaccacagctccaggaggcctgcctgcctctgtaggctccacctatgggggcagggcacagccaaacaaaaagacagcagtaacctctgcagacttaaatgtccctgtctgacagctttgaagagagcagtggttctcccagtacacagctggagatatgggaaccggcagactgcctcctcaagtgggtccctgacccctgacccctgagcagcctaacagggaggcaccccccagcaggggcagactgacacctcacagggcccagtactccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctagaaagcagagcgcctctcctcctccaaaggaacgcagttcctcaccagcaacggaacaaagctggatggagaatgactttgacgagctgagagaagaaggcttcagacaatcaaattactctgagctacgggaggacattcaaaccaaaggcaaagaagttgaaaaactttggaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagtgagaagggaagtttagagaaaaaagaataaaaacaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataactgtcagattcaccaaagttgaaatgaaggaaaaaatgttaagggcagccagagagaaaggtcgggttaccctcaaagggaagcccatcagactaacagcggatctctcagcagaaaccctacaagctagaagagagtgggggccaatattcaacattcttaaagacaagaattttcaacccagaatttcacatccagccaaactaagcttcataagcaaaggagaaataaaatactttacagacaagcaaatgctgagagattttgtcaccaccaggcctgccctaaaagagctcctgaaggaagcactaaacatggaaaggaacaactggtaccagccgctgcaaaatcatgccaaaatgtaaagaccatcaagactaggaagaaactgcatcaactaacgagcaaaatcaccagctaacatcataatgacaggatcaaattcacacataacaatattaactttaaatgtaaatggactaaatgctccaattaaaagacaaagactggcaagttggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatattagtctctgataaaacagactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgcgacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgcaaaagaacagaaattataacaaactctctctcagaccacagtgcaatcaaactagaactcaggattaagaatctcactccaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagactgcaggaaatagagacacaaaaaacccttcaaaaaattaatgaatccaggagctggttttttgaaagatcaacaaaattgatagaccgctagcaagactaataaagaaaaaaagagagaagaatcaaatagacacaataaaaaatgataaaggggatatcaccaccgatcccacagaaatacaaactatcatcagagaatactacaaacacctctatgcaaataaactagaaaatctagaagaaatggataaattcctcgacacatacaccctcccaagactaaaccaggaagaagttgaatctctgaatagaccaataacaggatctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcagtaaaatactggcaaaccgaatccagcagcacatcaaaaagcttatccaccaagatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagccaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaagagaatcaaatacctaggaatccaacttacaagggatgtgaaggacctcttcaaggagaactacaaaccactgctcaaggaaataaaagaggatacaagcaaatggaagaacattccatgctcatgggtaggaagaatcaatatcatgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactataaggctacagtaaccaaaacagcatggtactggtaccaaaacagagatatagatcaatggaacagaacagagccctcagaaataacgccgcatatctacaactatctgatttttgagaaacctgagaaaaacaagcaatgggtaaaggattccctatttaataaatggtgctgggaaaactggctagccatatgtagaaagctgaaactggatcctttccttacaccttatacaaaaatcaattcaagatggatttaagacttaaatgttagacctaaaaccataaaaaccctagaagaaaacctaggcaataccattcaggacataggcatgggcaaggacttcatgtctaaaccaccaaaagcaatggcaccaaaagccaaaattgacaaatgggatctaattaaactaaagagctcctgcacagcaaaagaaactaccatcagagtgaacaggcaacctacaaaatgggagaaaattttcgcaacctactcatctgacaaagggctcatatccagaatctacaatgaactcaaacaaatttacaagaaaaaaacaaacaaccccatcaaaaagtgggcgaaggacatgaacagacacttctcaaaagaaaacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtgcagaaataggaacagttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaaacgtcattctcagtaaactatcgcaagaacaaaaaaccaaacaccgcatattctcactcataggtgggaattgaacaatgagatcacatggacacaggaaggggaatatcacactctggggactgttgttgggtggggggaggggggagggatagcattgggagatatacctaatgctagatgatgagttagtgggtgcagtgcaccagcatggcacatgtatacatatgtaactaacctgcacaaggtgcaaatgtaccctaaaacttaaagtataataaaaaaaaaattttcttaaaaaaaaaaaagaaaacttaccacaaaatttagaactgaaaaataaaatatgtgaataaaaagaagctgtcactgaatgggttgaatagcaggtggagacaacattagaaacaatgaatctgaggctagatcaatataaattatcctaaataaggagaaaataagactttaaaatgaatagaatctcacaaacacgtgggacgataacaatctaaaattaatgtgatcagagactcaatggaaaagagagtgtggtgcccaaaaatatctgaagaaaaaatgattgaaaatttcccaaattgggcaaaagacataagttgacaaatttaagagattgagcaaactccaagcaggataaatccaaataaatccatgcccaaatacataacaataaaacatctgaaaactaaagacaaatttaaaacttttagaaacagccagaaaacaattattacctacagcattaaaactattcaaatgacagcatatttttcagcagaaatcatgaaggccagaaggacgtgtcataagacttttcaagtgctgaaagaaaaagaaaaactgtcacccagaattctatgtttggcaaaactaactttcaagtatgagggtgaaataaagatattctcagatgaagaaaatctaagaaaatttgttaccagcagaactgccttaaaaatttttttgctggaggaagtaattccgacagaaaataaatgataacagaaggaaatgtggaacgtttggaatgaagatgagcctcggaaaggatatattacttttctattgctttataacaaattactagaaacttggaagcttaaaacaacacgttgtggatgaatattttgggcatcgcttagctggattctctgtttcagggtgtcaccaggttacaacacaggtgttggtgggactgtgttcctttctggatcttggagtcttcttccaacctcatcacactgttagaagaattcaattccttgcagttgtaggagtgaggccctcagatcccgaaggacacccacagattttgcaatgtgttcctgaataagcagttcctatcagaccatctttcttcttcaaggactgctgtggttagggacgctcatctgcaacaacacagtgtaattcagcacttctcatgctcttcttctcacgctcctcaaaaatccacctttttcagggtgatgtcaatgaagtccaacagtgagctgaacatgaagccccacctgggcctgcagactatacccaaaaagaagaagaatttaaaagaaaaaacaattagttcttatgacataatatccaacatgtccaggagacaataaaaaatccatataccaagaaccaggacattcacaacttgattgagaagagatgatcaaaaggtgccagcgttgagaagactcagacattgggattacctgacaagaattttaaagcaactatcatgaaaatgcctcactgagcaattactaacactcttaatacaaatagaaagtagaaaataaatagaagatataaaaaggtaccaagggaaattatgtaacaaaaaatataataattgaaattaaaaactcactgggctgcctcagtagtggacaagagatgatagaggaacgaaaaatcgatgaactcaaaagcatatcaatagaaatgtccagtctgggccaggcatggggactcatgcctgtaatcccagcactttgggaggccgaagcaggtggattacttgaggccaggagttcaagaccagcctggctaacatggcaaaacaccgtctctactaaaaatacaaaaattagccaggtgtggtggtgcatgcctgtaatcccagctactcaggaggctgaggcaggagaattgcttgagcctgggaggtggaggttgcagtgagccgagatcgcagcactgcactccagcctgggcgacagagcaagactccatctcaaacaaacaaacaaacaaacaaaaaactgaaaagagaaatacagaaagccaccattagagttggagactgcaacatttctctgtcagtaattgacagaataagaacacggaatattggcaaagatagaaaaatgctgaaaaatactatcaagcaaattgacctaatcgtcactgataaaacacatgacctggaccagtggaatacacattattttcaagtgcacatgtaacattcagcatgatagaccgtatgtgagccataaagcaaatcaacaaatttaaaataactaaaataatacaaattttattctcttaccacagtgaaaaccagctacaaactaagtacaaaaatatatcttgaaaatgtctttgaggacatttttaagaccaataactcatttaaacaattatctttaaatgctttatttaaaaattatcttttgggccaggtgcagtggcttatgcctgtaatcccagcagtttgggaggccaaggcaggaggctcacttgagcccaagggttcaagacaagcctgggcaacatagtgggaccctacctctagaaaaaaatttaaaaattagcccaccatggtgatgcagacctgtggtcccagctacccgggaggctaaggtgggagaatctcttgagcctgggaggtggagattgcagtgaactgagatcgtgcctctgcactccagcttgggtgacagagcaagaccctgtctcaataataataatataaatcttttgaccaaaaggaattcaaaagtgaaattataaaatattttaaattatacataatagaatttgtgaaatgttctcaaagttcagacggaaatttatagcattacttataatacttatattagaaaaggagaaatgtctcaaattagtgacccaagcatctaccttaagaaactagggagaaaaaaggaatactgtttgcaatctgtgagcattttttatatttagtgattaaaatcacagcctggctactatcagggccattttccactttctcagcatgaactcacttttggtgccacatttcttttactgtgaaataaattctttgatcagaagcaatcttgtgtgaaacagtgaataaagctagagaaggcgaatccgtgttcaaagtaagcatctattccagtgtggacaaatcaacgttccctgcttgatggggaggggcgggggttcagtggaatcatctctttgtgcttatatttttgtgcacaagaatatgacatgcttcatgaaaggaagaacttagcttagtgctaaatccccagggctcaggagggtgcatgccacataggggctcagtactttcgctgaatgaagaaatacgcttaagtgttctatagtacagagttttcgcaggggcttttcctgtgtttcttggattatattttcctcaagatgaactcttcatctttctttcgcagactgtgtttcttcctgtctttcctttcatctgggttctctcgttccccttctatcatatgtatgtgtggttactgagccgtttctttttttttaagaccgctttattaagaagtaatttatatgctgtaaaggttaccagcttaaagtgtaactggctttcttcccttagcaccgtgtttttgaggtttattcaccttatggtgtgtatcagtacttcattcctttatgtgatgaaatagtattccattatatgaatgaactacattttgtttatgtattattcatcagtgggacatttgggttgtttccacttttttactatgaataatggtgctgtaaacgagttttttagtgtatgtcctaaaacctaaaataacaatagacagataggctctccaaaggagtttatctgggattggtgggggattgcaatccaagatacccatgccacaatgaaccaagaaacacccaaagatgctggggtcaaggcaaacttttataaagacaaaaaggagaaagtcatgtaagctggtttgaaacaaaaactcttgactgttgaagctcatagctcctcattggtcacgctggctgttgctggggagatgtcttcacagcagcagcttaacatggagtgtttatggtttccagggagtccttgtaatagttcttatcataggtacatgtgcgtgagtactcctccttcagggcctcccggattcattttgctagggtttgacctaagtgaccccattttggtgctgacaactttcacaacatatctccacttctcttgggtgtatacctagaagattccccaagtcacatggtaactctatgtttaacattttcacaaattgccagactgttttcctgggcagctacatcactttacatccccaccagcaatatatgaaggttccaatttctccacattctcatcaatacttgttattgtgttttctttttcttttattttttagagacagtgtctcgctctgtggctcaggctggagtgcagtggtgtggtcacagtgtcgatgaagagtccaactctgtaaaatatttgaagagatttattccgaaccaaatatgagtgaggcacagtatcaagaggtcctaagaacatgtgcccggtgtggtccggctacagcttgaatttatacattttagggagacataagacaccagtcaatacatgtaagatgcagactggttccatctggaaaggcaggacagctcgaagcaggggcttccagatcatgggtagattcaaggattttctaattggcaattggttgaaagtgttattgtctaaagacctctaatcaacagaggggagtgtctgggttatgataagggattgtggagaccaaggttcttatcatgcagatgaagcctccagattgcgagcttcagagagaatagattggaaatgtttcttagactgaaaaaggtgccagatttgtgactgattctctgctgtgtcagggaaaagacctgaaagggaaggggattctttgcagaatgtagatttttccaagagacagctatgcggggccatttcaagatatggcaaagaaacatatttggggttaaaatattttgatttatctgtcatgtgatgttatgccagagtcaggttggaaagtaagccacatcacatagggttaaataaaactgctttgagattttataaggtgcaactccccagccccttagataggaatttgggcaagagggaaaaaaggtcagagtttagtcctcagtagctaactgtaactccacctcctgggctcaaagatcgctcccacctcagcttcccaagtagctgggaccacaggcgcacacctgcttatttttatttattttttttagagacaggcgtaactacgttgcgcaggcaggttaagaatgccttttattatagtcattctagtgggtggtgagtcatttcattttgttctcatgtaaaaggacaacttcataatatgtgaacaaattcccttggttttctcttcgagcattttgcaagttgtattttgtgttctattctacattccgtgccctgatagctaggagtgaggcagggaaaagctcagctgagactatatctttgctagaatatctggtctctggtttcttgactaggattttctaaatgtcctgaatcaaagtttcctccccagggaatgatgcaatgacccctgggggtcaccccaggctttggatcctttatctggttcagcagggaacccctgaacccatcagagtccctcctgtttgttcacgagccctctctcactggtctcttcccagcagcccttttcacttcccccagcagtaacaggagaaagatatagatacctctctttctccgaattaacctgtttttcctcaccagtgagacccccccaccttttttttttttggagacagagtttcgctcttgttgcccaggctggagtgcaatggtatgatctcggctcacagcagcctctgcctcccaggttcaagcaattctcctgcctcagcctcctgagtagctgggattacaggcacctgccaccacgcccacctaattgttttgtatttttagtagagacgggggtttcaccatgttggccaggctggtctcgaactcctagcctcaggtgatctgcccgcctcggactctcaaagtgctgggattgcaggtgtgagccaccacgtctggcctccagtgagactttctgagttttgttgcgccagcagggccatttgcgggagtaatcttacacacctgagcaataattttttttccctgtattcacaattttttgacgtttttggcatttggctgtatccttttgcttgttcgctgtggagttttcatttgtttgctggttttgggcaggaaggaggtgctggcttttcctacagtgtgtttatcatttaagtatttgagaagggagatgctgcaatccagctgcactctaccactttaaaaattctcagcaatacttttaggtgtttagcttactcccagcaattcctccttactcattcatcaaactcctagtcactgtgcacctgctgcatggccggcagggctctcagagctgagctacagcagagaaccagagccctgccttcgtggagccttagtaaattatgtccacgtgtctccatcaaagcgtattttgcataaaagtgttgtgtttatggaagacaatttcaatacatttaaaagaatttaaatcaaatttgcctaggttacaaaattaaccaataggtctagtgcatagcatcactacagttatcatattataaatttgctaagagtagattttaagtgctcttaccatgaaagaaacgcatacgatgtatatacaataaaagtttaaaaaatgtgtctaccccctaacattcatgtgacacttcatactctaccaaaagggcagaacagaggggaagctttagagcaggagcggaggaatctgcctccatttttcctgggtgtttttttttttcctttttatgcatattctacttatgtagtgccttcattttcaggctttttcaatgttgtatttgagaagctgcatcaggtacagctcattttccactcattgcttacaggatgaattaaaatcatttgcatattccgtagctgatgatatatgcccaaaataaatgcaagtctggcataaggcattaaaaaaaaagtacagagaaatgaagttgtgtggcatagagaaggtatttttacattttaaaatcttgaagcataagatctttgaaaaaatctttttatacgcaccataaaccagttgttcctcagcaatttgcagaaatcagatcaacatggtgttacagacaaatatttacttgaagccaatttctatatattatctccttgcagccacctcaactgccagtccctggaattgtacacagtcccttcaaaaccttgaggacacccgtggcattaactcagcaaataaatgagagcctctgtgtgcacggcattgttctagggacaatggagggggtagacataaataacccagcaccttcccgtgaggcattactggggtaaatggaagagagctgacaaagcaaggtagagattcttaaggggaaatcatgacagatggcctgctgcagtgataaattctgagtgtctagagaactatcaatagaggatggttgactgatatggttcccaacctgtgtgaacaggatggctatctaatcatatccctgggtcagagcccatagctcacacatgatggactgagtatttgtgtcttttccaccccaaattcacatgtggaaatcctcaccactgtaatgatggtatcaggaggtgggacctttgggaggtgatcaggtcatgagggtggagctctcaggattgggattagtgcccttatagaagaggccccagagagatcttccctgcctctaccatgtgaggatgtgagaagatgttatgaggaagaaggccctcaccagataccaaatttaccagcaccttcatcttggactttctagcttccagaactcttaagaaataaatttctgttgttaagccacgccgtttatggtattgttatagcaatcctgaaaatctaagacagcagaggaatagaacctgaaggtcagactccaacatggcattttgctgccagcagaggcccatgggatttgctacaagagattgcacccacactccctagtgccctttgaaagtatagttttactttgcagtttctttttggggctgtgtatgagttcatcgttcataaatttgtttgtactatttgaaaatctcttcgtatttcctgctagttctgtctcaggccatcagctctatcaaagtccttgatctgaagcattcctgactggcttacatccttcaggttccaagggctatgcccttgtgcaaactttttaggatttgggaacaagttcatttatgcctcctttcatggattctgaatctttgagctttactctcagacactgcagcttcattatctaattcaggccccagagccacaaaaatggttaatcaaggatgctgttacctatttccaccaagggcaatgcatacttcctactaacttcccaccgactccctggttccaccttgcatggttgctcaacagggaagtattagattctcttctacacagagctacataaggagactcaggagacatttttattatagttagcaaaggggctacttcttgaagaaaagatcgtcttctaaagaaacacctgctcaatcaacagtttaacggatacaaaaagtgtgtctttgctctcagaaagaaaggtccacataaaccgggttactcccatcctgaagaactgctcatgctctgtgacaagttcctcgtaaacaaaacaaaacaaaaccagtttttttttctgtttctggaactagaatggggaagcaaatgtaatggggatgcgccacctagcgacgagagatggaactgtcactcaactaagaaaaggactgtgctttaaacagcagcaagtgatcactgaaacctttcaggtaaactgaaatcaataaatcatctgctgaatgaaatatgcagatattttatagcttctagatatgatatggtggttaacagtcttctggataatacacacaagtgtttaaaaagcagtaactcagatacccacatttgaaagaaaaaatgctaagtttttaaatgtttcaaaagcaagcttgagtaaaaatctttttgaataactgagttttttttccccgataaagggtctataacagatctatactcaaaaacatttatatatttccactgtgtcaataaaccagccaattatgactctgttagaatggagtaatgccctgaaagataaaaatgttattcttaacaataaaggtaagttgtaatgattattcaagattatatttaatatagaaaacaggcccacagtatttcttaacttgcaattttattaatttttcagtactcttaccttttatatactactaagaaaatttaaaccataactagacataaacattctgcagtttaattcaaattttcatatatacagaccagactacatatgtattacactgcaaaacttacacatgactgaagctgagcctaataacttcaattagccaacaacagaaacactcccacttcctgcagtcacagcaattagctaacaataaaaacactcccacttcctgcagtcacagctgaaagacttttcaaggcagactacatttgggctggagatacaagtgatgtagtttgacttgggcaatacaaaacaaaagtcataggaattaaatggattttcaatcactgtataattcattctcctggcttaagtacgttttaattttttcacagaaaaaaatatatttcaggcaaataaaaacaaattccagattagcatagttcagcgtttcatttatcttacctttatcaaggcaaacaaagtacagatgctgtacattaaaaacatagaaatatatcactcacaccacatcaactcctacggacaaaagggctttttctaagccctgctcctttctgaagcacacaccacagctaaatgtacaaagagccatctgctggtccaacatagccaactccaatgagcaggacgtctatcagcgtccatattcccaggccaccgaagctgaagagcttgccgaggccttcccgccactggcccaggtagaaacggtctgctccaaacccaccgagggtgatgctgcgatggcaaacagacaggattccatgagaccacctccaccccagctgtggccagtcacggtttaatcaccacattatgtcagatttgagaaagggcttcccctgatcgtagcccttaactggaacacaagtgactatttcacaaactgacaccaccaaataattacgggcaggaagacagtttaaatgtcaaaagtaaacatacaatttttagctgtactaaaaaaccaatgttttctttttttaaagttatcaatctcattgctttttagtcaaaataaagcaaagacccagtctaacaggaagtgcactaacacggggtcagggctggagtcaggaggagctcaccaccacctggacgacctggatcaagtcatccatgttttcagtctattttttcattcatctctaaaatcttaatgttaggaataaatccttaaaagatttaaggatcttttaaattctaagatctaataatactgaaactatattatggaaaatttctaaacacctaacaataaaaagtaaagagaacagtacccatgactcagctccaataatcaacacttggccagctgtgtttcatcaaaaccctcctctttcccctccagagtaccctgaagcaaaccttgggcatcatctcattacagtgatgattttaaaagaaaccatgttgccgggcgcggtggctcacgcctgtcatcccagcactctgggaggctgaggcaggcggatcacaaggtcaggagatccagaccatcctggctaacacggtgaaaccctgtctctattaaaaatacaaaaaattagccaggcgtggtggcgggcgcctgtagtcccagctgctcgggaggctgaggcaggagaatggcgtgaacctgggaggtggagcttgcagtaagccgagattgagccactgcactccagcctgggtgacagagagagactccgttaaaaaaaaaaaaaaaaaaaaaaagcaaaaaaaaaaaaaaaccatgttgagtgctgagaagttttaattgttgaaagtatgttacagtatagtactgtaagaggttaacaatgtagggaaaccaggttaggggtatataagaactctactatctttgcaacttttctgtaaattaaaattattccaagtttcaaacatttatttatttttttaaaaagccagttgttaatttgaaccattgtcagcaatggttactaatctttttttttgagacagaatctcactctgtcactgaggctggagtgcagtggtgcaatgccagctcactgcagcctcctcctcctgggctcaagtgatcttcccattgcagcctaccacgcagctggaaccacagacatgaaccacgatggcaggcttttgtatttttggtagagatggggtttcaccatgttggccaggctggtcttgaactcctgacctcaagcaatccgccagcctcggcctcccaaagcgctgggattacaggtgtgagccatcgcgcccgccctatcttatttttgttagtctcattttctatcctggcaccctcttttacttttcagttacacttttcctgccaggcaagatccttctttcctcagctcaaattctaatgcagtggttctcagcaaggggcaattttgtcccctaggggacacctggcaacatctggagacacactgtcacagctgcaagggatggggggtttgctactgacaagtagtaggtagaggccagtgatgctgctcaacaccctgctatgcacagcacagccccaagacaaaaactcattcagcccagaacgtcagcagtgatgaggctgagaaatcctgccctatggctgcaatgctgcaggcctcagggtctcaggcacgaactcaaaacttcaagtgtaggcagcgtaaccttttcactaatcagttaaccagggtcttacctgcccttccctttggtgggaagaactgctataatttcttaaagtactgttgagaagtttaacaaacagcacatttctatgtaagaaatataagcctataattatctgctgctgatgaaattataggtaatttttaatgtttttgtcattttcatttttccagttttcagtgttcatcatgtattactttttataatagttacttaaaattaaagatatacatcataaaactgcctattttggatagtccacagcattttactgattcgtggtacattcagaatggtaaacgtaatgtgcaggcatcttgggagaaaagctaacatgcctgccagtcaactccacggaggtactggtctgatcatctaaactcttccagctgtttgctagagtctaacacacgtggtaggatctgagtgaagaatgaaggggactgagctcaatgtctgaagattccaccaatcccaaagaaatgcaaacggccttttacacttacgagtaacaaggcttaccttagagccagagccgtagaccacttatagcctccagtccaattgcaatatagcattttgggaaaagtacggttaccttaaaaaaaaaaaagaaagaaaaatacagggtataaaaaatactctcagaaagacttaattgtaacaaatgggctcaaaatttaaaatgtgaaaagtcaactctctttacggtaatacatgttgaagtgaagagtacaaagcgcttaccatctatctacatagatgtaatatttaaatcagctaagttaggattacaacgtgaggaacatgaaatgctcacccacatatcaagacctacggggaagttacgagtatataagacagtgtagtcttgaggcataaaaatcacccaataggaaaagaagagaaagtcaagaaccagaaatatacaaacacttcatgtatgagtgttatgacagaggtcacacacggatcaacagggaagagttgagacaactggccatccatgtggggggacaattaaagtagaatctacctcacaccatctaccaggaccaattccaggtggattctaaacctaaatgtgaaatgttatacttacaactttcaaaagaaaatgtagcaaattgtctttattaacctggggtagaaaaagatttcttaaaaccaccacaaaaaaggactaactctaataacttccagtaattatatttttaaagttctgttcatgaaaatatacaataatgcaaaaaaaaaaaaaatcaaaatctgggagagggtttcagggacagcacaggtaatatccaaaatataaaagaagtctagacaactttaagaccaaatttaagaataaccactcttggagagaatatggctcatcaggaacagttacatagcgcgggtgggaatgccagtcaatacagccatttaaagaatgacacacgctggaaagtacatgctgaagaagctcttgcacctgtgccattgggagacaggcaaagaaatttgaacagtcacaacagcggaaaacagcacttaaccaaatatattggagaataaactgtgatacaatcttacaatagattattacacagaagtaaaaaaaagaagagaagtcacgtggatgaatcctagagccacaatgtttaggaaataagcaagtcccagaagagcacacagcctgaaatcattttacacggttctaaaacatgcattattgaatattattttattacatatagacaataaaactacagaaaaaatttaaaaggaagtgaaataaaaaattcaaaagggtggttaccttggaagaggaggaaaggcaaccaggtgaaggcaagcactcaggcactcaggcggccgcaatggtattggtgctgctttcattgttattttgggtaaaggtcaattactgtgtattatgctttatacttcaaatgtttttcttattttatcaaatattacatttaaaaagaactgcaattttctggatgctttactttagtacgttgagtttattgatgatgcttggcacatctaaagagctgctgataaatgtttctaattaagtaacttgactcgcaaatttctggttaaagtcccttcaataaacttggagaaaaacattttgttgacaaatgtccttgaactctgacctacccaagcagtggacgtggtcccgcaccgtgcagttggcagggtagcgctgccgaggacaggacaccgtcatgcagctggtggagttggtacactcgtaatctgtttcaggaagctgccagcaaaatctgcaagtcatgttaatgatgaagttcttttgggatttgaagtcttgatcctatgtagcaaatgacacaaaactcatcaatcacaatggtgtagtctgttaagatgtcagtaagactacacagtcacatggcacaaaattccgtaaatgcttgtatttaggacctaggagtaagtgccagaaaaacagttaccaaaacaatatgtatgtaaaacaaatgcctatgatgtgacctcataatcataaaactacacacccaaacatatgtacttaagggaaaaaactagataaattcacatcaaaatagcaaaggttatttcagggtgatataattatttcataacttttgcttagctaaatttttcatagtaaacgtatacttttataatgcagaaaagaggaaaatttattttagaaagtcacaatcacggatggctggaaggaactgatgaatgcatttgttgaaggtcactgagcttcaagtgaggagtggaatccaggtccctgaactccagcctgatgcttctgtaatggttaacacaccgccttgcttccgagttgccaaccttccctaacatcccctaccttgcacagcctggcaactcagggttgttacagctgctcctaccaccagggcatgtggcatgtttaatccagaggcagcccaactcagaagcaccacatggtgtgtggaggctcagtgagtgttcactggtggccagagaatttttcatttcaattttaaaagccattattttgtattctgcttacaaaagtagaatgttctttgtatgttacatatttgaagattatagacaaaaacctataggtgttcagagctaaccacttttaatcttctttccgtttcttctacatgtatatttataaatttactaaaatggaattatactgaaagcactttgtagtctttttactctacctgacattacattgcagtgcatatttttcaaaatcatttttatgtggtcacacatctctggaagcatcatgtatatatatgtatacatatatatacacatacacacattatttttttttctttttttgagatggagtctcgctctgtcgcccaggctggaatgcggtggtgcaatctcggctcacttcaacctccgcctcccaggttcaagcgattctcctgcctcagcctcctgagtagctgggattagagacgcaccccaccacgcccagctaatttttgtatttttagtacagatggggtttcaccatgttggccaggctggtctcaacctctgacctcaggtgattcacctgcctcggcctgccaaagtgctgggattacaggtgtaggccaccacgcccggcccatgtttgttattttttttaacatttcacaaatttgcatgtcatttttgcagaagagccatcctaattctctctgtatggttccaactttggcatatgcgctgatgaagcaagtactattcattttcttatcaatgcaaaaaccactttttatggaaaacattcaaatatgggtaaggcatcacttgatttaggcaaacagttggatctgcaaaataatacgtttacatctgcctattttcagtgatgtgcttaaaacacactttttttaatggttttttaaaaagtaggtgacacatgtacatggaacacatgtcaagacacaacaggagagtgagaagtgagccggcctcgtctggcccagccgccgggagcccctgccctccccaggccaagtacgctctgtgcttccagagagagctgattctacacataggcacatttatgtcacctacatttaatgttccccaatactttcacttaattttggacatctatcagtacattacctctagagctgcctagttctttttaatggctacaaggtgtttattctattacacgtgtaccataaattaagcagttcttagacatttcacttcttttgaatcttttgctttaatgagcaatgcagctaaaaaataagcacacttatctgcatccatgtataatgatatctataacataaattcctacatgtacaactacgagctcaacgattgtgtgcatgtgtaagtttaacagatatggcaaatcgcctacaagaggttgatcaatttgattacctattaataagatatgagcatctgacccttatactctcacaaactcagagttaatcaaattaaaaaaaaattgccaatctaagggttaaaaatgtattaattaaatactatgagaaaacttatatgtttttcatgttatatatctatttgtatttcctttcctatgaaccatctgctcatgtcctaacactgtttttctacaagactgtcatcttttccgtgtgggttttaggaagtgtttatatattactgatattactgtattatttgtcacatattctagaaacgctttttcctagtttgccatgtcttttgcctttatgcttttttttttaggtcatgcagaaatctccaatttttaggagtcaaatgtatcaattctttattttatggcttctaaactttatttcatacttagaaaaatattctccattttgggattataacagcaactatctggtgttttctgtggtacttcagggtttcatttttcacattacatctttggactatctggaatttattctggataagacaggcgttccacttaattttgttctagagagctaccaggcattccggcatttactgaatccatcttctcaccacagataagcactggcccttcaaaagctcatctatggcagaaagacactgccaccccctctgtacactagctgtcactattgagaacacagaatccatctgaacgaattagacttgcttcagatatgctagtagactgagatcttctccagtcctacaaagcaacatttctgtcaagtgcatttccagcagacatcaactggcttgacagttatcattataactaaaacagtagtgagctgatatggaaaggtctattgggttttttaatttatttctgcttacatactcaaaagggaaatcataaaagaatataaaaattcttcagaatttcttcccaataatcaagtctgaattgttcttctaacttaaagtttacaatgaatttatttagaataagtaagctgcagtacttacaacacaggtaacagatggtttcactgcacagtcaaaagtgacaggcttcccataggtacaggagaaatttgttgtgcagtctatacagtctgcaggaagcctgctacacaaaccattgctcggacacttcatcacataaggtgggatttcagtactttctgtgagaggcaagagagaagcttattctcctataatactgattcgaataacagagaacaatcttctaaggttaagagacgtgatcattagcaagtagacactgcactggaagggaagaagcatgggactggagtcagagacacctgcaattaaagcagaattctgcccacggccagctgtgggacctggtgagcaccacacttgtaaaacattacttcattcctgcctcccacgtggccgtgaaaactaaaggtgctcatatacaaataatgtatagaaaattctgggtatacattaagggcttaaaaaaaagactatcattttgtaagttgaaaaaaaacttacagtagggttttgcaaaatcacagaggaagtctgtggcaaaactggaactagaacccaaatctctccatttccaatcccgtgttcttttcatctgaattcactaattcagaaatgaagccactgacatcctcagggcatcaactttaaaatgtcattatttcacactggtacttcgataagccacatttgctaatataatatttacagttttacgctaccaaagttcaaaacagttctctactttaataacatcttcagtaagctgcaacttatttccaaccaacctaatgagtgtgcaatgtatttttaccaactgaaaggatcaaaattgcaagtattcctgaaaagaagggctttcaaaagcctgcaagagttaagaactcttgtgctttctctaaaaagtaatctgagtttaaaattcaagtgcactgctgttttttacatccaaataagaatcagtaaaatatctctgccagtttcaattcactgaagtaatgtcactttaaagtgatgaaattatagtcagagcctccacctagcaaaacacactaatgcttgtttaaaactggtcctactttactcactgtattaaggaacaattctacaaaatactctttttgatcccgtgactatgtggctggaaggtggacacttagaatcacaaagcagaaatgactttaggtcgtcagaccaaccccaccgctttaaagatgaggaccaaggtccaaagaggataaataatttgttcaagatcccagtagcaaaaccagatctagatttcaagtctccatcagtcccgctgtaatccttccatttccacagtcctgagggagcctttaatattccaacatcaggaacagggttttagcagtagaggaaatttgctgaagggaaagaagcacggactgaaggttattttgatggatgaagtggaaaaataatagaaataaggtgacaaatgagcgtgggattggaaaaagagaggaggcagaaacgtcaaaaggtataaatacgaagactatctactgaaaatggctgtgtatctacccttaattcacataatctaaaatacaataaatattcaaaaatggaaagtgacttcgtatactaaagggaatttttataaaaacaaagagaaactactagagataactacatgtatttactagaatagaaaacgtctagtacctgctgccctgggaactactgtgaatgtgcgtgttgggcccggatcctttattgactgagccagcgcctgcgattgctctaaatttaaggatcgtacaattagagaaacacgttatcccgggacaagaaaaccttattttgtgtggttaacacggcgggtctacaccaggccaataagctgctcatgaaaacctcacggctggtcagccagaaaacacaaagcttagggacgaaacgtcaacagagtagacatcagttcaggtcagccggcaacgagggaccgaaggatgacatcgcgctccagttccgcctccccggcccagcccccaagcgctccatctccgtgccagggctccgcagccgcgatggcgggctcggtgtcgccggagcggaggggcggcctcgggccgggcggccagggcgccagactccagatgcagcgacaagcggcccggagcccggcactcggcctcctccccgcgtcagcgtccgcccgtgggcccggcctcctcgcagctcccggggccctgctgccactcagccccacccggcgctgaacccagcctttgactcaccaccgcccgacagaatgcagaactgcgagaggaagagcagcacgcgacacaaggcgcggaggcccctcagcgggagcacccctcccgccatcttgccagcgcctgcgcacttccgggccggggggcggggcgcgcctgggagccggagcgtgaactggacgcaggcgcgctgcgactcctggcggccggcgtttgcgctttcgctgtcctcgcgcgggtcgcgggttttcttccggttgagccttctgggaggtccccgaggaggatgcgagcctgggaggttgttccatttccacgcgcccctcacgcccttggacgaggccctcacccctggttccactgcaggagacctgttaaaggtcatccgtggaccgaaatgcgcgcccgaagcaaccaagagcagaggcgggcgaacgcgggaggctggccgccccagtgtgtggtcggatgttgtgtgctggatctcgtgcgaaggttccgaggacactatcgcgtggcgtttcatcctaaagacacttatttacagtcggggaagcggccccgggacgacgagggcccgagggacccctcccctggggccggcgctcaggcctgccgcggctttcacttctggccggcctcttgaagatacgcagcacttccagaaagttcctctcaggcctggagaagcaggatggcccgaggcgctgggaagtgaggggagggtccagagcccagccctgcctggggaaggtcgcggccgtctggggagccgcgctcaggccccagcttgcggagacccttgccggtttctgtcacagcacacctgggagaaagcgctggtgacaggtgctctcctcccacccacgtgcttcgggatcgttcattccgcggtcttctgactaccaccccctcacgtgcatgtttgctgaatgactttttaaaaaatacatggaaaagtgccggcacataagccctgaatgttagctttaaaaatcgtatcacggccgggggcggtgaatcacgtctgtaatcccagcactttgggaggcccaggcgggcggatcacgaggttaggaaatcgaaaccatcctggctaacaacacggtgaaaccctgtctctactaaaaatacaaaaaaattagccaggcgtggaggcacgcgcctgtggtcccagctactggggaagctgaggcaggagaatcgcctaaacccgggaagcggaggttgtagtgagccgagatcgcgccactgcactccagcctgggtgacagagcgagactccgtctcaaaaaataaataataaaaatcatatcacacaatctgcaccttatactactacacaagcctgatatatattgttttgtttgccaactgtttcactgttcacatccctcaggaagttaactaaatgatcagtatattgaaaagagattatttcttacatttcttttgaatttcacagcatatcgcaaaataaacaatacttcttgtttggtagctgaattctctattgacataatgccattttaattcagttctgagcacgtagagcattcctctctttaaaatctgaaatccatttcagtacataaatccatggaatgtcatcccatcaaaaaagtaacaactctaggtgagcggcttagtggtggtagaagcccacagctgaaacgctggaaacactgatgcaattcatttgggaatttatttttttctaaagcggaacaaaacctaattatgaataagaaacatttaaatggcaactcttaacctatagtgcaaacaccagattccacaaaactgaattcctttgtcagtaatccaatatttagcagtagctgctgcttttgtggttgttggttagttaaaattaagtaatgattccagtttagaagataaagtttcagtgtgaattttagtagaagtcataaaaatacctgagacatattagaaaataagattttccctcctatttaaaaaaaactctgcagacttttatttgaagcccatcttttgaaaatcactaacatttcataatcatttcctagtgttttgtttcactttctcgatgaataatatttccccatttaagtttctcaaggcattgattgctggaaaatttcccacgtgccctctaaacgtcccccgtggacatgagtaaattaaacttcgtgcatgtcagctacacgttcatcgtctcctttctcagctgaggccatgagtggacccatcagtggctccaaagtcgtagaagtactaacatgttaagaaaaatacatttttaagggtcaaaacaaagttacacagaagcaaatatcagggaaggacttcaaaaggcctcctcagcattgagtgtccgtgtcttcctgagattcttcagtttatcaatggcagaagttactaaaatctctccatgaattttgttgtctcttgttcgcacgtttacagcattatctatcttttccttttctccaaccactgcagaaaagaaaggtaaagaaatgtattttaaatcagcaatttaccaaacattaagtcagcagtcccatgacatgtttttatcaagtttttcttcactaatattaaatatcatctaatgagcatttggttcatcctctgatagttaagtttcttgagggaagcaatgacttctgatcccatctctctattgtccacctgagagaacagctcttgtggtcctggggtgcagatgagaggggggagctcttacagactcacactgactgcacctggcactagggcgcaaatgagagcggggagctcttacaggctcacagtgaccccacctggcactagggcgcaaatgagagcggggagctcttacaggctcacactgaccccacctggcactagggtgcaaatgagagcggggagctcttacaggctcacactgactccacctggcactagggcgcaaatgagagcggggagctcttacaggctcacactgaccccacctggcactagggtgcaaatgagaggggggagctcttacaggctcacagtgactccacctggcactagggcgcagatgagaggggggagctcttacaggctcacactgaccccacctggcactagggtgcaaatgagaggggggagctcttacaggctcacagtgactccacctggcactagggcgcaaatgagagcggggagctcttacaggctcacagtgactccacctggcactagggcgcaaatgagagcggggagctcttacaggctcacactgaccccacctggcactagggcgcaaatgagagcggggagctcttacagactcacagtgactccacctggcactagggcgcaaatgagagcggggagctcttacaggctcacagtgactccacctggcactagggcgcaaatgagagcggggagctcttacagactcacagtgactccacctggcactagggtgcaaatgagagcggggagctcttacaggctcacactgaccccacctggcactagggtgcagatgagagtggggagctcttacaggctcacactgaccccacctggcactagggtgcagatgagagcggggagctcttacaggctcacgctgactccacctggcatacctgatgagccaaggagtggacaccagacccatgcgagccagccagaactttctggaatgtgggtaaaaagtttgttctctctagtgacccatattgtgagatgatgcaggaatctacagccatgcttcttgccacacagaaggaagaaaccggtctgcagataagtggaataaggtagatattcaagagaagcataaagaaccagagcaagacaggaacgagaaatggggagaaatactcctggtgagggttgagctcctgattgctcttctagtggtttggctatttaattctacctttcatgtcatgggatactccaagacccttccaacaaatgctgtctttgtctaaaccaagttgagatttctgccaccataagaagcctgactgaaacagcacaatacctactctggtgtcaaacattatcattgaaacactgtcaatagaacaatgctatgcatatttatttcgccttctacagactctcaacttacaagaaatagcaatactgtgcctgcagttatatcagtgttagtttctcttaattttggaatcatttttaaagcctaaattttagattctgcatctaattagtcatatgctaaaaggacattttacttttcatctaaatcttttcctttagatcattttaaatttgggatcttttctttctgttagtttaatcccaaagtttcctaataagccagaaaagtgagggaaaatattacaggcctgtgaggctgaaatataaagtatataattctactgatgggatcattttcagagttgttttcgttgtttgcttgcaatatgaactattgctagtaaaactatcccaggggattcaggtgaaactttacaactcttcttccagcaaacaacaaagagtacctaggaacagctaagctaggaatgctatggactcttccttttgtgtaagtattaaatagacaaatcatgataatcaagtagttgaaccatatttcttatttggtcttttggaattgaagtgggaaaaaaaagcatttggaaaaatatatacaaacttaaattacccaaaataaaattatactgagccagctgtgcatttcgtattttcttatttagtgtacaactgtgatccaagtcaacgtcagccataaatccttcttcaaaaaattcactggatacctagaagaaaatgaaacacctttactgttacattatggtacctagcctccaagaagaccccgttgttccccactcttggtattcacacctttgtatagttccctgctcactataccagagcgggtctgcgtgaccataaagaagtgcggaagtgtcggcgcatcgtttctgagactagtttataaaaggctgcagctcccatctctctcagatcacttgctctgggggaaaccagccaccatgcagtgaggacattcaggcaagcaagcacccaggtgatgaggagctgcatccaccaactgtgagcgagccccgagctccgcagccctggctgacagcctgactgcagccccaggagacgctctgcgccagaatccaccagctgagctgctcccagaccctgactcgtaggaactgtgagatcatcaatgtttgttgtttaaagctgctaagttttggggtcacttgtgacacagcaacagataatattcttccctaatagagctgtgtagaaatgaataattatgatatgttttaaaatactaatttctcaaaaaacattaagaatgaaatagttctgagacagctgcagagacatgattcgtgtgttactcccacctgctgaaaacacggtttaagctaatgtgtcagttctgcaatattttaaagcatgaaggacactccaaatcgatgacctacacagaatacatgcaagattattatgtactttaaacacctctgattttacctgaagtgcatatttttcacaagttggccccacagggatgaccatcacctgacgaggagatagccagaaaggcctgaaaaatatatataaaatatgtattttcaaagtgtaataatggctacttattacatgattttcaaataaccaaagattcttttaaagacttcacaagagggcagtttcagtagcgcagcatggaagaaaactaaattatattaaagtttgaaggcagcaaagtaaatgaaaggagaattttggaattttgatagcacaagtgcaggtagaatgagctggcagacagcccaaagggctgagcatgcacttactgtctgccccagcaattgcactcctggcatttgtcccagagaaatgaaagcgcaggttcacacacaatactgctcactaacgtccatagcagctttatttataatagccccaaacaggaaacacacaccccaaatgtcctttagcgggtgaatggccaaactgtggtgcatccacactgtggaacgtggaacaccatcagcaaaaaaaaaaaaaaaaaaaaggaaccaactaatttatctcgaaacaaaacaacatggatggctcttaagggaattccactgagtgaaaaaaaaaaagcctacttcaaaagtttgtgtactctgtaaatccatttatgtaatattctttatatgacaaaatgatggagctagagaacaagttcatggctgtcagataggaggacagggtgggatggtttgagtgtggggaaaaaagggcagcaggagggagccttacaagtgatggactgtcctgtgccttgactggtggccttacaccatctgtccgtgtgacacagctaaatacacgttcacacaaatgagtgcatgtgaggctggtgaaatcggaacaaggttggtggacagtctcaatgtctagttcttggctgtgatattgtatctagttttgcaagatgttaccattgaggaaaactgggtaaagagtgtgctggacttctctgtataacttcttttttattttttttgagatggaatcttgctcacccaggctagagtgcagtggcgtgatctcggctcactgcaacctctgcctcccgagttcaagtgattctcctagctcagcctcctgagtagctgggattacagccattgccaccacacccagctaatttttgtattttcagtagagacggggtttcaccatgttggccagactggtcttgaactcctgacctcaggtgatccacccacctcggcctcccaaaggttgggattacaggcgtgagccaccacatccggcctctatataacttcttagaacaacatgcgaacctacaattatttcaaaatataatttttctagaataaaaaagatggcagggtaggtataaacagtgtccgctgtgggacatgtttgccctttccctgtcatagtgagtatttagtctgaaggtgaaaggacatgcaaggaggactatttcagatagcattttataaatgtgcatatttatatatttattctcaaattacaaacacaaaacaatacatgataaatggtagaacacagaaatacagggtatataatggcaactacatatttccttttgagctctgtccttatcccatccccagccctactcctctcaaggacccacactttagccatctttacttttggctcctggggagatttccccacaaggctgactgctgtctgaagtctggatgtatgaagtgcagggagtatacttccgtctctgcgacaaaggaaggcatgctcagtgcactggccccaaccacctcctgtctccctctccatctcctatttcactagttctctctcttttctttaaaccactttcactgcaaccattctaatgcaaaacaccatcatctcttacctatggtaaactatttaaaaccaactggaaagaaatataaacatgttaactcatactcaggcggcatacatattcatacccatacttttggcttaactgtaacttcaacagcttagaaactccatgatacctaagtatatttctctatgatcacaaaatatcaggaatatacacagactctctagctacccaggtcttttggaagacactttgtttgggaaactttccaccttatgtttcctgctcaaaaatttgcttccccagtctcgctggacatgaatggtagtatgcatgggtgtgatctaggttctgctaatgtataaacatggcactctgacttaagacagagtggagaaggaggcaccacatggaatccattatggcaaggaaaggtgatgcagagacatggagcttttggaggaactggttgcagtgaccctagcagtatcatccggtgcccagtgtccacagtgggagctgcagggactgtgcccggcaatagtagcagtgggggcagtagtttctgaagagagagctaaactgcatgagcagatgcttagccaatttctaaaaatggaatgggaggtagaaatttcacaggtggttgctggtttgcagcatttccacatactaggatacatcatcacaagatgttgtctgccagctggtgctataactgctagtaaagccacttgcttctgaatgcatggtgatagtagtgaatcccttaatgtcagtgcaatgctttacttatttgctataaaatctctttcatagtcagaagcactgttgtgttcctggcagcacctaagtacatatttggtgccactggcagaagcatggcagcaaagaagagcaaagcaaaatccacagtgagtctctcttcagtgagaatgaggcattgctccttacatgatgaaagggatccaacgtaatcaacctgctacaagaccactggctattaccccaggttatggtaccatcccgggggatcacaattaatcactgactgatggcaacctgaattctcagaagagatgtagccagatggaacttagtgaggcaaagtccatgtctttgagcccatgcctatccaccagtggccactttgcccatgagccattgagcaacaactaggggaaaaagcagctgattttaacagaatgggtcctcttgtattggaatactgaaaaattcctcaacagcgggggccttttggtggcaataccacctctgttggcccattctgagtgatcatccacatttctgcttcccaaatctatgtaatttgtttttcaatctaattagttctaaatctttgactctgtggccaaagcagtaactagagcctgtgcatccatgtaactccttatctccggccattcttccttccgggcaaaaaggaccacaggatgcaccactcaaaaaggaccacaagatgcaccactcaaaaaagaccacaagatgcaccactcaaaattctgcactttaggacacttcccttccccactgtcatcctaaatgggctgtgctgctgagccatcctctttgagtttgtgccatttatgaatcaggtttacatgttttcctcctcagtggctgtagggaaccccaaaggcaaacaatatgggttgaaggaaggatggctggagggcaagaggtggtacctaggagtgtgggtcacatgttttcaggacagcaactagatctctgaagggcttgaaacaggtaaaaagataactttaattctaccgagtcccccaaaaggtaaatggtacagttttatgccactctcccttagtttttattttctgatctggcaaatcgaataagaattctttatttgctgtttggacaattgctaattacaaggcaggaaaggccctttcttttgttactacttttttcttttacacatgattttttaagaatagaaatatttttaaaaaggaaaaatgagtaaattaataaaaattaaaaagaataatagacatatagtttttcttttccatatcacttaccattttccgccatagttttctgaaagaatggctatcattctttccactgatcccaaaatggctcgatgaatgatcacaggtctcttcttatcatccccatccttactaaaaaatgaaaattatacatttaagtcttttcctaagattcaataactatcttctagccttatatttaattttgagaatagatttagattagtgatatcagatctctccattaaccttatttgttctgtgactgtcttgttttctcattgctttctttgctaatcttttttcttttattttaaaaactttttattagagcgcactgaaacatatacaaaagtagagagaagagtataatgaacttccacataccctctctcagcttcacaaaatgtcaactcacagccaatctcatctgatccaaatgcacccccattcttgccactatctcccacattataatcttcatttttaaaatgttcctgatatgtgttcttgaagtccactggtcaaattccctgaaaccctcatgaggtgtatcttacatttaattattccctcttccccttaggaaaaaaaaatgaaaaaagcaaatgatgacttaattgtaatgaagtaagccacttcaagatctctgcacaagcacaagcttctcagaaagataaatttcacattattgcaacaaatgtgacatgcgacacttacaaagttcttttgataaatttttatctaaaaattataccagctagctactactacaataaatgaaacaaatttaacaaataaataataaaataaaacaaacaaaaacagagaaacccattcattaaacctacttcaaatgagttgtaactggatatcatcactgccaaccatttctgctaagagccattatagaataactgcaggcaaaactctctgtctggaccctacaggaagctttggggtaggggtgagcggcttgagtccattcctatgcaggtatatgaagaaattcatcccaaaaattgaaaccagtatgaaatattcctgaatatcccatcatgttgattttgtgtagggaagaaagagaagcaaactgatcctttcacagagcctgggtatccaaaatttctgtcccatcatttctttgaatcatgtctagacttaagaagagcaaatagtgacataaactatgattacacatctgtgctatcagataaacattggaatgaatgccaaattcccccaaaataaccccagtggatttgcttacaattatattagattaatagataaatttgaagagaataacttcacaatgttgattcttctcattccaaagtgtggtacgaatcttcatttaaataactcttttttgtggtcttggagaaaaacttatagcgtatgcttataaataacatctatagtcatgtgttgcctaatgacattttggtcaacaatggactgcagatatgatggtggtcccacgagattataaagaagctgaaaaaaatttttttttaaattatactttaagttctagggtacatgtgcacaatgtgcaggtttgttacatatgtatacatgagccacgctggtgtcctgcacccaaggaagctgaaaaattcctatcatctagtgatctgtgttacaagtacctagagcattcagtacagtaacattctgcacaggtttggagctagcagcaataggctatcccatacagcttaagtgtgtagtggcctatgccatctaggtttgtgtaagtacactccgtgatgttcacacaacaatgatattgcctaacgacacatttctccaaacatatccctgtcatgactacatttatggggatgcatgactatatttatatttattaagtttattcatattttctattttgtggttgctgttgcttctgaaatgttttttccattgcatttcctagcagattattgctaacattatgaaggcaaattgatttttgcatttttaccttccattattattagtgcccatttctccatttgattctgttggatttctctatattttaacatctactaataataattttatctcttgctttcatgtatttgtaatcccagaataattttgagtaacaatacaaatagtagtcatattcgtcttcttcccaactgtgttgagatgctattgctgttttctgataaaagctctttatcgtgataaggaaatttctgttcatttcacaggaatgaatgttaacttttatctgatgcctttctgcatgctgaatgtaatgaatgacaacagcacactctcatccacccctgcttttttagggaaaaacccttactcaatcatggtgatgaccttgatgcttctctctctcctctcatacataagcctgagcaaatcacatcagttcttcctccaaaatacacttccagtacccctactttgttcatctctatgccacctggctccaactgtcatcatttcttacctggtctgcaatccactgcttccacctttgcttgcctactcgccatttgccacacaacacctatgatggctggctgggctgatttgtttctcctccacgtcctccttaaatgagtagtttcacttgcattctgatggccctaagcaattttgttgtaggactgatcctgaaggtttgactttctctctaatagttctgacccttgctcctccaaaacggagagattagacttttcggagtcctactaactccactgtaccaatcaggcaaaaagttagaggtcaactcccagaagcttttccgttttggcacacggtatgacctatgggacttggccactgggtggcgaacacatggaacagatgtgaatatcactataaaggcttcgataactgaactgacaccgaaccgcagcccacaaaagtgggctggaaatttccacctgaacctaaccaggcagattcactgccaaaacaagacaaccgccttaggatttaaacaagacacagcatctcataacataatattcaagacattcaggatataatcctaaattacttagcatatgaatcattaggaaaattttcaatttgtgagaagaaaagacaaacaacagtccagcagcaagaaaacacaaatgatggaattaccaaaggctagaaatagccattataactgtaccccaggaagcagggtaaacacacctggagtgactggaaagaccaaagtctcaggaagaaacacaaaacacgaacaacagagattgtagaactgaaaactacaatcacagaaagttttaaaaagtcattcgatggattcagtagcaacagagatggtaaagagttggtgaatttgaagataagtaaatagaatgtatccaatctgagagatatacaaagaaagactgaaggaagcataaacagcctcagaaaactggaaaaataccaaaaggtctaatattcaggtcacctgcgtcccagaaggagcggaggtatagtaccaaagaaatatggaaaaacaatacaacgtttgcaaaccaataacttacagattcaggaagttcaaaccgccacaacatagacttgaataagtccacagacagacacatcacaatcgtgtgacacataaaggaaaagtgactgcaattactgcatatttctcatcagaaaccataaaagccagcagcatgtgtaacaatattttttgtttttactttgcaagaaaataaattatataacttaaaaaataaaacccccaaactaagcagttcatcaaaatatttcagcctacagcctacagaaactgctaccatttaaaattgtacagcgttatcatctcagcgtgtagtggcacacgtgcaaatagcatagaccacatgaggacagattacaacttaggaactcaaatttgttcaacactctaaacaacatacagtgtagatgacaggaaagctctcatgtaatgtttattttacaaacatgaccttggaagaattaataagatggcatctcagttatttacataaaaatagaaaaatcagcttgagtttaagacggcaaatctttctataaaactagccaatctttcacccagattgaagttttaaaatttgctctttgaaagggctaatgacatcttactgcaaataatgtaaaatattttttaactactcaggtcatattttgtattaaatttaatacaaagtaaaagtaagaaagctaagtttttactttgggaagcgttaacatttatgcacaagatgagaacaagacttgaaaaaacaagttgatagaactcgggagcccctccaataaatgcaaacattggaagacttcagaattcatttcgagatcctcactgaatcattggagcagtaatgttctaatatttacctcactgtaagcatcaaaattgttctgtattttcccttcataaattttatttcatgtctacttactctggaaatgagatgcaacaaaggttaacacaaaaatggatgtctctgtttttaaattagaagatgagtgttctaggtcaggatcggtggctcacgcctgtaatctcagcactttgggaggctgaggtgggcggaggtaaggagttcgagaccagcctggccaacatggtgaaaccctgtctccactaaaaatacaaagtttagccaggcatggtggtgcatgcctatagtcccagttactcaggaggctgaggcagaagaattgcttgaacccaggaggcggaggtttcagtgagccaagattgtcccactgcactccagcctgggcaacagagcaagactcatctcaaaaaaaaaaaaaaaaaaaaaaagatgagtgttcaaagtttgcattaacctcagaagcgtcctcttgctatactactaagttaatatatatttttaaacaatatttttaaaatattaaaactaaataactatcaacccagaattgtacaagcaaagaaggttattttctttgaaagtacaacaaaataaagacattctcagatgaaagaaaataaggcaattcatcttcaaccgacctgctttaaataaactgtttattctcttatatcttcagatatatgagaaatgatactagagggaaccctggaacatcaggaatgaaacaagatcaacagaaatggtaaatatttggtaaatataatataatgttctcctcctaagctctttaaaacatgtactatgattgaaaacaaaaataatattgcttatgaggttgttaatgtatatggcatgtagtgtgtagtatgccttccaaaatgaatttttaaataacaagacttgaaagtcaaaattgtgccttgatccatgggctgcagaatggatgttgtgttaataggcatgagaaaacattaatctccttgtacgtctccatcagagctcttggatgaccaggtgcattgtcaatgagcagtaatcttttgaaatgaatctttttttttttcctgagcagtaggtctcaacagtgggcttaaaatattcagtaaatcatgctgtaaacagacgtgctgtcatctaggctttgttgttgcatttctagaacacaggcagagtaaatttagcattattcgtaagggttctaagattttctgaatggtaaatgagcactggcttcaacttaaagtcaccagctgcattagctcctaataagagggtgagcctctcttttgaagttttgaagccagtcattgacttttcctttctagctatgaaagtcctagagggcatcttcttctaatagaaggctgcttcatatatattgaaaatctgttgtttagtgttgtcatcttcatcattgatcttagctagatcttctggataacttgctgaagcttgtacgtcagcacttgttgctttaccttgcacttttatattatggagatggcttttttttttgagatggagtttcactcttgttgtccaggctggagtgcagtggcgtggtcttggctccctgcaacttctgccttctggattcacatgattctcctgcctcagcctcccaagtagctgggattacaggcacccaccaccacgcccagctaatttttttatttttatttttgtatttttagtagagacggggtttcaccaaccatatggagttggccaggctggtcttgaactcctgacctcaggtgatccacctgcctctgcctcccaaagtgctgggattacaggcatgagccactgcacctggccctggagatggttcttttaacttcatgaaccaacctcttgctagtttcaaactttgcttctgcagcttcttcacctctctcagtcttcacagaattgaaaagttagggctttgctctggattagtctttggcttcagggaaactttctccacatcagcaagaaggctgtttcacttccttatcatttgtgttcactggagtagcacttttaatgtccttcaagagcttttcctttgcattcacaacttgggtaactggtgcaagaggccgagcttttggcctatctgggctttcaacagtccttcctcaccaagcttaatcatttctagcttttgatctaaggtgagagacttatgactcttctttaaacatgaatatttacaggctgttgtagggttattaattagcctaatttcaatgttattgtgtctcagggaatagggaaggctgaggagagggagagagattagggaggggccggtggagtggtcacaacagacgacatttatcggtaaagttcatcgttttaaatgggtatagttcatggtgccccctaaaattataagagtaatatcaaatatcactaatcaccataacagatagaataataatgaaaaagcttgaaatactgcaagaattacctaagtgtgacacaaagacatgaagtaagcccatgctgttggaaaaatggcactgacagacttgcttgacacagggctgccacaaaccttcagtttataaaaaatgcaacgtctgcgaagtgctatacagtgtgaagcatgataaaacaagctgtgcctgtatatatatataccgtcatgcactgcgtaacagtgttctggccaacaacagagcacatacatgacagtggtccagtaagattataatggagctaaaaatcttcccattattcaggtgtttgtggtgaggctggtgtaaataaatctaccatgctgccagctgtataaaaggacagtgcatacaattatgtactgtacatcatacttgataatgataataaacaactgttactggtttatgtatttactacactatacttttaattgttatttaaggtgtattctttcacttactttaaaaaaaaaagttagctgtaaaacagcctggggctggtctttcaggaggtattccagaagaaggcactattatcatgggtgatgacagctccatgcgtgtactgcccctggaaccttccactgggacaagatatggaggtggaagacagtgatatcgataaccttggccttgtgtaggcctaggctactaggctgatgaatgtgtttgtgtcttagtttttaacaaaaaaacttaaaaagtaaaaatttttgaagtttttaatagaaaaatgtttatagaataaagagataaagaaaatatttttgtacaactataatgtatttgtgttttaaggtaagtgctataataaaagattcaaaagttttaaaatgtcaaaaatgtataaagtaaaaaagttacagtaagctaagcttaattaactattgaagaaaaaaattatttaaatttagtgtagcctaaatgtacagtgtttataatgtctacagtagtatacactaatgtcctcggccttcacatatacttacaacttactgactcgcctggagcagcttccggttatgcaagctccattcatggtaactgtcctaaacaactgtaccattttttatcttttatacctaattttactgtaccttttctatgttgagatatgttttgatacacaaataccttaccactgtgttacagttgcctacagtattcagtagagtaacatgctttacaggtctgtagcctagaagcaatagtctagaccatattagcctaggtatgtagtaggctctaccacccaggtttgcgtaagcacactcggtgatgttcacacagtgaacaaagggataatcagtggtcccatagaacagaatttataatctagaaacagacccacatatatatgtccaactaatttctgacaaagatccaaaggcaagtcgatggtgaaatagtggcctgttcttacatcatctgatgtgtgaataatgagacacttagatgcaaacaatgaatcttgacccaaatgtcacatcttacacaaacaatgaactcacatcagatcttagaactagaaaacttttaatataaaacatagaagaaaatcttcatggcctgtacttaggcagagcttatagatatgatgccaaagcatgatccataaaagaaaaaaatggagaaattaaactttattgtatttaataactcaggatgaatgggaaagtaaagatattacaaaaaatgaaaaagcaagctacagaccagggtaaaatatgtgcaaatcatatattcctccaagggctagtatctagaatatataaagaattctcaaaactcaacagtaaggaaacaaatcactcaattaaaaatgagcaaaaagactttggcagacttttaaccaaagaggataaatgaatagcaagtaagcacatgaaaagatgttaacatcattagccactaaaaaacatgtaaaatcaaaagataatgaaatactactacacacctattagaactacttaacaaacaaaacctgacaatatcaagtactggcaaggatgtggaacatctggaactctttacacattgcaggtgagaatgcaaaatggtgcagctgctctggaaaacagtttggcagtttctacaaagttaaatatttaattatcatatgacccattcccagttatttaacctaaagaaaacttctattcacacaaaaacctatacactaatatctacagcagttctattcataatcaccaagaactggaagcaacccaaacacccttcaatgagagattggatccacaatggcacactagtcagtgacagaaaggaacaaactatcaatacttgcagaatcatggatgaatctccacagcactgtgctacgtgaaagaagccagtctcagaaggctcgatactgcatggctccgtttacatgacattctggaaagggcaagactatggtgatggggagctcattaacggcagccaggggttaggagtaggaggagtgtgtgactacaaaggagcagcacaagagaacaacagaatcataaccatcaagctgtacacacaacacacacacacacacacagagttaattttactgtattatttttaaagaagttgttggtttacagtgataaaattgccttttttcccctgctttttcaagaaaacatctcatccttaagacacagacccaatgccagcattttgtgaagtcttccccctgtaactcagggagagtcagcagcctggatcatattttcatggaactttgttcatatctctactctcatgtttacttatcttcctcccgctactagaccagaaaattcaagttgattcgcaactggattatgatcaggtaaacaaatatatattgcgtgtatagcacatatactagacattcactaatgtttatttttgcattgctaatactcaaatgacaaaaaattagaatattagtactataatatttatcacattcaatcactcacctaacatatgtgagattaaatctaataggcagttggaagtccagctgaattgtagcacattgatggtatctgccaatagcatccttgatttttatgtcaatctacaaattaaataatgtttgctcagaaaagagtatttatttttcttttacattttgctgttttgaagcatgtggtcgactcactttagggccataaaatgctccatctcctgggttcattttccacggttctccaaagtccatcaagctgttctgcagttgctttttcaaaagaagaaaaaagatacaattatacactgtatcttttttttttacatacagctcacaaaagttactataactcttcattacagtctatgttagttcaacatatatttattgagcatcttttacattcaataaactattgagcagggactacacagagatgattaaggtggcacctgctctcaaagaaacataaacatttcaactggggagaaaagatcatttataaattgttccagtgaattccaggtaagcattagggaggggtcgcttttgaccctcctcccaacacaggccccctgtgccctacacatcaaccagcttctgcctcctggtgacgggcctccacacatgaaaaagcagaaaagccttgatcacactccctcttccactctgagtctgggtgggtaagaaggccaagagggcaggccttactacttcctttttgcctttccttcacctctgcacgtgtctgggagggtcacttataatttataggggtgtggaggcatgaggctccacttttgtcttcagcctaagccaccacatgccttcaacttagcttgtagtgaagatgttccacattgaaggtgaggatgcaagtgtattaatgaaaaatttcccagagtcttccagtattcccgtgaatccagcttccctgggaagcacgtgggcattcctgagtccttggccaaaagtactgccaaaacacgagccaaactcccatcatcacctccaacatacgggtgcccatgagggggcagacttgggagtgacgcgcctcatggggaaatcagagccgtggcagagtcttagggccgaagctgccatcatcaagaaagctgactcctgggaaagctgactcctggagtcctggcagcctttcccaggacctcagtcaggatctgatcttgagagagacggagatttttttcctgggatcctgggagtgtcccgcataggcctgatcttacagaagcagcttcttttctacttaggaccagagaaagccaccccacggagacacttccggggcctggaggctgcgctcccctgttccactctgtttctcaaaggagaaggaacacaggtacatgtttccaggacaaatgaggccctcctacagcagataccaagtgatggaaagaattctggggactgcaagaagctaaaaagccaaggaaaggccaagttttggagaagaggataaagcaggggtcactgctgctcctcgggccttggaggacacaggacaggagggcacagtaggagctgccagagccgagagagcatcggatacatgaagatgtgtctctttcaaaccatttcagacacttctgaagacaaaatatttcaatgctcacctcagtgatttccaggccagggttagttattggagagaaatatctcaaaagtggaagcaggtccatccagtcacacccctgggtgacctcaggcttggctgctaaactatttacccccattaattaagaaaggagcaaaaatgctgggacttccagcctattctccccatgccaggtctatacctggtccatccccttttcagctccccacaccccaccaagtttcaaatgaatggagtaatgacaacgataccaacacctgacatctactgggcacttacacgtgcctggcactatgcctaacactccatgtaaattccttcatttaagttcaccataccctcaggaagtgggtgtcattgctacatcaccaccaccaccatcaccaccatcgttatcatcatcaccatttcatgctggatcctgatgcttatagatcttctataatttactcatggagataaagtactttcagactttaaagtctggagcaaatggctccagagctgagctctgtgtcctcatttcctcttcctgcttccacatggctgttaggtaaactgagtctgcatccttcccagggtagataggctatctcatttggccctctttgtccatgcagtggatgtggaagaagagcttaggatgggcacgggtcagtggggaggagaaggccctccttagagctcaaggctaaactgcttctgtgcagcctctgctcggcttctgcacctattaatcacgtaaaaataattgttatactattaatccagggcttctctgattcttatttctcatattggtgtgttaagctcccaggagtacagtagtcccccttctctgtggtttcatttttctcagtttcagttacccgcagtcgactgcagtctgaaaatattaaatggaaaattccagaaataaacaactcataagttttaaattgggcactgctctgagcagcaggataaagcactctcctactctgccctacctgggatgtgaaccgtcctttcgtccagagtctccatgctgggtgcactgcccacctgctagtcacttgggagctgccatgtttatcaaatcaactatgcagtatcacagtgcttatgttcagtcacccttattttcctgaaccatggcctcaaagcacaagagttgtgttactagcaatctggatatgccagagtgaagccacaaaatgcttcctttaagtgaaaaggtgaaagttatccatttaacaaggaaaaaagactcctatgctgaagttgctaagagctatggttaaaaaaaaatcttctatccattgggtaagttgtgaattagtgaagaaggaacaagaaattcatgctagtttttgctgttgcacctcacactgcgaaagttccagccacagtgcatgaacagtgcttagttaagaaaagaaagggcattaaatcccagcactttgggaggccgaggcaggaggatcaggaggtcaggagatcgagaccatcctggctaacacggtgaagccctgtctctgctaaaaatacaaaaaattggccgggtgtggtggcgggggcctatagtcccagctactcgggacgctgaggaggagaatggcgtgaacccgggaggtggagcttgcagtgagctgagatcgcgccactgcactccaacctgagcaacagagcaagactccgtctcaaaaaaaaaaagaaaaaaagaaaaaaagaaagggcattaaatttgtgggttgaaggcatgaacagatacgtgtccttaacctgattgccatcaatttggtaccatccagggttttgggcatccacttggggtcttattcccatggataagtggggactattatattccaagaagaggagaactaacaggcagagcagggtgtctggccatgacaccatcctcatttttaataaaagtgaacacaggaaacacactatatcctttgtgtttattaagaaaaaaaagcaatgtgatgatctccttatcttggttttgcaaagcttagatgtaacatctttgggcttgagtgtcttcagacagacacagggcagggcacgacaggacgtgactacgaaggggactatgcacatctacatctagaccatgcagccctgggactctacagtcggactaagatgactcaacaggcaatgctttaaaataaaccacacaaaccgagagttacagcaatcagaggatttctttaaaatcctgggccagctattagtgaccagcactgcaggactataaataaaagccagatatgaactttaagtgtgaagcaaatgtaaggtattattatcaccgtcacaaagataatgggataaccacattctacaacctatatatctatctcataatttccaggttcaaaatttctattacaaattattgcatcctcctgtgaagactgcagcctctcaggtgtcttccatacgactaaaatgaagaggaagcacaaggtgtgtctcttaccttctcagcctcattccacatctcaatctctcctaggaagttttccggccttgttgacaggtttaattgaaaggagaagccaaatgttgagtaaacagattgcaaaaactgcaaacacccctttatttcttcttcaatctgaaatcaaagcaaatgaaacattcaaatagaacatcaaattcatttatgttttaaaaaatacaattcttcatgtcagacagaaataaagcatgtttttaatggagtacagttgatgatcctgttttggttgcttatccaatcctgagctgaaccttcgtttgagtgctaggcacgtgcagggaatggagaaggagtaggcgagggaaccgtactgtgaaaaggcagcgccgcgcacaggagagcggcacggaggggctgcccagaggaagtgagactgagctgcagcaggggacaagcaaacgctctgcatggagcggaagctcaggagctctgtgagcagaggacacactgagttgaaggctccgtggacagaggagcagactaagtcggggggctgcatacgatgggctgaagggcagaggggcagtgtggtaggtgggcaggggccagagaaaattaagtgctttcaaagccaggcgaatgtatggattttttaggctgagaacaacggggaggcaatgaagggtttttgttttgttttgttttgtttaagcaggggactaacatgagtcaatgtgttctttcacagtatgtggaatgaactggcaagattagaagagagccccatcaggaagctggctgagtcaattaggagcaagatgacagtggcttaaaccagagagaggcagctgaaatgcagggaatttgatggatttgagacatcaagtctttcattcattaactgcaatggctagttttttgttttgttttgttttttgagacagtcttgctctgtcacccaggctggaatgcagtggtgtggtcttggctcactgcaacctctgcctctcgggttcaagcggttctcatgcctcaggctcccgagtagctggaactacaggtgctcgccaccatgctcggctaatttttgtatttttttttttttagtagagaaggggtttcgccatgttggccaggctggtctcgaactcctggcctcaagtgacccacctgcctcagcctcccaaagtgctgggattataggcatgagccactacacccttttttttttttttttaagttcctgggtgcacgtgcaggatgtgtagtttgttacataggtatatgtgtgccatggtggtttgctccacctatgaacccgtcacctaagtatttaagcccagaatgcattagctatttatcctgatgctctccctccctcctcttccctccgacaggccccagtgtgtgttgttcccctccctgtgtccatctgttctcattgttcagttcccacttataagtgagaacatatggagtttggttttctattcctgtgttagtttgctgaggataatggcttgtgatggctacttttaagtgttaactcgactgagctaaaagatgccagacagctggccacccttacaacatttatttctgggaatgcctgtgagtgcgtttctcgaagagatgagcatctgaatcagtggaattggtaaacaacttccaccctcaccaatgtgggtgggcctcatccaatctgttgagggcaggaatagaactcaaaggcagaggaaaggcaaattctctctctttttgagttgggacatttattttctcctgttctcagacactggagctcctggttctcaggcccaccaactctgggacttacaccagctccctcctttgctcaccccactgaggcttttggccttagactgggagttataccatcagctttcctagttctccagcttttttttttttttgagacggagttttgctcttgttgcccaggctgcagtgcaatggcacagtctcagctcaccacaacctccacctcccgggttcaagcaattctcctgtctcagcctcctgagtagctgggattacaggcacatgccaccacgcctggctaattttgtatttttagtagagacagggtttctccatgttagtcagtctagtctcgaactcccaacctcaggtgatccacccacctcagcctcccaaagtgctgggattacaggcacgtgccaccaagcctggctaattttgtatttttagtagagacagggtttctccatgttagtcagtctggtctcgaactcccaacctcaggtgatccacccacctcagcctcccaaagtgctgggactacaggtgtgtgctaccatgcctggcctttctccagcttttaattggcatatcatgggacttctttttttttgggggtcattttttttttttttttgagatggagtatcactgtcacccaggctggagtgcagtggcatgatctcggctcactgcaacctctgcctcccaagttcaagcgattctcttgcctcagcatcctgatagctgggattacaggtgtgtgccaccacacccagctaatttatgtatttttagtagagatggggtttcaccatgttggtcaggctggtcttgaactcctgacctcatgatctgcctgcctcagcctcccaaagtgctggaattacaggcatgagccacctcacccagcctgggtcatattttttaatctactatgtcaatctcttttaattggtttatttagaccatttacacttaatatgttagggctttacactgcctttttgtttccttcttgttctctcttgttattcatttctgttttatttttcctgtcttcctatggattactttaacatttttctggaattcaattccaatttatctataggttctcttagtgtatccctgtctatagcttttttttttattggtttctctaggtattatataacttatcagtccagatattgtcactttaccagctcaggtgaagtacaaaaacttttattccctataccttaccccatttatagtataattttcttaaacatttcttctacatacatttagaacatcagaaagaacatgtgatttttacttcaatgatcaaacataatttagaaaacgcaaaaggagaaggaaaatatattgtatttacctgtttttattttcacaatctttttcttcctaaagttccctgattcctcttttcatcatttcctttctgtttagaaaacttcctacagccattcttttggtgggtccaatgtcttgatttcccctcaattgctgaagggtattttctttagacatagaattctgggttgaaaattcctttttcttttttcagcactttaaaagtattgtgccacttccttctggcctccaggatttttgttttttgttttttaatgagaaattgctatcattcaaattgtttttctctttaaaggtaatgcataatttctctctcattgctttcaagcctttcctttgtctttagttttcagtttactatgatatatcttggtgtaggtttcttggagtttatcctgaacagctttcttgaatctgtagatgtcttttgccaaatttggcaagttgtcagctattatttctttgagtactttttcactcccaccttcagtctcctctccttccaaaattatgatgatatgaatgttagatatcttgttatatcccactgttctcaggctctgttcttttctctttcagtctgttttctctatgtttttcagattgtgtaatttctgttcttgtcattatgtctgtcttcaccattctgctcatgaatctattcactgaatattatatttctcagttcaaaatttccatttggttcttctttatatcttctatttctttcctgagattttctgtttcttcgctgactttgtaatttttgtttgtttcaagtgtgttagtaattgctcattagttagtaattgcatttttatggtggttgctttaaaatctctggcagataattgtaacatctttgttatttcagtgttaccgttcatagattgtctttttaaattcaagttgagatttttcttgttcttagcatgatgagtgattttcaatttcttaaacctggacattttcggttttatagtaagcctctggatcttaaatgttgttttagctgacttccactgacactcttccagcagagggaggacagtactggacagttactggcaagtgggaaaagcagtccaagctccttttagaaaggaagtaaggggagaggagctcctcgttacttctgggttgcacaggtgttctagcccccctccatggcctttactgcacacagaaagcatggcctcatgaccaattggcagtgagaaagtcttatctttccactagacgtcttctgacactactcaagcaggactggaagaggcacctcattacttccaggggagggcaaaagtccaggctccccacatagtcttcactgacactgctgggttgggggagggggatgggatcttgttaatgcaggagtaaaattcccagcttcctaataagccttctcttacccattccaacaggtattgaggtacttatttagagcctgctgagagttaaaatataagcttctcaatcagccttagctggcatataaagggccacagttttttctgtggtgtctggttgaaatagagtagatattgtctaaaacttttctatctttctaggctgcccctttcctagtcctttggctacagcaagcagacttctgttggcctgttttatcgatgcctgttggcatctgttggttgccaagtctggaatatatgtggcaaaacaaaacaaaacaaaaacacctaaggaactcactaccatgttgtttcttaggtcctgatgtccatagccagtgtgccctttttctcaacacctttcagagtctcgtgtttgttttatatgtaatatccaaggtttttacttgttcttagagggaaggaaagggaaagcacctgcttcatcttccccaaagcaggtcttttttgctcattgtttaactgggttgtctgttttcttattgaggtttgaatatttgttaagtattctggattcaagtcctttatttgatatatgcctcacaaatattttctcccagtctgtaacctgtctttcctgtctatgatcagtattttttgaagagcagaagttttaaattttgaggaatccaatttatcaacttttttcttttatggattgccctttggtgtcatatctgagaaatcatcacctatcacctaattacaaagattttccccaatttttattctagaagttttgtatttttatgtttgacatttaggcctgtgattcatcttaattttttcatatggtatgaggtatgaatcctcatacctcatgttttgcatatggatacacaatcattccagcatcatttgttgaacatattacctttcctccattttattgccttcgaatcttaattaaaaatcagttgtccatatatttgtgtctatttctagactctgttttgctgatttatctatctagaccagcatgattactgtagtttctcataattcttgaaaccaagcatagtgactcttccaaatttgtttttatctttcaaagttcttttggctattctaggttcttgtgctttctatacgaattttagaatcagcatgtcaactcttacagggaaaaaaggtctgcttgggtattgactgggattgtactgactttatagatcaacttggggataactgatattttaataatatttagtcttccaaaccacgaacaaggtatatttcatttatttaggccttctttaaatttatctcagcaatgttttaaagttttcactgtataggttgtgtatgtatgtattactcagcttgggctgccagaacaaaaatccataggctgtgtggcttaaataagaatcatttattcttcacagttctgcaggctgggaaatccaagatcaatgtgccagctgattcagttccctggtgagggctttcttcctagtttgccaacggctgacttctcactgtgtcctcacacggcagagagaatcagaaagcctctggcatctccttaaaagggcactaatcgtatcatgagggttccatcttcataatctcatctacacctaattacttcccaaaagccccatttccaaacaccatcacattgggggttaggacttcaacatataaattttgggagtcacaattcagtccatagcaacatatttgtcagtcttatcccaaagtactatcatatgttttgagatgctattacaaattgtttcttatttgcaatttccaagggtttattattatgaaatgcatatacaattcatttttgtatgttgatattccatactacaatttttctaaattcaccttacttctaatagctttctgtagattccatctgatctctacatagatgatcatgtcatttacaagagttttaattctttccaatctaggtgttttttatttctctttcttaacttactgcatcagaaagaacctgcagtacaatgatcagagaagtaatgagataatccttacctaatatctgattttaagagtaaagcattcagactctcactattaagtatgaggttagctgtaggtttttcatagaggccttttatcaggttaagaaagttcccttccattcctagttttgagagtttttatgagatatggatgtagaattttgccaaatacttttccctgcatctactgagaagataatatgctttttgtctttttgtttgttttcttttttttagtttgtgaatgtggggaattacaatgattcattttctaatgttaaactaccttttcattcctgggattcagtccatttgattaagatgtcctttttaaaaaattactagatttgacttagtaaaatgttgtttaaattttttgattttatgttcatgagagatgttcagtagttttcttttaatttctttgtcttatttttctatcacagcaatattagcttcattagcttcatgaggtggtgaagatttcctcctcttcaattttctggaagagtatctctagattggtattattccttctttaatgtttggtagaattcaccagtaaaaccatcttggcctggagttttctgtgtaggaaggtttttaactatcaattcaatttctgtagtagacacagggctattcagatgatctacttcttcttgagtaaagtttaatagttttgtctttcaaagatttatccatttcatctaagctgtcaaatgtatgagcataaagttattcataaaactgccttatctttttaacagctacagaatctgtagtgatgacatctgtctcattcctgacatttttatttgtcttttttccctcatcagtctgactaaaggtttatcaattttattgatcttctcagagaaccagcttttgttttatttttactctttattttctatttcagtgatttctgctctgctctttcttattttctttcttttgcttccattacattgggtgtaatttgttcttctttttctatcttaagtaaaagctaagtcattgatttttcttttctaatgcaggtattcagtgctataaacatccctctaccacttaaatcgcatcctacaaattttgatgtgtttttatttcatttgttatataaaattgtctaattttcctttggattttgtgttatctatttttaattctattgtggtcagttaggattagggttaaacattagggttaattaaacattttattttaattgcatccctttcaactcactgagacttgttttatggtccagaatatggtctattttagtaaatattctacgtgcaatttcaaagaacaaatactctgagctttttgtagttcataagcgtgatgactgggtgtacacacatgtgtaagatgtacctccctcacacctcggtacaacattggcatattacccaccccacatgaagcacattggatacaacactggcacattacccatccaacatgaaaccaaagaatgtatattctgctgttgttatataaacatcaattaggtcaaattgtttgacagtgaaactttgcatggcaattttaacttgaattaacacaaaaacttgaaaaagtaaattttaagttctaggcgatactgaaaaacaaaacatccagaattccaccaaatcccttaaaatactccacttaatggaatttaggttaataaaatcactgaaggaatatatttcatgtcaagagatgattaatctattgacctaatttagagaatcacagcaggttagagctgaatgaatctcagagactagaccaaacgtctatgtttcagtaactctgaaagaatacaagatgtgtgcggggcatcacactcaatttgtgaccacactgcttcactctgtgttattgtttacctgctccactgtgcaaaaaatgtgagcatcgtcctgctggaagcgcctcactctggtcaagccgctgagagtccccgacagttcatttctatgcagaactccaaaatcagcaaatctaataggcatttccctccaagatcgtggacgatgggcaaacattagactagaaaagatgtggtaacacacagcttttacacagcacagaaatattaaataattatctaaatataaagaaattacaattaagcctcaagattcataaactccttattctagttcttagatcaccaggttaaaaaaaaaattcttccacaaattagtgaaccttgcatttacatcactgcagcactctgagaaagatgcttgtctattatctcttcccagaaatgctgttccctccccttatccacacagtgaatcaccatttactgtttatgattcatttcaaaggctacttcttaaatgaagccctcctagacatttcccagacagggctaggcagtttctcctcacgttcctggaacacctcaaacatgccatcattatggcactggtctttttataacagattgtctacatgcatggccctgcccactctgctcatgagttccatgagggaatggtttgtgtcttaatcacctctgcacttctagctccaagcacaaaaagcactcaactatgttctctgttgaatgaaagacttctctcctgcagaaagcactcctagcttccatatcccattgcctctaagccaccgtggtcttgctttcttattctgaggtgtaaaaagacaaacttaaattctctactttcattataaagtacgaggctataattttaaaggatgcctttgagaagatgagttaagaaattgttaacacaagtgttttacaatgcaaaacactagcatagcttctaccttctgtttagaaagagaggatacagaatgtttacataccggtgttcctaaaattaaagttatatatattttttacatgacatcatcataaagttaaatttcttctcatcttcacttaaaagggcaaagagctttcttcagtgttcagttaccggttttaataattatcttctaggtaaatttacttgaaactatgtatgttgataatacaaaaactacaattgttgggattgttttttgtggacaattatgcctattcagtttcagttgtacaatatgtttgtcttacaaggttgaatttgcataccaactttatgataattagtctttcatagaatcaaagacagcattgattgtaaaatgtatcttcattttatgtgctacaaagaaagaaaataacctattaattaaattatgatataatgctaagatgccaccaactataagatgcatttcaacttcagaaatgttgaaatgtggaagaaaaatggtatcttggaatcagtgaaatccagaaacccattgattatgacctcattgatcttgttataatccacccaaacagtatgaaagaactaaatattctgcaaatatgaacatgtgaagtgcattactataagaaagacaaatattataaaacttataaaattgacacataacattatcctttaatcagcacaaaaaaatgcaatggttaccagctaacatcccatacctgccaaagatcaaatatattttcaaaagtaaatccattctccggaatgaaacaacttagtaaaaattagtaatcaccactcttcagattaaagggactctttcattccacaaagcattaaaagataattgtgacgaagcgtgctatgtgctctcatgaaaaggtctgcttcgcttttaatactcaccagtgccctggacaattcatgggtttgagggcaaaagtgtccttttcaatctcaaaggtaaacatgttctcgctgtaatgctgccagtggcctgaggcttcccagagtttactgttgtacatattgggagagagcacctccgtgaagtcccgtttgtgatattcctccttcaagatacatgcattcaacattaaaatctgctagggcagatcacaattccatgcaaagtaacactatgagcaaatattttcaaattgggctcatgtcctatattaattcatgattaatgtaccctcagttttaggtgtggtggtttctggatcttggaagaaagatttacatatgcttagtataatttctattgagtatatttattttatagcatataacagtatatagtatataatgttttagttctttgaaaagtagtaattgaaatacaatatatatagaaactcactgtaactactccaaagtccttctaaacaggttttttcctattaagaggcagaaaaaatttataatttaataagcctgaatgccatgttgcatgttataattttgatttatttagttttaaacagaaataagaattttagtgtataacgatttaagtagttgaaattattaagtcatgagctggcctctctccctccctacctattaacagcttccctaattgaattactggagacaggagaagagagtttttttccaagcaaagttttaactttatttaaactttctttaaaaacaaaacaattaggtgatctttgttgggtaaatattttatgtgcactttccaaaaatgcatattctgctgttgttttacaaatgtcaattaggtcaaattgttttgacagtaatttgatagggaccctttgcatgacagttttaatttggatgaacacaaaaagctgaataagtaagaattctgagaatccttagattctcaacatttgtaaaccacttaatggacatctggcccaaatctagaatgccatgtatactttgagcacatttgaaaaactgttttcacagctaaaaaaacataaaacataacattttaagattactaacaatggttttatacaactgaaaggaatgttgtctgttattcttcagcagggcatcctggcagtccacggtagacagcttaggtctcggccattcagtgagctgctttacctatcctttgtttttactaaattagaaaaccttaacaggtagggtgtggtggctcacgcctgtaatcccagcactttgggaggccaaggtaagtgcatcacctgaggtcaggagtttgagaccagcctggctaacatgatgaaaccccatctccactaaaaatacaaaaattagccaggcgtggtggcacacacctgtaatcccagctactcaggaggctgaagcaggagaatcgcttgaacccaggaggcagaggttgcagtgagccaaggtcacgccattgcactccagcctgggcaacaaagctagactccatctcaaaaaaagaaagaaaatgtttaacaaaatgatgtcattaagaatggcagtgattattggctatttcagatggttccatatattcagattaaacaaggtcccagaaattaagggtgagtgtgtgggtgtgtgtgtggcagggtgtgcgtgttcgcttttactaaaaactacttttaaagtctagctcaggagatactgctcaatgcatttttaattcactctgaatgcaaccatgttaggaatgtatgtcttcttgagatgtttagaaatgattttaaactatccctgcaatggactgaatgtgtctcccccaaaattgtgatattgataccttaaccccaaggtgatggtattaggaagtagggcctctgacaagtgattaggtcataagggtagagccctcatgaatgagattagtgtccttataaaaggattcgcagagagctctctggtcctctttctgccatctgaggttacaagaagtcagcagtctgcaacctggaagagggccctcaccagaacccaaccatgctgggaccctaatcttagacttactgcctctagaactgtgagaaatacccttatgttgtttataagctacccagtctagggtactttgttatagcagcacaaactaatgaatataatccctatgagatgaagtgtcagcaactattatatttttacataaatatataggagatatctatatatattatgctgctgtatctctccatattgtaatatacatattgttttgtctctcacacacacatataaataacagagagataaagcaaactggcaaaatattaccaactaatgaatccaaatgaaggaaatatggatgttcattgcattgcattttagtttttctctagatttgaacttttcaagagaaaaagttggggagtaaaatatgtctcatgccatgccattaatttctttctctaatgctgggaaagagtaaactctcagtgactgagcagttcacagctcagtccagtctcctgaagaaatccagataacttatctggaacattaaaaatcatatttcatcctggaaataccagtttaggttattgaaggagctgagtctctacccatacctagtgatctggccacttaaaaacatctaaatagcttctaagaatcagtgtcataaatttgttttcaagtaatttctcattgtaaaaaataaggcaattccacataaacagctcctttccaaaaccccattaaaataagagtaaagaaagtttttataagagcataaatctaccaggacaaagaaaataggagagaagatgaatgctataataagttagaatctgcaaagtaggtgatcaagtgttaattgcctcagaagacctaggaaagccaaaactaaattggcagtgggagaaacccagaagcaagctactttaactgggtatagatttctaggcttcgcattactaaggcattgttcctgtcttctgtttttcagtgtttccactgaaaatttcaatgccattcagatacccagtcctatgtctgtggcttttttctctctggaaacattcaggatattttctttatccttggagctttggaatctttcgataacatgttttggtgcccaaagtatgttttcaccaaaaactgagacatgcttgggagttgagattgtccattgcccattatgggctccctttactatagaactgatagacagaaaaggacttactacccttgatcccaattacttggggaaagacttactacccttgatcgcaattactgggagaagtcgtattgcttacaatggagtaaggaggactgtgtctggaattcagtggggagcctttgatatcaacacatctagcaacaaccatcagtgggagccctgaaaccccacaaagagcattactaaaaccttggatcctaaggacagactgaggccatccactattattggtttaactgtattctccaaataagatattttgaagtcctaactcctagtacttcagaatgtgtccttatttggaagtagggtctttatagaggtaatcaaattaaaatgagatcattagggtagatcctaatactatatggctggtctctttataaaaaggagaaatctggacacagagacagatgcacacaaggggaagacaatgtgaagacacgcagggagaacatcacgtgaagacagaggatgggaatgacgcttcaacaagccaaggaacactaaagatgactggcaaccaacagtagctaggagaaggcaaggaaggattcccccatgggttttagagggaacacagcctcgtcaacaccttgatttcacacttctggcctccaaaactgggagataataaatttctgttgttttaagtcacctagtttatggtattttgttataataccctaggaaactaatgcacccaccaaataaaacaatgcccatctggggtgccaccaggataaggcgaatgtggaatgagtgatgggaaaagaaggctctgatgtatcagcttggccctagcgtccatctacagaggctgaaacagttacatttagttatgacttttccttgcattcttacatgaagggcactcatggtggccaatggcacgattcagatttaggtgaaactgaaatgacatcaccacatgatgacacatcggctgatcggagtttgtgggaggaaaccaatgtcctcagtgtcctccaagcaaaaggcaagaatgtgctgagaggcacagggggtgagccaggctggttattttccatttgccactgcctgtctcgcctcatcttggcccattttccttccttctctgccctgcactgtgttccccaaagctgacttctgtgggctccgcacaaggcttacttgctgtgattattatttttttattttataaaatatatacttttaaacacaatagtataatacaacatgcttaaattatgtttcatgtggaaaaaaataaggtgtataaagaaaacctgaacattttctctcattccaccctttactgccctgagataatgctaatggcctgctgttcctgtatttcaaccctctcctccatgactgtgcaaacacaaaacacacatacaggattttgttgttttttgcttttacctataaaaagaaaggatacactatacatttactctgtcacttccagttttcaatggtgaggtatactgaacccccttcaagttagtatgcatagatgtatttttgtactaactgcatagtgctttattgtgtggacatgtcacaaagtatttaatccttctactattgagaaacattagacttttcatttttgaatactacaaactattctgcagtaaagtttttttctatgtgattttaattgtatattttagattcctttctaagaatattgctaggagtgtgcatttttttcacattaatatttgttaccagattagtagcaatttaaactttctctctaagtatatgataactgtttcctcacatttccttcagcaatgaaaattatttaatgggtatcaatctttttttttgaaatggagtctcgctctgtcacacaggctggagtgaagtggcgtgatctcagctcactgcaagcttcgtctcctgggttcacaccattctcctgcctcagcctcccgagtagctgggactacaggcgcccaccaccacgcctggctaatttttttgcatttttagtagagatggggtttcaccgtattagccaggatggtcttgatctcctgacctcatgatccacccgcctcagcctcccaaagtgctgggattacaggcatgagccactgcgcccggccaatgggtatcagtcttagaactattacctcagtatttatatatatatatatatatttttgaaacagagtgttgctctcttgcccaggctggagtgcagtggcacaatcttggctcactgcagcctctacctcctgggttcaagcaattctcctgcctcagcctcccaagtagctgagatcacaaatgtgcaccactacgcctggctaatttttgtatttttagtagacacagggtttcaccatgttggccaggctggtctcgaactcctggcttcaagcgatccacccctctcagcctcccaaagtgctgggattacaagagtgagtcactatgcccagccttttaaattttcttcaataaattttatttcacatatttgagattcacaacatgatgttataggacacaaatagtaaaagagttaccttttttgtgtgtgtgacaagagcagttaaaatctaattacttaacaaaactccctgataaatataattttgttaactttagtcctcatgttctgtattagatctctggccttgttgatcctagatatctattttgtatcctttgatctatatccccccatttcttccccccaacccctgaccatggtaagcactgtttaattctctgtgtatgtacctgagctctctcctttttttagattcatcagctcccctggttctcaggcctctgcactcaggcgagaattacatctccaactttcttggaccctcagatcatgggatttcttggcctccataatcacacaagccaattcctcataataaatctcttcttttctatgtatcttgttggttctgtttctgtggagaatcctgacatgccaatatactttccatatggtttctgattgggtctgaccaatgggaagttccaaaggattcacagggtagtggaagagagaggtctggatatttctttccctggttctccctgctgtgggtttactcaggttctggctgtgttccacagttacagcttctgttgtgtggcctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccacggctccaagctctctgtgggttctggtattactactccatctcctcacttctctcctccatggctccaagctctctgtgggttctggtattactactccatctcctcacttctctcctccatggctccaagctctctgtgggttctagtattactactccatctcctcacttctgcaggcctagtgatggaggggaagggattcttgctattggtaatccctgggcgctctatcatcccttgttagttaccttagccaggcccatatctccataaatacttccttcactagactctcttcagttaaacccttggagtgcatctttcaggactctccctgcagaagagctgaatgttttgaggcctgccatgttcacaaagacaagcttggtctagaaattcactccatctaaggttgtgtgaagaggaagcaaaaattccccaagtgggttattaatataacaacaagagaagccactcccctccccactccagggtttcaagacatgcatcaacaagtcaggcagattccaggaaatgcaaaaggtgtgactgagatgagctttacaaaagcaaccctcatgcacagctggtgggaatgcaaaacagtagtcattttggaaaatagtttggcattttcttataaacttaaatttaccatatctattctcacactgctaataaagacaaacccaagactgggtaatttatgaaggaaagaggtttaatggactcacagttcagcatggctggtgggggggcctcacaatcacggtggaaggcaaaggagaagcaaaggcacatcttaaatggcagcaggcaagggactttgtgcgggggaactcccttttataaaatcatcagatctcaagagacttattcaccaccacaagaacagtatgggggaaaccacccccacgattcaattatctccgcctggccccacccctgacccttggggattactacaattcaaggtgagatttgggtgtggacacagccaaaccatatcaccatatgaccctgaaatcacactcctaggtatttactctagtaaaatgaaaacctatgttcatacaaaaaactgtacatgaatgacaatagcagttttcataactgccaaaagctgaaaacaacccaaatgcccctcaactgcaggatggatctgaagcagtggtatgttcatatgatggaatactgcccagggacaaaagcagaggcccgctggggacactcaactcggatgcatctccagggtgttatgctgggtgaaagcggtcagtctctaaaggttttataaaagtatgattccatttatatgccaatattttaggggtagagaaaaaatcagccgttccctgaggtcagggctggggaggatttgattttaaaagggtagcatgagggagttttgaggggtgacggaactgttctgtatcttgattgctgaggtgataacacagttctgcatgttatcaaaaaggcgtacattttactgcatgacaattaaaaaagttaatttaaaaaaaggtaagaaaagtacagaatcagctgacagatattttccagaatgcagggaaaaaaaaattcaaggagactaacaaaaagatctatttattcactatcagttgtccacacagtcagtaactaatatacaaacaaaagttcacttgcctttacttaaacctaagtggaagtcattttacctgagtcaaaaactcagaaatcctgaaatttccctcagtgggagcagtgtgcacacccagcccatcctggcctcctacatcccttccacagaaatgcagcagttccagttctgaggaaaaggatgcttcctggtagaatgcggccatatattccatcgtgctcagcaccatgtatccccagcactctggctactactgactggtctaggactcagcaccaaggcaaaggctactgatattggaccagaccatggcccctgaggcagcccagctgtgactgagagtctgtcccacaagcacaccctctactggctggtgactaacagaaccaactggaacctcagggaggaccttgaggcacatggaagagggcagagaggaaaaaagacacaggcagatagactgaaaaatatcaagacccaacagtattcttttctccagcaacgtactttaaatatagaaacagaggcagaaaataaaaggataggaaaagatatatcatgcaaacactaatgtaagaaagctagcttgcctatgtcaacaccaaaggagacttttaaaaagatagttttattacaaaaggtcaaatagcctatgaacccatttatatgtgacacctagaaatagtcaatttcatagcgacagaaactagagtggtggttaccagaggctgggggaggcaggcatggaaattagtgtttagtgggtacagagattaagtgtaggatgatgacaaagtcctggcgagtttcggatttgcaacgtggaaagagttctggagatggaccatgacagttgcataataacatgaatgtacttagtgagaatgaattgcatacttaaaaatagttaaaatggtaaatttttatattatgtgtattttaccacaaaatggcttgaggtaaaatttacacgccataaaattcaccaattttaagtgtacaattcagtgactgttgacaaatgtatacagtcatgcgacttctgccacagtcaagatatagaacatttccaccctccaggaagttccctcctgaccccctggagtcaatcccctctccccacccactggactcctgatcatctttctgtcactatagttttggcatttctgaaatgtcatataatggaatggtgccttatgcattctctgacttatctggcttagtacgatgctttcgaggttcctccttcatgtgtatatcagtatctcactgcttgtaaatgctgagttgtattccacagcatggactttccacattatgtttatcttttcacaagctgaatctggggttgtttctggttctgtgctattataagtaacgcttctatgaacatccaaatacaagtctcagtgtagatgcgggcatatgtttttatttatcttgggataattagaagtgggggctggcgtggtggctcacgtctgtaattccaacactttgggaggctgaggcgggcaaatcacctgaggttgggagtttgagaccagcctgaccaacatggagaaaccccatctgtactaaaaatacaaaaatattagctgggtgtggtggtgcatgcctataatcccagctacttgggaggctgaggcaggagaatcacttgaacctgggaggcagaggttgtggtgagctgagatcatgccattgcactccagcctgggcgacaagggcaaaactccatcttaggaaaaaaataaaataaaaaaataaaaggccgggcgcggtggtggctcatgcctataatcccagcactttgggaggccgaggtgggtggatcacgaggtcaggagattgagaccatcctggctaacacggtctctgctaaaaatacaaaaaaattagccaggcatggtggtggcaggcgcctgtagtcccagctacttgggaggctgaggcaggagaatgcatgagtccaggaggcggagcttgcagtgagctgagatcgcgtcacggcactccagcctgggcaacagagcgagactttgtctcaaaaaaaaaaaaaaaaaaaaaaaaaaaaaagaagtggggcacgtttatctttacaggaaatgccaaactgctacaaagtagttctaccattttacgttcctaccagcagtaagtgttatacttgcttcatattcttgccaatgcctgatgtttttagtctttctatgatgggaaggggacattcttcaatcaataaccctggcatgagactctacctgaatacagtcatgtaagggacccaatgcgagaaccacccacaggagcctaaaatttggaactatgaaagacagtaatgatgaaatggcagttttaaactattaagttctgggatactttgctatgttgcaatagccatccagaacagaattttgcactggatgtaggtactgctataactgagaaataaaaataaaatcctaagctccccaactgactgaacagacaccctcttggccaaaggaccccagagaaaccttaaaaactgagttactggcagtgacaagaggttggacatgcctaattatacccactctgtcactaacaaccattaggctttctttcctaagagttaatcagaaacaagcccttttgaaagacttgttccaccactgatttacacaactgagcagcatttcttcctgttaaaagaccactcaccatgcactggttctggttggtttataaaggctgcacatgggatgcctccgtgtcctccatttgaccttttggttatacagcctaatttaaatgcattgtctccaccccaaagtgaacaagggatgcatgtaacatgcatgtttgcttactatgtatataaatgtcccccctttgtgaatattcatagctcttcttataacctgttaaatatttatacttggccaatctcatcagcataaattcctgtcttacttttccctcccttgaaatgcctgcttctggtttctgccagaagctatgaagcttcctagcctgcaagatttcaggctgcaacccctcagaagaaatgaagctctcctttacaattttatgaacctcatgattcttcagttgacataacaataacctaaaacatgtagctttggggccaggtggtgggcagaagctagaagggattcttattacgaggtgccagaaacagatggtgggtaacactgtcaccagaagtaacatggaaaacagaaagggtacccaaagaactcatggacttagctggggagacgtccaggcagaatgtagaaaatgacagccgatttttggctccctatggtaaaatacaagaaaagaggtataaaccaaacgtgaaactaattaactttttgagccaagtttagaggaaatataaagccaccaggacctgctgggttcaaaaatgaaaccttcttatccttagactgtaccaaaaaagactcacgaggcttcaggacacggatcaaattcagattataatcatcaaagcacagccttacggtaaagatcttaagggcggggctgtaagacactgtgaaaacctcagaatgatctactgtaagtgcacctagtaaggcttctgaaagtcttaggagtgtgctttgtagaccctttccattaaacacgaaggctctgaagactctgcagtgtactattgtctcacagtagcctcccaggcaaagaaggatcggtgtcagaaagatgtggatgtggcttttatctaaccgtgttgatgataaatttatagaaaaggactcgcaaagtttttaaaggaattgtactagcttagattgaaaggcagcacaaaatgaaataagggctttggattcccccagccttctacaggaaggaatcaggttgagaacaaagctaccccaggccgggcgcggtgactcacgcctgtaatcccagcactttgggaggctgaggcaggcggatcacgaagtcaggagatctagaccatcctggctaacacagggagaccctgtctctactaaaaatacaaaaagcctggcatggtggcaggcgcctgtggtcccagctgctcgggaggctgaggcaggagaatggcgtgagcctgggaggcaggaggttgcagtgagctgagatcacgccactgcactccaacctgggcgacacagcgagactctgtctcaaagaaaaataaaaaataaaaaaatacataaataatttttttttttttaaaaaagaaagctaccctaaggcacatatgggccatttcttatggaagagaaaggatgactcagagggcagaatcacagccaggcagagcaaaactggatcttaatcaaagtgtatcttttgaccctggggcagtgatgaccggtagataccagaatttctacagatggtgactaccatgtgcctcctactctaccccactcctttttgagtaagactatctattgcattattcctcaagcaccattttacaatgtgagggagatgagaggatgaggtggctgatagataacttgagtttttagttcacaggtcttaaactgtagaggaaatgtacttgataatctgttcccaacaaactgcacccgaggagcctcatctgcagctaggcctgattcagaagatgtcctggatttttgagccaatgtagtaattagatgagccttggaattatttgttaagaatagaacactttggaagagtagaatggacttccctacagtcctttggggctgaaaagacataaacccaccagcctgtcaagtggaaacccaagggggtcatgacctagaaacaggaatcaaaagttgaatcttattaaagtggaagccggccctaacccagtgcaatctctgatcgaattcaatgatcagtccttaatagtggcagagggtgaatgctccagtgggagatatcatctagagcctctacacctaaattacatgtaatacttggcatctaacaaaatattacttgatatgggaagtgacacaaccataataacaaaaaaccaacagaaaaaacagctgagttctccaaaaggtttttttcatggtaaggccaattccttcagacaaaggtatccagaaatgcaaagttctcagtgtcgcctgtgtctgtcaaatattcccattccaagcctcagggacccttcccaaccagtgcccttaccttagaataagagatcactgggtttgtgcatttaagtgcctttacagtttggtgaccctcacaatcaggccctgctcctgttcatcagccacatctgtcttgcatctataaaaaataagagatccccttaatgccactgtaaaggctttctgttcattctccatctattgtactcccaacttgagagtacaaggtgccaggggccatgctgattttccagagaagacagcacatccaaatcagcagctgtgatggtcatcaccacctgcctaaatgtaaatctctgataatcttcagtgattcttcaagtctcttccactgccctctgatctcctaccattgcctcgcattggccagtccctactggaagatgtgtaccccaggtgatagaatacagacatgtcagcctccaggggcacagcacaagaagaaaaagacggagaacaagactggagaagcaaacagagaataaccagtgcaggccacatgccatggattgtcttctcagaaagttactgaagaaagtgatccccaaatgagaattaaagataagcaacgaagagatatacagggaccaggaaaagagactcagcataggaagagacatgaggggagtggccaagatgatgatgaaaagaagtcctaagccatcagtttgcaagaatcttagtagcaagttaattctggagtaggaccaaatttgaaaaaaaaaattactgagcaattacctgaatcattgcagaatatgttgcaaggagatttgtagtttttgagagaaattggagcatgaattagtggtaggcacataaaaaaactaagtaaatgaaaaatttaggtaatgattataggaaagacaaaacagtgcaagcatggaaatgtaatcccagtagtccacccggatcacctgtgaacactatctacacagtccttatcatgtaaatactaaagactttcccacctatgaacttgtaatacaagtaggtattttgcactgttggttttttcctctttcctctggaactgccaaatcacctgggagtcatgctataggcaaagggaagcatcagtggcccatggagcacatttggagaagcaatgcttcatggcttaacactctgtaccagagacgacactttctcctttcttctttttcacagggagtgccacacttagtctaatgcttacctttatattctacatggtttagaaacttatatggacaaaaagtgaattttatgaaatccaggaatgtattcaggggaaacagaaattatctccatgttattattagaaggtacaatctagtacctcactttttttttttttttctttgagatggagtcttgctctgtcaccaggctggagcgcagtggcacaatcctggctcactgcaaactctgcctcccgggttcaagcaattctcctgccagcctcccaagtagctgggattacaggtgtgcaccaccacactcggctaatttttgtatttttagtagagacagggtttcaccatgttggccaggctggtctcgaactcctgacctcaggtgatctgcccaccttggcctcccaaagtgctgggattataggtgtgagccaccgtgtctggccagtatctcacttttaacctcaaaattcttattaatgttaccaaagtaaagttaatggaaacgcttgaccactttattatgagagaaaatagtaaaaatgtaaactggaattgaataagaataaaacattttaaagttaacttactcgtatgaaatctgtaagcgtattataaatgaaggctcctctgggaaggaaaaaacagcttccaggactcaaatcgtggaaaaagaaaagttcttgttcctagattgaaacaaaaattgcatttcaaatgtcatctgctattgcttaatatttactgcacacacatataatactcagttatttccatcttctctagtaatagacattccaaggccattcaacacttatacctaaatgcatgcaacagcatatgtaaaatttccaatcatatttatgcctaattagctttgaacttagcttttacttcaccttctgctattctctgcgaattttcttacttggcacacttggagtacggcactcatggggagacaacacggtagaaagaccaaaaaagttcattgcaggaggtgggctttaggtgatgatgatcatcatggctgctgcctactgagagcctatcctgtaccaggcaccgtcacccagtttctgtcttcacagccaccctgcaaggctacccagcaaggaagacaaggacacggagcttgcccatcatctaacacaactagtgagtacaaggactgggcataaagctcaggccgagctgctttccagtctgagcttttccttctacacgctgctctgtctcccagatacaaaggatgctataaagtgcacagaatgtaaaaaacaactctttttttttttgagactgagtctcactctgtcgcccaggctggagtgcagtggagcgatctcagctcactgcaacctccgcctgccgggcccaagtgattctcctgcctcagcttccagagtagctgggactacaagcgcgtgctgccacgcctggctaatttttttgtatttctagtagaggtggggtttcaccaaaaacaactttattttttatcatgacaaaaataagagaagggtacaattttcaaaaattaataaaagatacaggaaggaaagaggttagaagacatctggggtattaaaatgaaagcactgagcagcggactgtgagtgccagcaaaataggagagaagaagaagaaatcttatttttaaagcaacttagttttgtgagacagaaacattcctatgttggcttatgattacatctccagtgattaagatgtggggcataccttcccgatcttcctgtgatctcggttctttgcttcctcttggaacttttcccagtctctcatcatcttgttatcaggaaaggatattccatagatcctctgcaatgtttccatttccggattgccctcccaatatgttgaggaattctaaatatcaaagaggattttggtaaatatatcatacattcagttgtaagtaaaactgctcttaaatacaaatgcaattttccactatcatatcaacaaagcagccctgcatggtggctcatgcctataatcccagcactttgggaggccaaggtggttagatcatttgagctcaggagtttgagactcgcctggacaacgtggcaaaaccccatctgtacagaaaatacaaaaactagccaggcacgatggcacatgcctgtaatcccagctacttgggagactggggcaggaggactgtttgagcccaggaggtcgaggctgcagtgagcagtgtttgtgccactgcactccaacctgggtgacaatgcaagaccttgtctcaaaatcaaacaaacaaacaaacaaaatcaacaaagcttaaagaagactatttgtagtgctgggaacaatcttaaaatggattctaactaaaccttcccagcctaaattataccattaaccagcaaattatgtagagtctgctatggattctaggaatgacagtgagagcacacagaaaggagggaaggctaagcagcaatcataatcaccaaggatggggcagaacagacagtaggtatggggaagtaaaggtcggtcttgctgacctacagtcaatgattaagaacagtgccattagccagccccattttacctgtaagaaaatcaaagccaagaaaggctgggactgccaagtcagtcccatgcctcctaatcccagagcgatgttttctccattacaacatcatatcccctcctgctgttttctttatgccgcaatacattactttcacatgcagacaaatattcttgcttacatcagggctattcaagaaaaccatagtatatagaacaatattttaaaatagtgtatgaaaaaggccaggcgcagtggctcatgcctataatcccagcacttcgggaggctgaggcaggcggatcacctgaggttaggagttcgagaccagcctgaccaatgtggtaaaaccccatctcgactaaaaatagaaaaattagccgggtggggtggtgcaggcctgtaatcacagctcctcaggaggctggggcaggagaatcgcttgaacccaggaggcggagattgcagtgagccaagatcacaccactgcactccagcctggacaacagagcaagactctgtctcagaaaaataaaaaataaaataaaatatcgtatgaaaaagaaatgttataacacttacaataaggtaaaatgataaacaaaagccacctatagtgttctaattatcaaaattctaaatgattttattagttttcatcaaataagaatgaaatattttaaaatatcatgatgttcagactacaaaagatatgattgaataagatatgattaaaatcctttaatagctagtgcaccttaagtttactgtattaaaaaaaaatcaatccttaccttaaaaattttgatggttttaatttttccagtgtgtcttacatgtggacctttgcaaaggtcaattaatggaccgcacctataatgaaatatttaggacatgctcaggcacagttacagtgttctggactattcattataagccataatatcctatgttttaggtagagcttcacttatttatatgtagcaatgccatttttaatttagggtgaaggagagaggtgattcatctagcctcagagtccactctgccctctagattcaaaaaccacagaacatcttctgaaagaaactaggcaattctctgattaaaaacttaaaaattacaatgaatacaaaaagggactggcttacagagtggcaaacacgaaaatgtcatctctctcaatggtcagtctttgtgtattgttctctagggagagagcttgtaaacaacactcagatgaagggaaggaatgccaaattagcatgaaaggcttcaatactctaatctttacatagaaagtcacagggccgggtgtggtggctcacacctgtaatcccagcactttgggaggccgaggcgggtggatcacgaggtcaggcattcgagaccagcctcgccaacatagtgaaaccctgtctctaataaaaaatataaaaaattagctgggcgtggtggtgggcgcctgtaatcccagctacttgggaggctgaggcaggagaatcacttgaacctgggaggcagaggttgcggtgaaccgaggtcgcgccatcgcactccagcccgggcaacagtgcaagactccatctcaaaaaattaaaaaaaaaaaaaaaaagaaagccataaaagaaaagctttatttttttttcaaaaattaaatacaagccattcaaattgaaaaactacaaaaagtgtcaatgttgacgtaagtaaggttctcaaacccaagagctcaagcattagaagccagaaatttaaaacttggcctgttttctacattttcatttatttttaagctttaagaaatgcaccgtgcatagctttgcacaaaggggatatgattttacttacagtacaattaaaccagagaaccataagtccttgactgtcgaaagtaagtaccatgagggagaatatctgtggttataattaaataaataccaggtcttctaaggcggtactgtgatagtcctagcagcacccagatggccggaacacacggaaaggggaacagcaatgacatataaggcgtatacacacgaataaagaaaaaggtgctcaggaacctgaggttaaatgaacagagctaagtgattctggtattaacttcacttgtctcctcttacatttgatcctgcctttgtttcccagtattttcttttggtctcatcatgagtatcctgctaatgcatgaagactgtacacttggactctggacaatggggcagactcttctacacttgcactctggacagtaagtatgaggcagagaatcactgccgaggagatggcttgtaatggcccccactgccacattaataagaacgtggaaggacagaatagaaactcctttcccaacagtatcactcacatggagaaaaatcctgttatagctaacacccaggaaacaaaatatgggtctcagtactgtcctgattactaaaaaggggaaaataatcatttctctttagtgaaaacattttgaagattgtaactacggtagattatcaactacacaacttgaaaaatcgatctccaaccagaaaacaaactcggcctctactgctaacaccttcaagtttaccactgagcagcgtttaccatgtgtggacacaaacctgtacacggtggtagttgcagtgttaactttctcattcagaatgcggcatttaaatttattgtactacgaagaaaaacatatttacacattattacacacaatgttgaaatgaagaaaacaactctacttttcttcaagaaacattgaaaggtcatctactgatgttctaggtgctgagacacgagggatacaaagagctcacagccttgagcgacaccgtgcagcatggaggccacaagccacgtggctactgggcatttcaaatgccattaatttgtggttgttgttgttgtttttgagacagagtctcactccctcacccaggctagggtgcagtgccaccatcttggctcactgcaacgtccgtctccctggttcaagcgattctgcctcagcctcccgtgtagctggaattacaggcatgtaccaccatgcctgtattgtatttttgtatttttactatgtgctaatttttgtatttttagtagagacagggtttcactatgttggccaggctggtctcaaactcctgacctctagtgatccgcctgccttggcctcccaaagtactgggattacaggtgtgagccaccacacctggcctcaaatgccactaatttgaaagaagatgtgcagtgagtataaaacacactggactttggaagtataatgttgcaaaaagaagaagaaaatcattcgttaatcattctttatactggctaccattgaaattatactttttatatattgggttaaaaatttgttaaaattaattgcaacttttacttttaaaatgtagctgccataaaattataggttacacatgtagctcagactagtggattccattatgtttctattggacagtactgttctagaagatctaattttaacattaatcaataaaattctgacaaggacacagctatattattaatttgtataaaaacaaaagcaaagtttatcgtaatgatgatatatttataaaactaagggtttttttccttttcctttcttttctgcttccatcactactatcggggtatacaaggcactttatattaaataactacttaaagaagctagttgttgggagaaaaacccgtatctgcatgatttaactgtttcgtatctatatattcacaacaaatcattttccttaacaaagattaattgtgtttagttcttaaaagtagctgcaaaaaaggcaacccacagaattaaatatttgcaaatcacatatctgttaagaaatggatatccagaatatatcaagaactcttataactcaaatacaaaaaaacctaattaaaaaatgggcaaaagagctcaacagacatttctccaaagacatttcttcaagaaaatacacaaatggccaataagcacattaagatgctcaccattagtacgtcatcagagaaatgcaagtcaaaacaaaaccccaatgagataccacttcacaaccattaggatgtccatgattaaaaaaaaaacaaaacaagtgttggcaaggatgtggaaaaactgaaccccctgtgcatcactggtgggactgtaaaatggtgtagccactgcaccaaacggtatggcgagttctcgaaaacttaaaaacagaattgccataggatccagaaattccccttctaagtatattcccaaaagaagtaaagcagagactcaaacagaactttacacacccatgttcacagcagcgctgttcacaatagtagccaaaaggcagaagcaacccaagtgtttacaggtggatgaatggatcaacaaaatgtggtctatccgtacaatggaatattatccaaccttataaaggaaggacattctgacacacattaaaatattaaaatatggatgaatcttgaggactttttgctgagtgaaacaagccagtcacaaaaggataaatattgtcatgattccactgatatgaagtgcctggaggaaccaaattcagagacggagagtagaatggtggtggccaggggctgggggcagggcgggaatggggagctaatgtttaatgggtatagagtttctgactggcaagataaaaagctttggagattggtgatggtttgacaacattgtcaatgtacttaatgccacagaactgtatacttaggattaaatggtaaattttatatgttatatattttactgcacaaaaaagaatactgcaattttttaccaaaaccaactctatttttttattcaagcccacaaaactgataatactgtgttttcaaagtacatgtttttggttgggcgtggtggctcacgcctgtaatcccagcactttaggaggctgaggggggtagatcacttgaggtcaggaattcaagaccagcctggccaacatggcaaaactttgtctctactaaaaggatagaaaaattagtcaggcacggtggcacatgcctgtagtcccagctgagggactgagacacgagaattgcttgaatccaggaggcggaggttgcagtgagccaagatagtagtgagccaagatagtgccactgcactctagcctgggaggcaaagagagactctgtctgaaaaaaaaaaaaaaaaaaaaaaaaaaaacccaaaaaataaaaaacaaaatgtatgttttctccaatatgtatgttttaaaacataaaatcaggaatatatttaagtacgttggtcaaaaaaatataaagagaaagttactgttttacacaggttactctaggttaaaatctgaaacaaaagttaacagaaaactcccacagaaaagagaaaaaggcagcattttatatgggattataaatattgttgaatttaggtgacagatattcacaatactcagaattaatcagatttataaacacacatgtgaaaattattcacctggccctttacctacctatgtctcccctcaaatgttcaggaaatagatggggagggaaatgtcacagcaagtaactggtaacaacctcacagtagcttaacaggattggaataatttggtgagcaacaggtaattatttgggggaaggtggggaagctagtctatattgatttttaatattcctagtaagaggtttaggagtttccccaagttaccttaaacatttccaggaggatttccttgctgacttctagtctttcaaaaggttgcttttcttttatgatggctttacatatattctccagggctgacaattctgtgctggacactgctctaaaaagaagagcagagaaccgacatccatcttccagacattatgcattccctctttcctttgtcctggagcctcagcagccataaatttgaatctgctgtcttattgttccaggacttcagaaagtcaaacgttcatacagtcactactcttgtgtctcagtgagggagactgggcatcaacagttgccaagacctgcctcatttctcctctgctgcaaggggagaaggaagccctgctaggagacacccaggtggactgtgagctcctctgaggcctgttcttttgtgtggtcttccttacccttcacatgctttagttttgctcaagagccagatgcagtgctcatcacgtccctgccctcactggctatggaaccaaggctgggagacatctgtatggactgcagagtcgcggtgctcccagcagcactcagcctccgctatgcatggactaacttcctttcagtcaccccctggtcagtgctcactccctcctgccacactagcttccttgccactcctcaaacaagccacacatatccccacaccaggacagtcccacagaggcctggaaccttctccctgcagatgtcataagtatccccatcctcagggcttgctccctccctccactccggtcggcttcaatgccacctgctccttcctgcccacctgcctgtcatggcacacacctcctacacctggctgatgttcctatagtcatcaccacccggcagcagatggctgcttgtgcatttgctgtcttcccccaaacactgttagctccatgaggacagactggttccttcactgctgaatcaccagcacccagcacagagcacacagcaggcagcaaaaacatcttgttgaacgaatactggagccatgttaacaagagatgaacgggatgtgatactgtgatacagtaagaaacacaaatttggtcttcatccagatttctggcacagggtttttaaaatcctgaaatctctggagtgatacgagtgtcttttgtgtgctgatgagatgactggtggctaggtcccctaggtagcttcagagcaggaactggtcaccacaaagaccaaggcatgattaaagggttgggactttcagcacccccacctgcctccttaggggaaaggagaggggctagagattgggttatcaccaaaggtcaatgatttaatcaattgtgcctctataatgaaacctccattaaaatccctaaacaacaagattcacagagcttccaggttgttgaacacatccaggtgcttggggcatggcgcccagagacacatggcatctctgtggtccctcccacatacctcaccataagcatctttcatcaggctgttcatctctatcctttgtaacatccattataatacactggtaaggtaagtaaagtgccttcttgagttctgtgagccagtctagcaaattattgaacccaaggatggggtcatgggaactcccgatttgtagcctgtaggtcaaaagtatggaaggcccagacttccagctggcatctgaattggggccagtcttgtgggactgagcccttgacctggggaatctgcattaactcagggtagatagtgtcagaattgagttcaatcattagacacctcattggtgtccagagagttggagcactggccattgatttgggaaaaaacccacacctttgagataagaattgttgtaggtaaacacagtttcatgcttgtgagtaatagtggttcagattggacaagtctgtaagtagtagctacacagcattgggtgctcggttggggaggtcattaagcagcgtgcaggagaaggtaaagacaaaatgcaccatagtcatccaggccagagatgccatggggctaacttaaggcagaaacaagagaaggagaggggggtgggagaactatttaggagataaaattggcagaactggactaaacaactggatggtggcgtggtggtgaagaggagggaggaagtagaaggatcagaggttttggttgtggcagttggaggtaccctaggagctatgaggaattcagggcaggaggtggacggggctggctgtttgctaacgattcaagcataggcctatggaatgtgaagcatctgtgacacatccctgtccggcactcaactatgtgagatgtttggctgaggttaatgaggtccttgattatcacggagcgaattaaactagcctctctctaggaattaagctttcaattctggtcttaattaataccatgctctagcaagtccaagattagataaatagcatatcatattcttctggggacaaaaaagaaaacaatcttagaagtatctcttgaatctaaactagatttgactaaaaataattttcagttaaatgccttagaccatttctaaactaaaaataattttcaaaattggtcaaccaatctataatcatcttatgcaatacagttgacccttgaacaacaaaggttagaactgcatgggtccacctatatgtggattttcttctgcctctgccacccggagacagcaagaccaacccttccacttcctcatcagcctactcaacgtgaagatgaagagctttataatgatccacttccactaaatgaatggtaaatacattttctcttccttatgattttcttaacatctcttttctctagcttatttcaagaatacagtatatgatacacctaagatacaaactatgtgatactcaactgtttatgttttcattaaggcgtctagctaacaacaggctattagttaagtttaggaggaatcacaagttgaactcggattttcaactgcatgggcgtcggtgcccctaaccccacattatgtaagggccagcagtatacagttactaggctagtatgtaaccattacagaacaatacaattgaaacacatgcattcacaagccagtattcagtgtgttacctgtcttcaatgaacatgtcataataaaatccattttcaatgggcggaccgtagcacaggtggcctccatagtaaagctccatggcctccccaagaatgtgagcactggagtgccagtacacctgcatggcatggacaaagaggccattagctaccaaaagtatgtcatggaaaattagtagtaaaatgatgtaaaccagtagaaaattttaaggagatacatggcaagaccaagggcagcaacatcaacttgaaaggaaaatcttcgatgcccacttagaagagaatgctttctgagccctccctgacattccaccggagtcacttgctcagtgccagtgtgaagctgctctgctgagtggcagctagagctcggccacaaccccatttcctctgtgcatgtcagccacgagagatgaacacctctcagaacagccagcagagcagctgtgtgcaaacctgattgaagcccagagtaggaggaaggccgaggagtgccagatgctagctgtcttctttttctccaggggcaccctctctgagctggacacagagcactgaagtgttcctgacaccactacagttaacgagatcctgcatctccagagcagtcttcgtgtgttgaatagcatgtgactgtggaagtttgaaagatgtctcaggaagaaaaaagtgttgccagggaacgtctgctggctgcctgggacgcctgagaagtgtatatatgggctcattagccacagtccagagcccggttgtcagtcctccaagttcaaaaagttgatactgttttgagttcccaaggaattcattttagtttatggataaactgaaattaaccaaagtcaccaaataaatataggtaccaaaggagtaagataatcaactcatctttcagcactttctttctttttattaaatagaaagcaagttacaattaaaaagctgtttgataaaatgaatcagggcagaaggagtcagatgatggagcactatgtgcaatcccagcccacagcaataggctgggatatgatttgcagacagacccagagggtcagtccttagggcacagcactgctcctttggatgctgctaggatggcaggctgactgctagcatcagcccaaatctcccatgtggtgcactgtccacacctacacatttgttgagccaaacactgtgctgggtatacaatagtgaaagaaacagacatagtcacagcccccacacaggtacagcctattggcgaagacacaggcaataaacaaacctggacgtgcataattctaagatgagaagggtgtttaaaaggagatgaacagggctctgtaatatagaaaaatggtgagtgtcctgcattcatggggactcgggaaggcctgtgtgactaacacgtaggggatgtgacaaagcatagcttgagaaaggttagagaggtaaggaagggccagagaccatgcaggccttggggaggagcttgcattttactccaaatgcaatgggatgcattaaagggttttaagcaaaatgattaaatttacatttacacacatcatttgatagctcgatgggaatgaatttcaggggacaaaacagcaagtaggcagtttcttgggtggttctataacaaggtgagtgcggattctcaggcagtggcaatggacagattctagatatttttaggaagtaaaatctactgggcttacccctcactggagatggagttgagggacggggaggaatcacacaaaacctccaaggttctggaatgagctattgggtatgtggtggagtaatgcactgacttaggcaaacaggaagaaataagttttggggttaaaatcgaaaatttcatggtgaatgtactgaagattcttgtacaatatctacatgcagatatcacgtagacagtagtgcataaaaactgaggcatggctagctatggctggagagttgtgaattcagtctacagtactgaactttctgaaaatcacttttaaatatggttttattaatagtgtactgtttacatatttaatggttatactttgcatattttaaacagaaattataatatggttcttatagtttaaagaaatttagcataagccttgcaattattgtaacctaagctaatcataacttaggtttcatgaagataatggacagcttgaagggcgactgcaacgttcaggcgacaacgtatatcagaaatcatatatcacatgcatatgtgaaaaatgtggtatttattttatagaaaattatattaagtatttaaaggatatctgagtcttgtaatttcttccaattctcctatacatattaaattataaagtagacccatttttaatggcctactaacaattcatttcaaacacacattgatttaataaccaaagcattctaacttaaggaaatgattattgtaagaaatgataaggctgggcacagtggctcacacctgtaatcctagcactatgggaggctgagggaggcatactgctcgagcccaggagtttgagaacagcctgggcaacatagcaaaaccctgtctctacaaaaaatatgaaaaattatctgagtgtggtggtgtgcacctgtagtcccaggtagctgggaggctgaggtgggaggatcacctgagccaggggaggttgaggctgcagtgagccgtgattgcgccactgcactccagtctgggtgacagagtaagactccatctcaaaaaaaaaaaaaaaaaaaaaaaaaagaaattataaatatgggctactttaaaaactgacatgtatttgtatacattcatgccacaaatatttattaaacatcaataatcaaattttaaatcttagaaacccccaaaaaactcaacattcgtgacttcaatatgtggcctcttatataatgtagtttacaacataactacccaaagtttggctgtctggtttttaaatactcacagcttgagcttcctcattatcaaatgtaagcagctctagagaagagtccccttccaatgggcggtccaggtcccacagttcaccattgactttggctattaccgtgctttcagccagttcctgactaagaagacaaaagccacttgggagttaactttatcactgttacaatgattccttaaaatattaaaagaatttctagggttttttttttttgaagtgtataaaaagtacaaacataaactaataggacagatatttcttgttttgcaatatttattttatgtagaaaagtaatatacattcactgtttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcgcggctaattttttgtatttttagtagagacggggtttcaccgttttagccgggatggtctcgatctcctgacctcgtgatccgcccgcctcggcctcccaaagtgctgggattacaggcgtgagccaccgcgcccagccacattcactgtttaaaaaaaacttggaaaactgagaaagcccacaagataaaataaaaatcacacataaatatcataaatcactacttataacattttggtacatttctatccagtggtttttctacctccatccaccccacgcacacatatgtgctgtctttaaaagcagctgccgacataattgtatagcttgcattttctgtcatgcctcagattgccttccaaagcagtctggaagtattgtatttattaatgaagcctccactgctgcacactgaggtcgcctaagtcttgctatcatagagtatatcacacagacatctgtacacaggcatcttgcgacttctgtgactgttttctgggaatacatccacagaattggaattactagatcaaaggggatgtaccgttgacagatttctgatgtcaattgaacgcatcacttccacgtaccccgatttttaaaatctttatcaatgtgacattgaaaattgttgttttgatttaattattagttttggttcatgcttacaagctatttttacttttatgaactatccgcttcctttgcctattttctttttttttttgagacagtctcactttgttgccaggctggagtgcagtggtgcaatcttggctcaccgcaacccctgccttctgggttcaagcgattctcctgcctcggcctcccgagtagctgggaatacaggcgcaggccaccacactcagctaacttttgtatttttagtagagatggggtttcaccatattggccaggatggtcttctagtgaggtgttgatctctttctttctgtttttttgggtatcttttaaataacatttattgtttgaaaattgttgacaaaattacaagttaagaaaggaaacctggaaagcacagaaacacacacacaaaatcacctataattctaccaccaagaaattaccattgatgttttgtttatatctttccatattaatatataggaataaaaaatatttaatagtatcataattatgtgattttataacctacttcttaaacttcacaataaatcacagcatcttccctaacaggagacagatttccaaaacgtgatatttaatagtcacagaggaaccaatatttgctaggcattttaattattttttatgggtactttgggggacgagtagcaacaaaaaacaatgctgcaatgaacattcttgaacatatatcttactcaattattttctcaggaaaaattctggaagtacaactgctaggtcaagggaaatgcattttcagtgatttctgtcagaatatattgcaaaattttcctactagcagagttacaagagtatcttgtctctgagttctcataatgttaggtactattaaattgtatcaactctacaatgtaatttttttttttttttttttgagacagggtctcactctgtcacccaggctggagtgcaaaggtgcaatgtcggctcactgcaacctctaccttccgggttcaagtgattctcctgactcaacctcccaagtagctgggattacaggcacatgccaccatgtccggctactttttgtatttgtagtagagacagggtttcaccctgttggccaggctggtctcaaactcctgaccccaagtgatctgcccaccttcacctcccaaagtgctggcattacagatgtgagccaccgtgcccagcctacaatgtaatcttttaatttacatttctgtgattaacttgagcagcagtactgcattgaggttgggggcacacaggtaagaggccaacctgagtttaaatactggacaatttactcagcttctttaggcctcagttttcttatctacaaaatagggattataggaccttcctcattcatctatactcaggattacataatgtgtacatatgataacaagaacttaataaatgttagatgttattaatcaagtagaactttcttttcatttttactggctgtcatagatggctagtgtttcgcaaaccgattctgcccttcttctccagaaggagttttccagccttccttgcagctacatgtggccatgtggccaggtttggagccaatggatagaaggagaagtcatgtgtaacacttctgtgtctcatcattaaaacagtggagggcacttctccaacctctctccaccttctgtagatgggaacccatgtgctattctttctggaccatgtagacaacggcaacattgtaccagacaaatcagcaacaagatgggagaaatctgggtccccaaaagaccgtatggagacatgtcacccagtcaacctggccacccacgtctagactgctatatgaaaaacagactttgaccatattcaagcgacttgagttttttgtgatgtctttgttgtagcagcttagtatatatcttaagtaatacagaaataaggacctggaagtaaaaatccaaaacaagtggcactggcttaacagactggcagtgagtaacaaggaaacagattctaacatatggagagccaataacctttgtgatagtatatcaaaatatttgataaaacttgcaggcaaaccatgtgtcacagtgcttgtagcacacaagaaagcaggtataaaaggggagagtagggctgggcgtggtggcttacatctgtaatcccaacattttgggaggctgctgtgggcagaccacctgaggttggaagttcgagaccagcctgactaacatggagaaacgccatccttactaaaaatacaaaattagctgggtgtggtggcgcatgcctgtaatctcaactactcgggaggctgaggcaggagaatcgcttgaaaccggagggcggaggttgtggtgagccaagatcgagaaaaggggcggggtggaggtggggggacagtgttggtataccctgggtaactcttgttgctttcagcaagaagctacaagaatgagttatctcagatgaaaacaatctagtttgccagcagaggtggaagggatagggaggctccctctgcccgtgtcctgtaattcaactgactaaaagttcagaaacgtggagctatgcaagatgggaaagacaatcttctttcccaaaccgcaggagggacaggcattgatagcccttctcaaaggccacacataaatccagacaatagaggccagtggaactgcaaggattagagagcaagagtgcctccctcccacaagcctctgcttcatatgatctcagtccattaaacaaggagacaggagtgagccgaataaaaaagccatgcaacaacagggtgagaagtctctatctagaagattctttaagtgagattactttcatgtggaacggattagctgcaaacagaccagagcctactatggctaactgatcatggtaattgtattgccaaacaaatcataagctcagctcacaaatatctgtgactatgtgatccttaagggaaccctcaggccccaaatgtgcaccacagaactgagctgtggaaactgcacagatcccaagaggacaaactcgtgcacttcagatgtgacaagtgagggtaatggacaactccgaacttcccaaagtgcaaaatcagggcccatggaggatcatgggataagacagctgcttccagagaacaaaggatgaacaggtgggctgacacaagcactaactgctgccaggctgtggggcctcaaggtggcttcaagcagaatctgatgacttctctataccactccctgctatatttctcctccttcttttttccaagcacacactttgtgattgtcttctgtgtactgtatgcacgtgtggtgtgagcagacttgtctatcagtttatttgttgctagaatacaagtggtcagcctgatggggggtgttctgtacatcactcagaaatcccaggctttgagctatggaacataagagttgtctcacttggggagtgagtgtgtcagatgttgaaagaagagtacccacagatatctggatgtcagaggggcagactgtggcagactctctgttgttccataaaccattcctctcttccatggtatgaatgctttagctggacatgtggctgggcggccaagggagctatattccaattctctcttacagctaggcatagccatgtgactaaatgtgagctaagaggatgtaagtggaaactgaagccagccactatggggtcttggcctcaaagcatcattgctctgcagcttctcttcctcctgactgcaggcaggcccatgcaaggacccagcttccaccgctagacacaaagaaaccctacctaggagacagcagatcaacaagatgggaggaagctgggtccataaataactgcatggaccagagatgtccactaggcttgactggtcacttctagacggttagcttgcattagaagcccctggagagctcataaaaacactgatggctgatcaattcagggggtttgaggtgggatccccaaatttgcttttctaacaagtttccaggtgatgcccatgctgctggtctggggactacactttgagaaatactgacccaacacatttaacatgcaacctgactctccatgagaaaacaaacttattcttgcctcaaaacctgttttctcctagcacatcattcctcctggaaaacatgaaaacaggctgggagagcatttaacaatataataggatgaatcagaaatacaatcttagccatagttttcaaagaaaatctgagaatttcagttgttgaaacagtttgctttttaaatgatgaacatttatttacatggcattaatacaattgtatagaagctatataattgtatttatacaatagcttctatacaattgtatttaatgctaagaattaacatgagtcaaaacaatataagttcactaatgtatctaatttctagaaaagtcaaagcacttttccaagactgataatagctctaaaacatttatcttcaatctatacttaaaagacctgtaaaaactcatggaaattacttgattgacgaataaagtcagtgtaaaatggcctatcaagaattacagatttttttctctcctatatatttttattagaacaggaaatgattgtgttctgatattcaactacttatttacatggcccttggagaagccagaggaaaaaaattaaatacatttaatttattcaactgaataaaaaaaaaattagctgatatggtttggctgtgtgcccatccaaacctcatcttgaactctagttcccataatccccacgttttgtggaagggacccagtgggaggtaactgaatcacaggggctgttacctccatgctgttctttgatagtgagtgcattctcatgagatctgatggttttataaggggttttccccccactttgctctgcacttctccttgccgctgccatgtgaagaaggacatgcttgcttccccttctgccacgactgtaagtttcctgaagcctccccagccctgcggaactgtgagtcaattaaatcttcttcctttataaataacccagtctcagacatgtccttttagtatcgtgagaatggagtaatatattagcggtccctaagaaaacattttcaccaggcttcagtataattacttaagattgaatatcttttccacactgcggtttacctaatttcagcagccacttggtaaggcgttgttttccagacttccccttgcactgtttgcccatcagccactcttactgtgatgatgttgcttgtatcccccttttttccataaatggcaagtaagagctgatggtctttcttcagtatttcaaaaagcttcaatctttcttttatgaaaattggttgatgcttcacctggaaattattagaacataatgagattaatatatacagcctactgttttccagctgctcagctctgaatcaggctcacccccttactgccttctcagttctacagatggtcccaagcttaccatggtttgaattacgattttgttgttgttgttgttttttggtttgttgttgttgttgctgttgttttgagatggagtcttgctttgtcgcccaggctggagtgcaggggcacgaaatcagctcactgcagcctctgtctcctaggttcaagcgattttcctgcctcggccacccgagtagctgggattacaggcacgcaccaccctgccagactaatttttgtatttgtagtagagatggggtttcgccatgttggccaggctggtctcgaactcctgacctcaaatgatttacctgccttggcctcccaaaatgctgggattacaggcgtgagtcaccgtatccagccgcaatttttcaactttagtgatgtgaaagtcatatgcattcagtagaaactgtactttgagtatccatacaaccattgtgtttttcactcagtacagtattcaataaattacatgagatattcaacacttcataataaaataggctttatgttagaggattttgcccaactgtaagctaatctaagtgttctgagcacttttaatgtaggctaggctaaactacgatgatcactagcttacgtgtattaaatacatttttaactcacattggttttattgggacataacccaactgtaagactaagagcatgtgtacttcccacctccaaaaggctcctctctgcctatctaacttctccttagctctaaaggtccacctcaaagcctgcctcctctacctattttacccgctggcatctcccttttttttttttttttcctttgagacagccccacgcccagcccccatgacacctcccttttctactgtttacagaacgtgtacagagtcacacattacagcacttacttgtataccatcgtactctgttctctagttgtttgtcctgagtctgcctgaattcctcaaccagactaacttctttgggcctaggtattccttcttcactcctaccaaatgttgatgctagataaatacttactgattgttttaatgctttatatacaaaagcaaagtagctagtttctcgaatacaaaaaaaaaaaaaagaccgggggcggtggctcacgcctgtaatcccagcactttgggaagccaaggtgggcggatcatgaggtcaggagatcgagatcctcctggctaacacggtgaaaccccatctctactaaaaaaaaaaaaaaaaaaaaaaaaaaattagccgggcttggtggcatgcacctgtagtcccagctactcaggaggctgaggcaggagaatcgcttgaacctgggaggtggaggctgcagtaaccgagatcatgccattgcactctagcctgggcaacaagagcaaacctccgccttcaaaaaacaaaaaaaaaccaaccaaacaaaaaaaaccaactctagtactctagtagcacaacttaaatagattaaatacacgtgtttattaaacatgggcagctcatttctcaagacatctcatatttaaggcttgaaaagttttaaatacactaatgtgacccaaataataatttaatcagtaatttttattggaaatcctaggtaattaactatatacacatatttaaaattacaggtagtattttatattgtttccacagcaacaacttacctcgctgtcagcctcgctttccttcattttcttctttttcatgtccttgtcttggctttgactaggaggaggctgaaagataaattataaatgactcacatcaatggcaagaaaaagcaacacattttaagaagagagtcatgccagcaggctgcaagtgccccgtgtttagaggctcatagctgggctctcctgaccaccagctacagctctcagtgggcaagtcattctccagggttcagtccttcctgtcacactgttgctaagcacatttaatatattgtgctcttgaaaaccttttgtcctgaactttaaacaaataatgtggctggaaaatgtgtggttgctgcccgccacatcaaatgcactatttcctgaagatgttgctagttcaccgcagctgtccttcctaaaggactgcagaacatctcagcctgagaagcttcaggactcagaaagtatgatgttaaaagaagataatttatcctttctacaaatcataaaatactgtattaaataaaaatgttaaatatacagctatcctctcaagatgaaccaccaaaacaagagcacaaaaagcgaaaacttctcgtccaaaaaaaacccaacaacaaaaaagaaccagagggaatgagagtttacatacgcagctgttagtctttctgaccaaggaaagaatgagttttaaacactccagcattttttcaaacaaatgaaaacactatttctgctactgaaaaagatgcgtggcaggctctttaatggacgaattgagaaatcaacagcatttggttaagtctggcgactgctggaaatccggcggctccccaggccacacgggaccaccgagcagggcagggcgggccagccgcagggcactgggagggcactcccccggggcgcccccgcacctgcccccgcagttgaaaacctttcggtgcgcaccgtctcggcccgccccgcccgcgtcctctccagtgtccccaccgcccggttacctgtgcgccggcctcctgcgccgcctctagctccgcgctctccagcgtggcctggcggctccgctcctcggcgaggcacagccgcaggctgcacaggcggtggcgcaggtcgcagttctcggcccggagctgcgccacctcccgcgtgaggcacggcccctccgcctggcagctgtagggcgcgttcagctgctcgtccctcaggcgctcgacctccgaccacagccagcggatgtcctcctcctgccgctccaggcgcgacgccacggcctccgccgccagggcctcggccgccatcgcggcctccctcaggcaccgacgccgagcggggtgcccgcgactgcggcgagggcgacgcggacactcagcgcacggcagaagacagggctcccgggaggggcggggcgatggggcggggacggagccatggggcctcgttggagccgaggcctacacgttgcaggggcggggcgctgggcggggaggggcggggcctaggccagataccctgcaggggcggggcggggcggggcggggcctgaggccagataccctgcaggggcggggcggggcggggcctgaggccaggcccaccttagggtcacgggcagtggggaaatggggtctgaagggcctcccctgcctttcgaggcctgtctagaggctattggcagtagtttttagtccgttgaaacgaaaatcttccaaaaccttgcaaaaaggccatcgtctgcgttctccaaaaaggcttcaccctttcttcctcttgaattctggcagtcaccattcttttgccttgcaaacaggttctaaaaagtggccattcattataaatggactttctggcctttcgtgccaaacttgcccaagtactgaggcctctgggccagggcatatagaaaatcgctgtgaaatctaaatccgaccagcacgaaattactggctccttgagtctagggcaaatgccacatatatctttgtatccctcttaaccatgagcgtgaaacttcctggagcaggaacagaaattgatttttatcactattcttagggcttaggatgtgacaaacactgttctaaactctgtaacagtagtaactcctttaatcttcataacaggagatactgttatatccgcttatagctggagaaattgaagcacagtgagactgtgttacttgactaaggtcacacagccactacatgacaaagggggaatcaaactcagatagtctgatgccagtttctacacacttaacactagtacttttcaactttggcagaatttaattgagcatgtcatataatgtgatacaggtaataatgcccttataagagtcctgaagtggaagagcttagcttggactggtgtggtttgagaaagggagaaaattttgagaaaggggaaaaggtttattttgctctggaaaataaaggttgggagatgttagcaaggaggaaaagcaggtaaattccactccaggagcagaatcagtgcaggagaaggagcggagggggacaagctcattggattaagctaagtggaatcccaaacagcacccaggaggagattccatgaagtatgttgctaaccaatatcactgtatcttttttagtccttcctcaggaagcctctggatacagttacataggacccactgactcctcattattcatcatttctcaatccactgccatggagtttctgcttctgccattctgtcatgaccaacacatcactgaatgtcatggacccacttaagccaccccagaatttcctcgggaccctctggaatttgtctctcttgggtctccattcccaatacctaggcaaccaccagtctgcttcctgtcactataggttagtttgcattttcttgatttttctacacatggaaccacaccgtatgtcctccttttgtttagctactttcagtcggcacaataattttgatatttacctatgtttgtgtgtatctattgttctttttttctgagtagtattccattgtatggatataccataatttgtttattcatttgttgatggaaaatttgggttatttccaggttttagctaggatcacacaatacccagtgagcccattgggtttccaaactcacactgtagttatttcgtcagttccagaatgcagagtttgaatagatatactccaaactggcagaatccctacagtgtttccctgaccctcggacataaggctattattctggtaggaaaggccaagcagaaaccactagaactttatcaacatacaaaaataataaatcaaaagtaatactgcattcctgaaggaattgcacagattactgttgccttcaagaacttgaaagatgcaggggtggagattctcatcacaccccatttaccttaccttaccatcccatttacatttagcctatgtagaagacaaatggatgttagagaattatagtagattaatataaatttaattagatggtgattccagttgcagctgctcttccagatatgatttcattgttggagtaaatcagcataacccctagcacctgatatgcacctattgagctggctaatacttctttctttatatctattagttaagggctatcgagcaccattttatttcagctgacaaggctggcaatacaccttcacagggtatcaccacaagacaatataaactctttagttttatgtgataatctagtccacaaggactttgattgctgctgtattccataggatatcatgctggtgtcctatcattgatgatagcatgctgattttccctgatgagcaggaaatagcaaatactatagtcaccttgataaggcatgtggaggtggtagagaaggaaatatatccccaaatgtaaaaattcagagggctgtcacctcagtgaaacttctaggcattaagtaattcagagcatttagagatgccactttggaggcaacatatacctcatttggacattatttttctaaaccaattactatgtaactcaagactgccagtgttaagtaagactgagaacctaacaagattctgaaacaggtaatgctgctatgcaagctacttttctatgtgggccacatgagcaacagatctgatggtgcttgaaatgtctgtggcagataagagttacccaacctagagtgcagtggtaagatcttggctcattgcaacctcgacctgctgggctcaagcaaccctcccacctcagcctcctgagtaactgggactacaggtgcataccaccatgcccagctaattaaaaaaatttttgtagtgatggggtcttgctacattgcccaggctggtcttgaactcctgtcctcaagtgatcttcccacctttgcctcccaaagtgttgggattaactattctgcttttgagaagcagcttctggtttgctactgggccatagtagagattgagtgcttcatcagggaccatcaaattaccatgctacccaagtttccctccatgaattgaatgttatttgacccatcaagcctaaggttgggtatatacagcagcatcctatcattaaataaaagaggtgtatgccagatcaggctcaaacagattatgtacgagtttttggcataaacaagtcacccagatgatcacaactcctgtggcctcatgaaaagttttatatgaccagttgactgaggaaggtaaaatttggccatgatttacagatggttctgcactcttctggagcagaagcttctttaagttgacgcctgagaatttaattgcttccttgatttttggtttgataaaatgtttcaggctcatcttatattcaaggaatctatcatttctccaaggtggcctagtccattttaatgggaattgtaatttaaatcacacaatgtgggtcctggcagcagtctttgtttctaggacttttctgtatttaggattgccagataaaatacacagtgcacatttacatttgaacttcagataaacaaaaaataatgtttatataaatatgtcccatgcaatatttgagacatatactaaaaaattattcaagccaaaaagcattaaataagacaaagaaggacattttgtaatgttaagtgccacattccacaatgaaaatatagcaattatgaatatctatacacctgtaatttgaaaaaaactacaggaaactaaaggagaaagagaaacacactaataagaggaaaataacaaggctgggtgtggtggctcatgcctgtaatcccagcactttgggatgccgaggtgggcagatcacctgaggtcagaagttcgagaccagcctgaccaacatagagaagtcccatctctactaaaagtacaaaaaattagctgggtgtggtggcgcatgcctgtaatcccagctacttgggaggctgaggcaggagaattgctggaacctaggaggtggagtttgtggtgagctgagatcatgccatcgcactccagcttgggcaacaacagcaaaactccatctcaaaaaaaaaaaaaaaaaggaaaataacaaaccactctctgagtacattcaagtgcccccacaaaaaagtaaggatgtaaaagacccaaacaatataattaaaaagtagatattttgaatatattcacattatcaatatgtatatataaatatctatctatataaactataccctgaaaatggaagatgcaccttcctcttaaacaaatgtatagattcttcatataaattaatcatttgtagagctcaagaaagacctcagtaggtttcataaagtagaaatattaggtacaacactctcagcccccaatgcaataaaattagaaattaaaaataaaacaacaacaaaaagccttttcacatggaaattttaaaactcttaagcatctctttattgaaaggagaaatgaaaaaggaaagtacagactttctttaaaatagtgataatgaaaatactacaaatctatgcaatacacagatcagtaatcagaaaaaaatcataactctaacacctatattgataaaaacaaaagaatggaaataaattctcaattgaaaaattgagaaaaatgacagcaaaataaagcaatgacaaagttctaataacactaaatatacatttctttttcaacccagcaatcccacttctagaaatttattctgaagatacaagaaggcaaaaatgcatatgcacacaaattcaacggaagagttgtgattgtaaagtacctcataggagattggttcaataagctatagtacacacaaaaaatggagcactatgaagctgttaaaaaaataattaagaggatctctgaactgatatggaacgatttccaggagattttatgaagcaaaaaaagtaatgttcaggctgggcacagtggctcacgcaagtaatcccagcactttgagaggccaaggcaggcagatcacaaggtcaagagattgggaccatcctggccaacatggtgaaaccctgtctctgctaaaaatacaaaaattagctgggcgtggtggtgcacgcctatagtcccagctatgcaggagactgaggcaggagaatctcttgaaccagggaggtggaggttggagtgagccaagatcacgccactgcactccagcctggcaacagagtaagactccgtcaaaacaaacaaacaaacaaaaaaaaaacagtaatgtacacatgtagtatgttacatgttgtataagaaaaaagagaaaatgaaaacatgcatatatctgcttatcatcacaaaaagaaacagaaaataaactagaaaacaatgaatttggttatctacaagtagataaccaagagataaaggtcccgacctctaatacctttcctcattaaagggttcctggcagaaaggcctattccagagctgggacattgacttagtccatttatgttgctacaaggaaatacctgaggctggataatttacaaagaaaagaggtatatttggctcacacttctgcaggctgtacaagaagcatggtgccagcatctgcatctggtgagggtttcaggaatcttccactcatggcagaaggcaaaggggagcccacatgtacaaaagtcacatgacaggaaagcagaagcaagagagaggggagagatgtgaggctcttttaaataattagttctcacaggtgctaagagtgaggactcaatcattactgtgaggacagcaccaagccattcataaggcatctgtcgaggacggcaccaagccattcataagggatctgtcgaggatggcaccaagccattcataagggatctgtccaggacggcaccaagccattcataagggatctgtccaggacggcaccaagccattcataagggatctgtccaggacggcaccaagccattcataagggatctgtccaggacggcaccaagccattcataagggatctgtccaggacggcaccaagccattcataagggatctgtcgaggacggcaccaagccattcataagggatctgtcgaggacggcaccaagccattcataagggatctgtcctcatgaaccagacacctcccactaggccccacctgcaacactgggggtgaaatttcaacatgagacttggaggggacagatatccaaatgatatcagacatgtaagttcaagataagcgtagagcactttgttttgctggaaattaacaaagcgctctccacaaaaatgatgggaacatgatacaagggcacaggaaccagcttgaagggatcccaccagccaaaccaattgaacttcaaaaataattaagtaatgaattgtaaaccattaaaaaatatgggaactcacaagtccaaccaataatagaaaaaaatgggaaagaagccagagctcagtttatagtctatgccatggactaaatggcaaacacaggtaaatgggaaattagaaaaccatcactttgccaccttcatagtaaggactggatcagacaagaatcatcatgctcaatctagggggcagtgctgaaaagcagcaggatactggcatggacataaaatgttcccccacaggctgttaaccagttgcaagggagaaaacaaaaagtaattatacaatggagaaatcaggcaatatcttgatcaggtgatcaaaatgaacatcacctatgaggaacaggtggactttatgtacctccagatgtgatattctaaagaaggtataacacccctgtacagaatttataccaagaatacataaccccaatctaatcacaaggaaacagcacataaacacaaaatgaggaacgtttgtttttaacggtggaggggagaaactgaattcttcaaaaatgtttatataatgaaagacaaaatctggaatgctccagattaaatggtactaaagtcatgatgattaaatgcaataccttactccagattggatcctggaaggggtaaaattgctacaaagaacactattagacaaactgacaaaattggaatacagatggtacattagataaaagtattgttcatgtaaatttatgaagttgataattgttctaaagctatatgagatctccatccttcgtaaaaataagctaaagtatttagttatgatgtatgtaactcatgttcaaatggttcagaaaaaaaattatagaaggagagagaacaaatgttaaagcaaaggataaaatgtttgcctcaaacataagcttcttaaaacatccgtaagattatgtttactcccctgggtaaaaccatcaggagctttctactgcaaataaagtaaaatccaaattctttatcaggacctaccaggccagcaagatcgagcctctgatggcctctcttagattataccatgaccccaaacccggcaaacccctgtgctggttcatggagctctcagatcctcagaaacatccctctctcctgcctctgggattttacacattcggtgtcttgccttgataatatcctcgtccactcttaacgtctgacttcttttcatcctggcagttttagcttagtgccacctccccactccatttaaggttggcctgcccccattctctcagtatccttttctactatattgtaactgttacccaacatccaggtgcttaggaaggttatataatctgcagagttcacatatcaaccacttcaattgctgacaaagctacaaaacacatttcagtaaataagcatgttaaagagcccttagaagacaccaataatgttatgactactgtaatcaatccagtaggaaataaaaatgtttgttactgctcaattgcagcttacagttaaaacaatactcttcaaaatattttcaggagcctctagtttaagaaagttactatggcttgggtgtacaatcactacaactgatacctagcagaatgacaacaattaaggcacaggaagaagttccagacattgtccaatttctcattgctaccttgttttcttaggaacttacaacttcagacaagagaacattaatgcattaatgaggctaccaaaaagaaaaagaaaaaaaacacataggcagtgttgctacacatggattataaaattatacattccagtcatagtcagttaaaagtacataagcaaatgtgatctagcagacagagcctgggaatctagatgaccttggatatcgaatctaattccctgagtttgagtctccccatctgtaaaacaaagaaatgaaaactttcccagaatggtaaagattaactgaaacctgtgaaaacactggatacttagttggcttgtaagtgtctgtctaaaaaataataattcactaggaaactgcaaagaataactgtaaatttccaaatttaagtcgaaattgtgttgtaagcatatttactttaagcaagtaacgtaaactatgtgcacaagtatggttttcgttgtttaaaatgattttcaatgtataaggtgactcaaatgggatctaataaggcactcacttcacttggtcaggaacaatttcctgggtgtctctgatcaagaaaagagatgaagagaaagaagcaggtttacaaaggacaaggaaagaagacacaggattagaatgggttaacaaagcaaagaataagccttcccaaagtgagcaatgaagcaagtggaaacaaggaaagttgaacagtaaatttggatccaccaaaaatcctcatgcttaaaaggaagctcgaagccccagtgtggatttgttatgcacccaatacgctgtttgtgctaactacataatgaagatgaggcggggtgatccggacacagacctggacactctgacctctggcacagaattggctacaggagtgctgggggagagaggcagcagggtagcggagtcatatcaagcaacaagaaacacaagttagtacattttccacaaatttcaattttactcccttccctcatgatacacacatacaaagcatttgaaggatgggaagaagaagctgagatcacagggaaaatagtaagagacattcagaagggctggtcttagagatttactagtttggggaggtcagagaacagtagcatatgaaagaacgctaagacagttcccagggttaggcatgggtgactagtttgattatatcattttgtcccactcacaatgacaaggagaattactgagggaacacatgatggggctgatagagtgctaggaggtggatacatgaaaatgtaaatgtcatcattttgaacacccatggcactccaagtgagattccctaacatatatgatatacagacagatatatgagtttgaaactctagaggtgaatgcgaatttaggaatccctggaacacaggtcatgacttcagtaatgggagtcaaagattactcagagaaagcacagaatgaaaagagaagaaagaagtaggccaaggaagaagagattggaggagaccaaggcagggtgataagatcaaaacagaagaaaggaatctgatggaagtcccattagattatcatgtcccttcccagaggatagggacatgccttttttgtcttttatactcaattatcacagggcctgacacagaagccactcaatgtttttttaaattgggttctactattcacagtttgctgtatccaccaggggagaaaaaagtataaacaagcacagatatggatttttttacactgtgtactaaaggggccagattatacacagtattttatgccttacttttttacttaatatatcttagaagtttgcacatgcttatggaaggactggctgcattttttggtctacaacagaatactctattataaaactatacactataatttttatttaaccaactgtttattggtggacattcagaatggaggaatgtttcaacaagggaacaatcaacagtatcaaaatactgcagaggggtcaatttggggactaagagaggagacactggatttggcaactaggagataaattttagtgcaatgatgaaggcagaatccagattataatgaattcaatgaaaaaagctgaagacatatagattatctgctcaagaaactagctatggtaaactggcagaggctgtaagagtgggaggtgagttttctccttcatgtaaatatatttacttttataaacactaggcccaattttatatcctacttcatttaactttatgaacatgtttatgtaatgttttagtaaaaaataactcatttttgctattataaaactgttatctttagatgttcagaagcaacttcctaaaaggaggtagcaataacagagctatgtctatcattctttcccatcaacccccttgctggagaaggaaacatgtgtccatctagcttttaattaatttttacctcttatcttcatggctctccatataaaacttaactctttttttggtatatgtgtatgtatatctataactagagagagagacagagagagaagagggggtcttgccatgttgcccaggctgatctcaaactcctgggctcaagcaatccttccaccttggcctcgcaaagtgctgggattacaggcatgaaccactgtgcccagcctcagccttaactcttaaaatatcttcaaatccctgttcttcatttcttaagaatatatgcgtttaaaccaactataacttattttgacaaaaactggagttaagacccaaacttcctcagatggtcagttctcctaagactatttacagaataatctatcttttccctattaagttaaaataccacctttgtcttataaaattctcattagcatgactctggttctaaacttctattgcctttatctgtctggcccagggctattccacaatattttatttaatatctggttgaacaagtctattctttattattttttattatttactcttctacacaaactttagagtcattttttcaagttccaaaaataaatctgctgggtttttttttttttttttaagacagggtctcactctgtcacctaggctggagttcagaggcatgatctcagatcactgcaatctttgtttccaaggctcaagtgatcctcccacctcagcctcctgagtagttgagactacaagtgtgtgccatcacacccagctaattgtcatctacccgcctcagcttcccaaacttttgggattactagtgtgagccactgtgcccagcagaaattatatttataaattaatatgaagacatggtgataattaacatatttataatatgaaatctgctcatccagggacatagaatgcaaatctttcattccactcagcaaaattttgtcatgttcttgataaaagtcctgcacatctaagtttattcctaggtatttaatttttgctgaaatacttgaaaaaatactttatcactatatctcctatgtgattatagctaatattggggtaggctattgatttttcagtaatggggcttttaaccagcaaccttaaaaattgttgtcagttggttcctttggatatttttaggtaaacaattatgtcaacttaaaataatgattgttatttttctataaagattatgacatcatgggaaaatacggtaaatgcttttttaaaatttttaatttttaatttttttagagatggagtctcactctgtcccccaggctggagtgcagtggcatgatctcggctcactgcaagctccgtctcccaggttcacgccattctcctgcctcaatctcccgagtagctgggactacaggtgcaccagccaccatacccggataatttttatatttttagtagagatggggtttcaccgtgttagccaggatggtttcgatcttctgacctcatgatccgcctgcctcggcctcccaaagtgctgggattacagatgtaagccaccatgcccagcctagtaaatgctttttaaaagaatataaaactatagagaatatgacctcaactatttaaaaatatgtataagggttatgtattttactagcaaagaaaaaatatatactggtagaaaatagccatcatgtcaacagtgattatattaggtagaaaaattatgagagactttaattttttttcttttctatattttactattgattgcttatgagttttataagcttatggttgcttatgagttttataataaaggtttttaaaatttttgcaacatggaaagttatacttctttatatactaaaaacaaaaacaaaactttctatttaaatacctttgacttttactgcagacttacagacccttgaaagaaaaggcaattccctcgcactagttctggtgtgactctacccatctctcccttcagttccaccttggtcttttttctacctcccaccttggctagtcatctctacccaaaatgcttgcttggcttaatggttagcattcaggaaaaggagatcttgaattcctaatctaaactaaggttatacatgtgggaaataataaagagaaaccaggtagtaaataagatttgaaggacttaaaatacccagactttaattcctctaagattatagtcattaatcatgcttttatatcatattatctcttaacattatatcatattatctcttaacatttaatttctaaatataatgttcatgaggaaaagagaaaatagcttggcttctctcttcactgaatggttgttcttagtatcttctagatgttccagaactgatgtcagatttggctcgtcagagtccacaaaacatattggtgagaaagatgaagaggattcctgtttagcacagagacacctatgttaaacatttacatacagactaacccaaatatgcaattaaaccacaccactaaatggcaagattaacatggatttaaacaaaatgtatgggggggaaaaggcaacacattaaaaccaatgtgaggagttggacttttgaggcagccattctctttgcatagcactgtctgctactacagctcatagaagtcaataattttcttcagcactggtaggcagcctctaaatggccccaatcaccctcacctcctggcattcacacccttgtaaaattcccacctctggacctagtgactcacttctaacaaagagaatgcaacagaagtaataacatcacttctgagatgaggctacaaggacaaaacgatgcctgccttggtcacccttctcctgctctttccattgctccctctgatggaagccagttgccatgtgatgaggtgccctatggagaggcccacgtgacaaggtattgtaaaagccctctgaccaatagtcatctagaaacagaggcccagtacaacagcctgtgagataaatcctgccaacatatacgtgagtgagcttggagatggattccctccctatcctgccttgggatgatcatagccgccaccaacaccttcactgcctggtgagaggccaagcaagtgaacccaaggtaaactgcacagaatcctgacccacagaaactgtgagataatgtttgttgttttaagctgctaaatttgttacagagcaatagataactaattcaaacaccataaaattctaatattttattctatcacacaaaccaagtaataccaagaaatgccattgctatacatgtatttttggaacacaattacatgtgattttttttaaaaagctaatgaactaagcattatgtgcttttaccactaacagacatttactctgttactttctactgtttcctattataaattggggagaagccattattattatatattagcttcacaacaactaggttcaagtcatggaaaacaatttcgcacaaactttaggaaacactgctttgaaaactgtaatctgaattatagctgaagccacagaaaccaattatttaccaaaggttcttttaagaaaaacaagttggccgggcgtgatggctcatgcctgtaatcccagcattctgggaggccgaggtgggtggatcacgaggtcaggagatcaagaccatcctgtcttgatcaagaaaccctgtctctactaaaataaaaaaaaaattagcggggcgtgatggcatgcgcctgtagtcccagctactcaggaggctgacacaggggaatcacttgaaccagggaagcagaggttgcagtgacctgagattgcaccactgcactccagcctggtgacagagaaagactctgtccaccccccaaaaaaaagaaaaaagaaaaacaagttttctggaaggaggacatcattaacagtatatctcttcaataatggtttattttactattctcattcttctcattcctctcttactatgtcccaaatctctttacaggctaaaagaaactcttcagaattaatcctattcatgaagaacaccacttactgagtattgcattttcttcttcaaattcttcaacatgcattgggaatacaccctatggaccatttttatgtgtttagttttgggttgtttttttttttttttttttttggctaaagaaactgcaactagatttaggacctcattctattaggttagtatttgtctagtaaacttcagcataagcaaaataaaatacgtgttgttattctggactgaaacccctcaaaaccatattttaaaaattataaaaataaatgaactgaaatcatgtttttaaaaatcttgtagatgaaaagatatgatatatagtaggtttaactacctatttcaacggttcccaaagtggggccctcagatgcccaggtccaaactattttaacaggaacactaacatggtgacatttgctttaagggtgcaaatacaatagtgggtaaaaatgctggtactttagcacaaacagaggcagtaacaccaaactagtcatggtattcttcactatgcacaggaaaggtttaaaaaggaagggcaggctgggcatggtgtctcacgcctgtaatcccagcactttgggaggtggaggcaggtggatcacctgaggtcaggagtttgagaccagcctggccaacatggtgaaaccctatctttacaaaaaatacaaaatttagctggacatggtggttgtatgcctgtagtcccagctacttagaaggctgaggcaggaggattgattgagcccagaaggtggaggctacagtgagctgtgatcatgctactgcactccagcctgggtgacagaataaggccctgtctcaaaaataaaaagaatgtctatgatgaatcagtgaaaattttactacatttttatccttgaatatgtctttttaatatttcaagtgatgaaattggaagtacacatgagcatttctacagactgcctgagaaaaaaccctcgtgtgactaagtcgtgaagtgaattaaccactttaatggaataccatttttacttgaaaggatgactgacaaacaatgttatttcaacttgggtttttgggagacattttctcaaaaaaatgagattctgtcatttcaagaaaaacaacaggcaggccataataaaattcaataataaaattgctaataataaaattcaagcttttgaacaaaaaattagttttagaaaacttatatccaccatagctttccaaaagtattctgatgagattgatggtgatattgatgaatgtattttgatattgtataatcaaacgtatcaacatgtagaagatcttgaaccattattttctaaatgaccaatgcatgatgttgtaatatcatgcaaaggtaaaagatccaaagttcaagaaaaaccaagttttgatggagtatcaaaaaagaagcctaggcaacatggcaaaaccctgtctctacaaaaagatacaaaaaattagccaggtgtggtgatacacacctgtagtcccaactactctggaggctgaggtgggaggatcacctgagtccccggagactaaggctgcagtgagctgtgatcacaccgctgcattccagcctgggcaacacagcaagaccccatctcaaaaaaaattaaaaaaaaatatatatatatatctccacaatgatctaaaatggctatctgtataagattggacattgttcatgttttttaaagcaaatatcacacaataaattgaatgcagatgaaaatgacataccaaacatcaaagaaatttgcaaaaaatgtaagactgtgctacttttggtttagaaatgttttcataaaagcatttataacaatatgtggtgagcttttaaagaatagtttaaatatttctgatttaatttctagtgataaataccaatagatataacctacataaaccaaagctccttgggccctcaatatatttttaagagtataaaggagtcctgattccaaaactttgagaactgctgccttcccctccactttccttccttccctagaatttcttcctgggaagaaacatccctttgccattccatattaacttacagagttccactgaggccagttttgctacctccctcccatctttccacctccctctcttgacacaaaacctaaccaaaggactttaccagcccaccccatttccagtgattagctgtcaaggtgggctaagccaagaaaatctgggttttctctgagactagccctctctttctgggagattggaatcacaggggcaaggctggctaccttgggatagtcagaattcatcttgcctaaatggggagaggttaggcaagtttctagaaagccaaactgctttctagaaagtcaaagataattatactttctgccacaactgtgagaatgcccattttctaacatttttaccaaactgataaataaaagctggtacctagaagaaaaaaaggccgggtgtgggggcttacatctgtaatcccagcactttgagaggccgaggcagacagatcacctgaggtcaggagtttgagaccagcctggccaatatggtgaaaccccgtctccactaaaaatacaaaaattagctgggtgtggtggcaggcacctgtaatcccatctacttgggcagctgaggcaggagaattgcttgaacctgggaggcagaggttgcagtgagctgagatcacaccattgcacggcagcctgggtgacaagagtgagactttgtctcaaaaaaaaagtttccatataatataatttgttccatctctagaaaccaattcagcaatgagaactgaaagccaccacttggaaggtttcaaggattcagctctacctattgatgtctaaagcattagttaaggtagaaacacacacacacacacacacatacagcctatgtattcagtaccaggaaacatgacgggctagatggtataatcatccaacagaaagcgcacaataactgaagccactgcagaggagtaagttacgacacggatctacaatattgttgagtgaaaaagcagattacaaaaaaaatctgatttttcaagggagagggaacatatacaagcataggagaaaagagatgagcagatgactggaaaaatacaaaattctgatagtggtaccttctgagtggtagaattatcagtaatattttctagttttgcctaaaaattttctaaatttcttaaaataaggttttgttatccatattataaaagatccaccaccccaggaaacttaaccttcagcacaaactctacaacatgttcaaagtttgttcagtttaatatttaagagacaatctattttgaaagacatctaaaatgatgaccaatatttaaacctatgcattaatatttttcaatcatatgctttaaattttgtaattttgataaggttaagctttatatccaccttgaaaaggtaagttttctatttgtcttcaaaatatgacctaaaataggccagtttttaaacagcgaatggtgctcaaaaaccgcaatataaattcaggcagtgttccttacatagaatgtttaagtgcttctaacactgctgtttttcaccagttatgaaaacacattacaattatctaagcatctaattattcaggtcccttgtttctcctccattctatcagttttatagtaattttaaggcctgtgaggatgaagttgtctgtgatggctaccacaaaggttactataagtggacaaatttccaacaagtttatctccactaccatccccaccataaaactgtcttgatcaagggcaacacatttcaaggttaaccaagacaacctctttacctgtcactgctcaagaaaaggattttttggtcttatttagaattaactttctgtatctatttttctccataaatccactgaggccaatgtgtggctctatctcaagctccagcaagcaaaactgcctgccagaaggttcagtttttgtatctttccaaatgtaggacacagctctcttttgatatcataattatttgaaaattgatgcacaaacttcttcttgaaagttcagccaggcacagtggctcacgcctgtaatcccagcattttaggaggcagaggcaggtggatcacgaggtcaggagttcaaaaccagcctggccaagatggtgaaccccgtctctactaaaaccacaaaacttagccaggtggggtggcaggtgcctgtaatcccagctactcgggaggctgaggcaggagaatcgcttgaacctgggtggcggaggttgcagtgagaccagatcgtgccactgcactccagcctgggtgacagagtgagaatccgtcttaaaagaaaagaaaagaaaaagttcagatatacagcagttgtaattcttctgaaagctagttatgggacacattactttcacactttgctgttcaataaatgtggggtggagaataaagtaaactgacagaattaccatataaaataaaattctaagtgctctgacaacaaaagaaacttaaaacacacacacacacacactctctctctcacacacagttttccctgctaatcattttacaactaaacaaccaaagtagctaacccagagcccacaacagcagagtaaaaattctaacacttggttaaataaaaatgcacatataccgctgtgagctaaaaaaaaatgcttaagcattcaaagacagacagcaattacagctactgagaacatcattgtaagcaaactgaggcagagaaaacaaaggtgctgatgaggaattgaaccacctaacctgcagaaacccactggatggtttcctaggttccgagttggcattatctttcagagtgatttctaaaagagatcacataatactgttacaaaggatctggagaaagggacccttgctttatctctctggctctccagtcatgctttacattttcacttcttacgctctcatatgaaatcaatttacagacttccttcaagcccttagagacctttttgtactatccatgacaagttcttgatgtagctctgcacttttgacaaattcttagcagttaactttcaaggcagttaagatttctgttcaagcacgatatagctagaatagggtcatatactcaataaaacaaatatttaccaagcatttactgactggaagataaaaagcacaaagcataattataaaatattttcccctgccaccataaaaaaaaaattaaaaaggcctacagaatatagcataacatgaccaaagcaaaaatagtgaggaccaaagaggggaggaagggaaaatatcagcatgaactgaatatgacccaggagagccttgatggtcagacatgtaaagacaaattgggtagggtgaaggggtggaggtcagggacgcatcctacaggggaaaaacagctcacacagaagcctgaaaggaaaagcgggcagacacctgtacgggactcttacctgccgccttgactgtacaatgagcccttccagaacacagcagcgcgcggccaggccccggggagagggatcgctcaaacagcaccagaggctgcattccaacttttcctccgtcaacgaggccgttttcattgttagtttctccttaaacacaaacttaaaaacaactggcttaaatctactatcgcatcttgcgtgatcatgtttgtgccttacagtgacaggctgcaaacgatagaaattcaacccaaactgtcacaagaaaagaaggaaaggcttgtaactacttaaacatattgctaattaaagatgtctggaaaattgactcaaaaacaaaaacaaaaacaaaacaacaacaaaaaattggccgaacacgcgggaacagggaaaacctgactgaagaatgaggccttaaaacttaagggccttgggtcccggcgcggtggctcacgcctggaatcccagcactttgggaggcagaggtgggtcatttgaggtcaggagttcgagaccagcctggccaacacggtgaaaccccctctctactaaaaacacaaaagttcaccagccttggtggcggggcctgtaatccagctactggggaggctgaggcaggagaatcgctttaacccgtggactgtcaagagacataggctgcagtgagccgagatcccaccactgcactccagcctgggcgacaatgagactgtctcaaaaaaaaaaaagaaaagaaaaaaaaacttttttttttttttgagagaagtctcgctcttgtcccccaggtttgagtgcaatggcttaatctgggctcactgcaacctccgcctcccgggttcaaacgattctcctgcctctgcctcccaagtagctgggattaaggcgcctgccaccacgcccggctaatttttgtagtttttagtagaaacgcggtttgaccatgttggccacgctggtctcgaactcctgacctcaggagatccgcccgcctcggcctcccaaagtgctgggattacaggcgtgcgccaccgcgcccaggcaaaaaacgcgagcatctcagaggccttttcccttccgcgcctgggctcaaacgacgctggagcgccccgccccgccccgtcgcggtcccgggagcagtcccgctgactgagggcgaccatgggtcccaagagggctccggccgccgcgggctcccacctcggtgcgtggcgacggcggccaagaggggccagcggcccccgagtcagccccgcgccaggagccggagagacgcgccctccgcctcctcccacccaagcctcgcgcagtcccgggggcggggcggggccagctgagggaggaaggggcggggacccggggcctctacccgttaggctgccgttggtcccgagactcccccatctgcgcccccgccctgccctgcgaggccgccgccgcgcgccccaccgtctgttgcagtggagcgtgagccgcggctgcggctcctggttcttgtggaaggtagacgccagcaacttcagcttggccttaaccctgacagggacatcttccctcatctccggcgggaggggcgcggaaggggagccgctgtcatggctgcgaccacccagcgggaccgcccggccgagcgctcgcggcttcgcctctccccgccgcctcaaccttcgtgggagcgcggatggaaaatgggaaggggcaccgaggcctcggcggggagctgcgcggcggcctcgggggctgctccctttgcgaccgacgccaccgataggaggggcggctcctgtcaagcctcagcttaaaagggcaacagcggccgggcgcgggggctcccgcctgtcatcccagcactttgggaggccgaggcgggcggatcacgaggtcaggagatcgagaccatcccggctaacacggggaaaccccgtctccactaaaaatacaaaaaattagccgggcgcggtggctcacgcctgtaatcctagcactttgggaggccgaggcgggcggatcacgaggtcaggagatcgagaccatcctggctaacacggggaaaccccgtctctactaaaaatacaaaaaatgagccgggcgcggtggcgggcgcctgtggtcccagctactcgggaggctggggcaggagaatggcgcgaacccgggaggcggagcttgcagtgagccgagatcgcgccaccgcactccagcctgggcgacagagcgagactccgtctcaaaaaaaaaaaaaaagaaaaagaaaaaggacaacagcaccaccgtccccgctaccgcctgggaaagggctgccccaaccctgccaccttccctgtcacccctcaacccggcgcgcacccgttttggcggttgcacgagtccagagcgtgcgcgcgctcccggctgccccctcctccccttgacccagcacctttctgcccgacccatctagtccctacattcctcacactcgcctactggaggctcagggcggcacaaccaccaactgtagtgtgtgtgtttctcccgagtgtgtgtgtgtgtgtctcccaagggaacagagcactgctgagttcaggttgattattaggtcgtggactgtcagcaaaatgcagtcacaagaaggctgtgggctgttttgtgttttgcggtgacatcatgttgctcatgttttatgtttttcagagttcattagtttctatttgttctcagttaatatccacctcaatagattgcataagtagaatacccccaaactgaaagtcacctacataaagtgtagtgaaaaatatgtcacccacttaaactatagcttaaactatagttgaagttgtgtacacactagttttgtgtagccaacactaggtaatgggtaaaggcacaggatcctggggctctactgcctggttcaatttccaactttgccatttgctgactgtgaaatactagacaactttaagcctcagtttctttcttttttttaaacttaatcccaaatgtgatagtaagtctcagtttcttgatctgaaaaacagaaattattcaatgagagtctgtgaaaacattaaagtttttaaagccactgcctggctcaggaaagtcctcagctttagccgttattagctatgataattattgtgttggctacacgtgcattaatgaggtaggaaaatgctcaaggataacaaccaagtatccagattatctcatgagaccgagagagatgcatatgtgtgcatgctcatgtttcagctcagagcgctttgtctagaaggctcttgaactcagaggcccaggcactatcaacttgactttgcagtggaggcatcacttttgttgatcaatgaaattgacataatgctcattttttttttagcaccgaccatgtgccgagagctaactgtgtcaagaagagcatgcttcagttggctggagtgagcaattcaacttgtggaggagtgagaaatgttagtgttgagacaagaaacgtaaaaccccagggtaaggtaggaatcagtgaaaggcagaggaactgccgtccagtaatgagttaggctttgctggcttctggccctacagatgactctttggagaggaaaaaattaagctaggcccgagggcacagatcctaagggaatgctggcagcctaggctgtctatggaagagaagcagagggtggcacctggttgaaagagggggttgggggacagagcttgaggctgtgtttacagatggagtcctctgattcctgtgactggggaaggagatcgtgctggatcagggcacctcaaatcagaactcttcccacccacaccccttcttttcagggcgtctttcattgcaaacagtagataaactagttggaaaactcagcagattctcacggtggtgcctagcaggccaggcctagctgccgtttaagctgtgactgagggtgatgccactggcctgtaaacacacattggacaatctttacgtccgtggacacgccatgccccacagagacagctgtgcatggttctttaggtttggggtgctgtgctggcagttgcctgataaatgtgtaggattaaaatgggatgccctggagcttagctaacctttatcccccctcccccctctaaaatgaaggggctgctagttttgtttgctttatgaaagatggatctgttattgtttttagaacctttggagaaagatttgttgggaggaagcgatcctgaacccccagagattttctcatttactggtgcaccagctttcgagtcctaggtcttcatcctggctcagccaccctccagctgtgtgacctttgagaagttgcttgactacactgagtctcattgtcacctatgagtggaggttgctacattgctactgtgtggagcacctacccccagccactcttacagggtgatggtgacgattaaatgcaataataaggctgaaggaggaggatcgcttgaagccaggagtttgagactagcctgggcaacaaagccagaccacatttctatgaaaatgtttttttaaaaaattagctggacttggtggcttgggcctacagtccagctactcgagaggctgaggtgagaccacttgagcccaggagcttgaggctgcagtgagctgtgattgcaccactgcactcccgcccaggaaacagagagagaccctatctcaaataaatgaataagtaaataaataaaataataaaataatgcatgcaattagtacactagtacatgatcaggcacatgataactgctcgataaatggtagcctcagtaaactttataatgttttaaaggagaatgtcctttggactcagcctttcaaatgacagagcatttgaaaagactgatttgtatgatggctatttcctacagatacaagactgtacctccagggactcaaggcattggctcagtggggcaccttgttctgtttactcttgttttggtcagcaccgattgccctagggctaagcagggctgccaccacagactcagttgccaagagtatccccctccccaagctagccatgggaaagccactcgcattgtaagactacaggaaatcaaagggaataaaaagcacaatttagtcacctactctccagttgatgggcaataggtttttgctattttgaacagagctgttaggaacattccttgtccacatcccctgttttatataggcaagaatttctcttccacgtagagtagaattactgggctaggaggagtgtgaatattgaaccttatgagatggagccaaactgttttccaaagtggtcataccagtgtatactcccagcagcagttcttaagagatctcaggatgtctatcttctggtgatttcacaagcagtcaaaaagaatgaacgccagcaataaacaacaataagaactttagcaatataatattgtgagaaaaacaaattccagaaggatgcatacagaatactttatataacatggaaaagaaaatgtatagacccagcatggtggctcatgcctgtaatcctggcactttgggaggccaaggcaggaggattgcttgaggccaggagttcaagaccagcctgggcaacatagcaaaaccctttctctacaaaaactagaaaaattagccaggtgtggtggtgcaggcatgtagtcctagctactcatgaggctgagacgggaggatctcttgagtttaggtgttcaaggttacagtgagcccatgattgcaccactgcactccagcctgggcaacagaatgagaccctgtttgcaaaagagaaaaacaagtaaataagtaaaatttaaaaacaaaatgtgggctgggcacggattctcatgcctgtaaccccagcactttgcggggccgaagtgggtaccttatgaggtcaggagttcaataccagcctgatcaacatggtgaaaccatgtctctactaaaaatagaaaaattacccagggtggtggtacgcgcctgtaatcccagctactcaggaggctgaggcaggagaatcacttgaacctgggaggcagaggttgcagtgagccaggattgtgccattgcactccagcctgggtgacaaagcaagattccatctcaaaaaaaaaaattatttttttaaaaagataacattgacaaacaaaaggaaacatgacaactgataccacaaaaactcaaaggatcactagtggctattatcagcaactatatgcaaacaaatgggaaaacctactaaaaatggataaatttccagacacatccagactaccaagactgaaccgggatgaaatccaaagccagaacagaccaacaacaaataatgggatcgaagcagtaatgaaaagtctcccagcaaagaaaagcctgggacctgatgattcactgctgaattctagcaaacatttaaagaagaactaataccaaccttacccaaacgattccaaaaatagagaaggagggaatacttccaaactcattctacaaggctagtattaccctgataccaaaactaaagatacatccaaaaaagaaaactacaggccaggatcactgatgaatattgatgcaaaaatcctcaacaaaatattagctaattgaattcaacaacacattaaagttggggtgcagtgtcccaggttcactcaacccttcccgttttcttgtctgtgtgtgtctactttgctctgttccctggtggcagcggcggtggcaatgttggtgcatgggcctcctaggacaaggggaaagtgagtatgcccttttcttgcttcctgccaggcatctgcagcctggcgcaagctctggccaggtcttcaagcaaggtacctggagatgttcttttccaatttctggattggtaacttgaggcaaattctgggcactagagtcaggactaagatgagacttgaatcaggggagtctggggtcctgagaggcagaggcctgaaaccatctagagcatgtggggacctgggtgtgtgttcaggccagttgcctttctctgtgcttcaatgttccaggtacccttggagggactgagatcctagggattgctggagcctggctgcatggcctggccaccctgatgcgcttgcattctccgtgacaggacagcaaggctgaggagaatggctcccacagcttcatgcactccatggacccacagctggagcggcaaatggaaaccacccagaacctggtggactcctacatggccattgtcaacaagaccgtgtggaacctcatggttggtgcgaagcccaagaccatcatgcacatcatgatctacaatgtgcatgcaccgcctcatgggggtaggcggctcctgtggcactggggatgcaggtggccatgttggcctgggggagatgctgaccagccctatgggaccaggtccagggagggaggcatggtccagaccagagctgtctcatagaaatataacatgggactgaggacagtggtccatgcctgtaatcccagcactttgggaggccaaggcgggaggatagcttgagcccaggagttcgagaccagcctgggcaacatagtgagacctggcctctacacaaaaattttaaaaatagctgggcttggtggtggcacgtgcctatagtcctagctactcgacaggctgacattagaggatcactttgagcccaagaggttgaggatgcagtgagcggtgatctcgccctctatactccagcctagcgacagagtgagatcctatctccaaaaaaaatttgaaaaacctgagtagacaggtgtcctggtagcatgataggtccagggtcccctcccagatctgtgacttgcacaggcgacctttcctctggacctcagcgtccctatctgagtgagaaaagggcaatggggaggcagatctttgagtttaagctgtgtagaagccacatctgaaaagccatactcagggcttcaactccagcacacagtcccagcaggcgccagcgggaggccagggcagcacgggcatcaggacccaaactccttccttctttgcccactctcagaccaaggagttcatcttctcagagctgctgtccaacctgtactcgcgtgggaacaaggagacactcctggaggagtcggcagagcaggcacagcggcgcgacgagatgctgcttctcagagctgctgtccaacctgcactcgcgtgggaacgagaagacactcgtggaggcgtcggcagagcaggcagaccaaggagttcatcttctcagagctgctgtccaaactgcacttgcgtgggaacgagaagacactcatggaggagtcggcagagcaggcacagcggtgcgacgagatgctgcttctcagagctgctgtccaacctgcactcgcgtgggaacaagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagcttctgtccaacctgtactcgcgtgggaacgagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacaagatgctgcttctcagagctgctgtccaacctgcactggcgtgggaacgagaagacactcgtggaggcgtcggcagagcaggcagaccaaggagttcatcttctcagagctgccgtccaacctgtcctcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagcggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcttgggaacaagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagacctgctgtccaacctgcactcgcgtgggaacgagaagacactcatggaggagtcggccgagcaggcacagcggcgtgacgagactcgcatgggaagaagaagacactcctggaggagtcggcagagcaggcagatcaaggagttcatcttctcggagctgctgtccaacctgtactcgcgtcggaacctgcagacacttgtggaggagtcggcagagcaggcacagcggtgcgacgagatgctgcttctcagagatgctgtccaacctgcactggcttgggaacgagaagacactcgtggaggcgtcggcagagcaggcagaccaaggagttcatcttctcagagctgctgtccaacctgtactcgcgtgggaacgagcagacactcgtggaggcgttggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaagaagttcatcttctcggagctgctgtccaacctgtactcgcgtcggaacctgcagacactcgtggaggcgtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcgcgtgggaacgagcagacactcgtggaggcgttggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacactcgtggaggcgtcggcagagcaggcagaccaaggagttcatctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcacgtgggaacgagcagacactcgtggaggcgtcggcagagcaggcagaccaaggagttcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtggcaacgagaagacactcgtggaggcgtcggcagagcaggcagaccaaggagttcatcttctcagagctgctgtccaacctgtactcgcgtgggaacgagcagacactcgtggaggcgttggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacactcgtggaggcgtcggcagagcaggcagaccaaggagttcatcttctcagagcttctgtccaacctgtactcgcgtgggaacgagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcatgggaagaagaagacactcctggaggagtcggcagagcaggcagatcaaggagttcatcttctcggagctgctgtccaacctatactcgcgtcggaacctgcagacacttgtggaggagtcggcagagcaggcacagcggtgcgacgagatgctgcttctcagagatgctgtccaacctgcactggcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaacaagaagacactcgtggaggcgttggcagagcaggcagaccaaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatgtaggagtcggcagagcaggcacagcggcgtgacgagactcgcgtgggaagaagaagacattcctggaggagtcggcagagcaggcagagcaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaaccagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcatcggcagagcaggcagaccaaggagttcatcttctcagagctgctgtccaacctgtactcgcgtgggaacgagcagacactcgtggaggcgttggcagagcaggcagaccaaggaattcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggcagagcaggcacagcggtgtgacgagactcgcgtgggaagaagaagacactcctggactagtcggtagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaacgagaagacactcgtggaggcgttggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcatcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcacgtgggaacgagcagacactcgtggaggcgtcggcagagcaggcagaccaaggagttcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagaggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaacaagaagacactcgtggaggcgttggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatgtaggagtcggcagagcaggcacagcggcgtgacgagactcgcgtgggaagaagaagacattcctggaggagtcggcagagcaggcagagcaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaaccagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcatcggcagagcaggcagaccaaggagttcatcttctcagagctgctgtccaacctgtactcgcgtgggaacgagcagacactcgtggaggcgttggcagagcaggcagaccaaggaattcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcggagctgctgtccaaactgtactcgcgtcggaacctgcagacacttgtggaggagtcggcagagcaggcacagcggtgcgacgagatgctgcttctcagagctgctgtccaacctgcactcgcgtgggaacgagaagacactcgtggaggcgttggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcatcggaacctgcagacacttgtggaggagtcggcagagcaggcacaccggtgcgacgagatgctgcttctcagagctgctgtccaacctgcactagcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcgtggaggcgtcagcagagaaggcagaccaaggagttcatcttctcagagctgctgcccaacctgcactcgcgtgggaacaagaagacactcgtggaggcgtcggcagagcaggcagaccaaggagttcatcttctcagagctgctgtccaacctgcacttgcgtgggaacgagaagacactcatggaggagtcggcagagcaggcacagcggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaaccagccctcgcgtgggaaccagaagacactcgtggaggcgtcggcagagcaggcagaccaaggagttcatcttctcagagctgctgtccaacctgtactcgcgtgggaacgagaagacactcgtggaggcgtcggcagagtaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcacttgcgtgggaacgagaagacactcatggaggagtcggcagagcaggcacagcggtgtgacgagactcgcgtgggaagaagaagacactcctggaggagtcggcagagcaggcagacgaaggagttcatcttctcggagctgctgtccaacctgtactcgcgtcggaacctgcagacacttgtggaggggtcggcagagcaggcacagcggtgcgacgagatgctgcttctcagagctgctgtccaacctgcactcgcgtgggaacgagaagacactcgtggaggagtcggcagagcaggcacagcggcgtgacgagactcgcgtgggaagaagaagacactcctggaggagtcggcagagtaggcagaacaaggagttcatcttctcggagctgctgtccaacctgtactcgcgtgggaacgagaagacactcctggaggagtcggcagagcaggcagaccaaggagttcatcttctcagagctgctgtccaacctgcactcgcgtagggacaagaagacactcctggaggagtcggcggagcaggcatagcggcgcgacgagatgctgtgcatgcaccacgtgctgaaagaggctctcagcatcatcggcgacatcaacatgaacaccatcagcacagctacgggggcccgtggacgactcctagttgcaggtacagagcgtcccggctggacccaggtaccagggctggcccccactagccccaaagccccccagcctccatggctgagcttgtgggctcttggaacaggctctgtgcccaagctggcagacatgggctctctctggagctgtcagagagctcgtggtttatggtgtaagggctgagagcttggagggggttgtgtgcagggctgtactctgaggcggccagaggcctaggaatgtcatcctgggcacgctgtagctgttgtgaagtctgagtcatgctgccagggagggcatccagctcccagcctgggagtgcttagagccaaatctactgcagagcaggggtgatagtcagggtcccacctcctctatctgttgacaatccagtggtgatctaagataaaaccttgagactcccatacacacggtcaacccacaacacacctcacaggccaggcagggacacacagtccccttccctccctcccaggtaccatcatagctgctagcgtgtggctgaaggcagggtccctggcccccgctgaagcactaccgccagccagcaggctcacgcaccttggtctgttgcttctagaggttgcttctgctattcagccgaggggaccatagtgcatgctggcccggctgagctccacccagcaagcccacccacctcccttgccatggactctccctcttctgcttttcccagccctcacctttgtgacctgcaacccccaacaagctgaggctcccctcttagacttataagtctatagccagtggcatccagctgcctgtcctccctacctcccccagggtcccttcagagggtcctgggctttctgactgcccaaaaggggctccggcgatcactccagccatccatcccttttagcttcatcatcctggttcaagcagtgttccttctctatcaggactggtggctgttgttttgggttcccaaaagcaagagatggccccgggccagtgggttcaaagacagggtgaccagagaagagggacactggagggggctgagcattgctctgaacggtgggtgcaccgccctgggtgccctgaaagaggccagcgtgtgtggggtggggagggccgccggagcccccaggcactaactgtggagcattgctctgaacggtggctgcaccgccctgggtgccctgaaagatgccagcgtgtgtggggtggggagggccgctgcaacccccaggcactaactgtgaagctctgcctccctccttcttcctctcctttcctttccagccccactttcccaggagcctcgccatacccgcacctgtgccctccccacccctgccctcccacagctgctgtggcatgcctgtgctctgcacttgcctcatcagctctctgctcacttttctctctcctgcttctctctgcttgcttttctctctcctgcttctctctgctttctctccaactgccagctgattgggtccggcaagaccatcccatcctcagagccccagcccctccttcaacgtctaaacagatccctcctcttctcagtgacctccctttccaagcctgcctgagcggctgttctgtgacttgacagtggctcccccagccccaaagccagccccctacatctgcgacttagtctgttgtagtggtgagctgacacatccaggtgtgaccactgctgaaaacttgtgccccctttgtgatatgtcccgtcctgctctataaatatctataaatacatatatatatatatatatatatatatatacatatacacacacacatgcagcaacacctggccgaccgcctcgtctctagcgctgggaatcagtcaccctgctgtccttttggagtcttgtggcccaacaagagaaagctgtcccctgacattgctcctccaaagtgcgccacctccagtgagcctccctgtcatgcccagcctgtggacagccagcccctccatccctcccaccccccaccaagcatgggggtgctgtgcaggcctctgtgtggcctgacagtctctaccagtcctgctgtcccttggctgagaatcaaacccatttctggatggcagggaagtgtgtcctctgctggctgtgttctgtgtggagctcagaggacgggaaaggccaagccatttctagggtgctgttgggagctgtgaaaaggtcacaccctttccaagggacacttttcctggaaagcccctggagcttagctggctcttatcctgtgaagccggctctggccaccagggggcagggccgtgaactcagcctggagggagcctgaggggcagccggcactctggagggacacagacataacaggccaccaggtgcagacaggagagggaggcaaggggatggaacggaagacacctggggtgggtggaaggcagtgcccttaggtgctggtacctgtcttcccagccatggctagatcacgcttctgagcctgttggctgtcagggccgggctgcgccccataggtgccatggcagtccccgtggaatcccccaggcgtcaccaggcagcatacaggtaacaggcctggaaggtccccaacagcccagctggacacactcagacactccagggcttctcgttcagtggcacaaacaccaggacccagtgagggaaatgggaacacaccaggctgagcagtatggctaaatccgtttattccaaaataaaaagcaaaataaacaggagtcgcatcaccaggagccatgaccccatccccgcctcctttctctgtcctgtgctagcaatacataagtttcccagccacaaataatgatcagaccctcctccccatgtgccagctccaacctcctctaggtatgatacaggggcggccctaccctctggaatatacaaaacgttacatagatacaatatgtaaaccgggaaggggggccaccccagcagcccgtgccctcacctggtccacagttagccccactgtcccgcctcagctgcctctctgaataagaagatgggagcccccccgagggaaaagttactatggtgagagtaaggaggccatcagacctcctccaaacaaaccacctctgccagcctctggctcttaaataacaatcatcatcatccagaaatttgaggactcagccctggtcaaggcggcaaagggtctgtctttccccattagacagaggtcttgtgtggctaccctaattgtaaaggggtgactgggaaggggtggtagggtcatggtggcagtggagactccagccctacttctccaggctttgctgacagaggcctgcttttaatttttgtttttatcccatgactttttttaaaatcccgtaacttctttttcataactttttttgtaacttttcataaaatttttttctacttttttgccacaacttttttacattttttatcccataactttttcactctgtaacattttttaatcccgtaacttttttattttgtgttcttttaacaaacacttgcatagctatattacaattttgtaaaaatgaaacagattatctcatgccaagcgtgcccagcatttgcacactatcaacacctttaatactatagtttttcaagacatgcaaaacaaaattttaagtcaaaaacagcgctttgcaacatttaataatttattacattacagtagcatcacactagcagtcaataatgccactttaggcaaaagtttttcagtatttccattataccttctgtttacaagaattcataaattggtaaaattcattctaagaaaacttggcaaataaagctttggactggaattggcatttctttctctacttttcctttccaccatttctttcttttaaactatagcattcatattttaaaatgttttatttcagaactttaagatagcagttacattttttaatagttacattatttttaaatgactctttaagataaagttttagagaaactgtattatggatagggctgatttacattttcaaattttctaaaaatcagctttggttttagaactgatttctttttttcatttctggaaaacctatcaggtttaatcaaatactttaaaaataattattatatattgcaatctttaaataggtgttttgattattcctgcagaaattcaaattgattcagttgaactagcattttaaaattctatgtttctgatgaactctaaccttccttctaagcaaatcaaaagctgcattgtactgaatgaggaagagcacaaatacttggctcaatgaggtatcgcaaaagactgtatgcactttgaagaaagacaagttagtcatatgatttccattctttttagctttctcttaaatatatgacaaatacttacacaaagagtggtatttcagttaatgtagtaaatttatttccagactgacgttcagcttaaatatgccagtatgtgatttaatccataggcacctgatgaacacattattgtcagattggttacagatgctaaacgctatctgaaggtcattcgtagtcattgatatttatcagggtaaaagtgaagtgatttcaacaataaaagtacctttgaaataatttaccaatgtattagataaacccagtttcagaatgataaagaaaaaacgttaggccaaatagatgtggctaattaacagtggtatgatttctagcctgagggtttaaaatggacttaaagtaactgtctttaaactgaactcaaagaatgcaaaagcagcaagttcagaaaataaaaggcaagaacagaactttaggtccattttaaacccatgggctagaaatcgtaccattgttaattagctgcattatttggtctaacattttttctttgtcattctgaaactgggtttatctaatacattgatacattcatacaatttggaagagtcagttgaagtcacaaggacccaatatttgcgctcttgcagtgaatgcaggcaaatctgttattccatcggtaaaatcatattgttgctctcctgttaatgtcatatttagaaaagtatcatgaggacgccaaatgctaaaaatggagatggtctagtaactagaaatccccaccccagggagcgcacatacacatctccctacatcctaataatgtgatgtgttttggaacacagacattagaacttcatgaagtttgaactgttgagtctttcccaagcatcatcaagttatgatttaggcaatgtatgactgaaatcatttgttcatcatgcataggcacaatcacataaatattgcacaaaatatgtccctaactgaaaccgagaggtacaaaaacatatttcactcttagtaaacaagtttgtcaggaaatataactctgtgattgtatagacacatttcctgataatacattgacattcacaaacagtagattgcactgcagtttataaacattttaaattgcataaa
